United States Patent 9,050,297 (MODIFIED POLYNUCLEOTIDES ENCODING ARYL HYDROCARBON RECEPTOR NUCLEAR TRANSLOCATOR) - sequence listing, part 2

SEQ ID NO: 520 - DNA, 3172 bp, Homo sapiens
ctaagaaggagagtatgaggcgagctccggcccgggtgcggccgggcttcaggggcccaggcgccgctgctgccaccgccatctaacgctgcgccctggaggcccggcgcgcggatggtgccggtgcggctcgggtgttgaaacgggtgtcccctccccctcctcccctcccccacgcggtggtctcccctcccacccggctcaggcagagccatgtctcggggtggctcctacccacacctgttgtgggacgtgaggaaaaggtccctcgggctggaggacccgtcccggctgcggagtcgatacctgggaagaagagaatttatccaaagattaaaacttgaagcaacccttaatgtgcatgatggttgtgttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgaatttttaaggggccctgagatagctttgcttcgtaagcgcctgcaacaactgaggcttaagaaggctgagcagcagaggcagcaagagctagctgcacatacccagcaacagccttccacttctgatcagtcttctcatgagggctcttcacaggaccctcatgcttcagattctccttcttctgtggttaacaaacagctcggatccatgtcacttgacgagcaacaggataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagatttaatatcagaggaacaacaataggtgatagaataatgagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcag

SEQ ID NO: 521 - DNA, 1554 bp, Homo sapiens
cgcgtgcgtgctgcgctactgagcagcgccatggaggactctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcgacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagagagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctgtcacttgccccggatttaccaggcttttctcatgtcagctacttttaacgaggacgtacaagcactcaaggagctgatattacataacccggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccagggcctctgatccggaagcaggtgtggcccggggcatagacttccaccatgtgtctgctgtgctcaactttgatcttcccccaacccctgaggcctacatccatcgagctggcaggacagcacgcgctaacaacccaggcatagtcttaacctttgtgcttcccacggagcagttccacttaggcaagattgaggagcttctcagtggagagaacaggggccccattctgctcccctaccagttccggatggaggagatcgagggcttccgctatcgctgcagggatgccatgcgctcagtgactaagcaggccattcgggaggcaagattgaaggagatcaaggaagagcttctgcattctgagaagcttaagacatactttgaagacaaccctagggacctccagctgctgcggcatgacctacctttgcaccccgcagtggtgaagccccacctgggccatgttcctgactacctggttcctcctgctctccgtggcctggtgcgccctcacaagaagcggaagaagctgtcttcctcttgtaggaaggccaagagagcaaagtcccagaacccactgcgcagcttcaagcacaaaggaaagaaattcagacccacagccaagccctcctga

SEQ ID NO: 522 - DNA, 2643 bp, Homo sapiens
aagtgacgcatggtacttgcgcaaagacgacgaggaggctgcgaaaagttaagggccggaccgcaggctgtgctcgcttccggaagtggcttctgcgacaacatgcttgcggacctcggcttaatcggaaccataggcgaggatgacgaggtgccggtggagcccgagtctgactccggggacgaggaagaggaggggcccattgtgctgggcagacgacaaaaagctttggggaagaaccgcagtgctgatttcaaccctgatttcgttttcactgagaaggaggggacgtacgatggcagctgggccctggctgatgtcatgagccaactcaagaagaagagggcagccactacattagatgagaagattgagaaagttcgaaagaaaaggaaaacagaggataaagaagccaagtctgggaagttggaaaaggagaaagaagcaaaggaaggctctgaaccaaaggagcaggaagaccttcaagagaatgatgaggaaggctcagaagatgaagcctcggagactgactactcatcagctgatgagaacatcctcaccaaagcagatacactcaaagtaaaggatcggaagaagaagaagaagaaaggacaggaagcaggaggattttttgaagatgcatctcagtacgatgaaaacctctcgttccaggacatgaacctttcccgccctcttctgaaggccattacagccatgggcttcaagcagcccaccccgatccagaaggcgtgcatacctgtgggtctattggggaaggacatctgtgcctgtgcagccactgggacaggtaaaactgccgcctttgccctgcctgttttggagcgtctgatttataaaccccgccaggctccagtcacccgcgtgctggtgctagtgcccacccgagagctgggcatccaggtgcactctgtcaccagacagctggcccagttctgcaacatcaccacctgcctggctgtgggcggcttggatgtgaagtctcaggaagcagctcttcgggcagcgcctgacatcctcatcgccaccccaggccggctcatcgatcacctccacaactgcccttccttccacctgagcagcatcgaggtgctcatcctggacgaggctgacaggatgctggatgagtactttgaggagcagatgaaggagatcatccgaatgtgttcccaccaccgccagaccatgctcttctcggccaccatgacagacgaggtgaaagatctggcttctgtctccttgaagaatcctgtccggatatttgtgaacagcaacacagatgtggctcccttcctgcggcaggagttcatccggatccggcctaatcgtgaaggagaccgggaagccatcgtggcagctttgttgacgaggaccttcactgaccatgtgatgctgttcacgcaaaccaagaagcaggcccaccgcatgcacatcctcctggggctcatggggctgcaggtgggtgagctccatggcaacttgtcacagacgcagcggctggaggccctccggcgttttaaggatgaacagattgacatcctcgtggccactgatgtggcagcccgtggacttgacattgagggggtcaaaacggtaatcaacttcacaatgcctaataccatcaaacattatgtccaccgggtggggcgaacagcacgtgctggcagggctgggcgctcagtctctctggtgggagaagatgagcggaagatgctgaaggagattgtaaaagctgccaaggcccctgtgaaggccaggatacttccccaagatgtcatcctcaaattccgggacaagattgagaaaatggagaaagatgtgtatgcagttctgcagctagaggcggaggaaaaagagatgcagcagtcagaagcccagatcaatacagcaaagcggctcctggagaaggggaaggaggcagtggtccaagagcccgagaggagctggttccagaccaaagaagagaggaagaaggagaaaattgccaaagctctgcaggaatttgacttggccttaagaggaaagaagaaaaggaagaagtttatgaaggatgccaaaaaaaagggggagatgacagcagaggaaaggtctcagtttgaaatcctcaaggcgcagatgtttgctgaacggctagcgaagaggaatcgcagagccaagcgggcccgagcaatgcccgaggaggagccagtgagaggtcctgccaagaagcaaaagcaggggaagaaatctgtatttgatgaagaactcaccaacacaagcaagaaggccctgaaacagtatcgagctggcccttcctttgaagaaaggaaacagttgggcttgccccaccagagacgaggaggaaactttaaatctaaatccagatacaagaggaggaagtagctgtcgtggcctgaagaaattcatgggggcagcccttaaatcccttccctgtgggaagtcatcctggctggtctgtcttttctccatttgtttaaaaaaaaaacaaaaacaaaaaacaacactttggtgtggtggtatggtacgtagctattttcctaagcatgtctgtcaatctcccttcttgctgattagctttcatatgactatattaaatggaagtatttttgggaaaagagaaaccaa

SEQ ID NO: 523 - DNA, 469 bp, Homo sapiens
atgcgcactcttaagaggtcgaacggggagggcggcaggggctctggaacggaagtgacgcatggtacttgcgcaaagacgacgaggaggctgcgaaaagttaagggccggaccgcaggctgtgctcgcttccggaagtggcttctgcgacaacatgcttgcggacctcggcttaatcggaaccataggcgaggatgacgaggtgccggtggagcccgagtctgactccggggacgaggaagaggaggggcccattgtgctgggcagacgacaaaaagctttggggaagaaccgcagtgctgatttcaaccctgatttcgttttcactgagaaggaggggacgtacgatggcagctgggccctggctgatgtcatgagccaactcaagaagaagagggcagccactacattagatgagaagattgagaaagttcgaaagaaaagaaaaaaaaaaaaaaaaaaaaaaaaa

SEQ ID NO: 524 - DNA, 2408 bp, Homo sapiens
aaaaaggacagcgagcggggagccccgaggacccccttttccctgcccagggattgagctccagagcctgttagggagctacccagacaggctttagttcctaaagtgctgaggaaacgcacggggcggtaaaggggaggctcgtcggtgagatggcgccggatctcgcttctcagaggcattcagagagcttccccagcgtgaactctcggccgaatgtaattttgccaggccgcgagggacgcagagaggggctgccaccaggcgggggcacgcgcggtagtcttgtccctacccgcccggtgccgccgtccccggctcccctcgggacgagtccgtacagctggagccgttccggacccggaaggggcggtggcgcagggtcctcgcgcgtcccacgtggggtcccgggcccagcagtctgcgcaccgggctcgctgctgcaccacgcgtcacccacgcagaccatggcagccgccgacggttcgctcttcgacaaccccaggacgttctccagacgtcccccagcccaggcgagtcggcaagcaaaggctacgaaaagaaaataccaagcgtccagtgaggctcccccagcgaaacggaggaacgaaacttcatttctcccagccaagaaaactagtgttaaagaaactcagaggacttttaaggggaacgcacaaaaaatgttttctccaaagaagcattcggttagcacaagtgatagaaaccaggaggagagacagtgcattaagacttcatcactgtttaaaaacaaccctgacattccagaactccacagacctgtggtaaagcaggtgcaagaaaaagtgtttacttcagctgcttttcatgagctgggcctccacccacatttaatttccacaataaatacggtcttaaaaatgtctagtatgaccagtgttcagaagcaaagtattcctgtgttgctggaaggcagagatgctctcgtgagatcccagacgggctcaggtaaaactcttgcctattgcatccctgtggtccagtcccttcaagcaatggagtcaaaaatacagcgcagtgatggcccctatgccctggtgctcgtgccaacgagagagctagctctacaaagctttgacactgtccagaaactgcttaagcctttcacctggattgtgcctggagtgttaatgggaggagagaagagaaaatcagaaaaggccagactccgcaaaggaataaatatccttatctcaactcctggacgcctggtggatcatataaaatccacaaagaacattcattttagtcggctgcggtggttggtgtttgatgaagcagacagaatcttggatttgggttttgaaaaggacatcacagtgatacttaatgctgtaaatgctgaatgccaaaaacgacagaatgtcttgctatcagcgacactcacagaaggtgtaacgcggctagctgatatcagtttgcatgatccagtcagtatttctgtcctggacaagagccatgaccagttgaacccaaaggacaaagcggtccaggaggtctgtcctccaccagctggcgacaagctggacagctttgcaataccagagagtctcaagcagcatgtgactgtggttcccagcaaactgaggcttgtctgcctagcggccttcatccttcagaaatgcaagtttgaggaagaccagaagatggttgtctttttctcaagttgcgagctggtggagttccactacagcctcttcctacagaccctgctgagcagctcaggggcgccggcatcagggcagttgccatctgcctccatgcgattaaaattcctacggctgcatggcggcatggagcaggaggaaagaacagcagtgtttcaggaattttcacattccagaagaggcgtccttctttgcacgtgaagaactcaccctaagccagaggaaaggaaccttgcttttaataccatcattatgttgacgagttgataagaagtaccaccgaatggccggaaaatggagtttctaagccacctgattttaaggctgacattaggttttctgttggtctccggtggctgtccttgattgtccctggatggagtgcagtcacctttttcccagaaaggaaagatacctgcagcccgccctgggcgccaactgtcccttggcatcctccttggctgtccggcgcgtgcatttctttttcagaagatgcacctaaatcacctgtgctgctttcctccaccttctccgtatttttttccgcttgaagcatactgttctgtctgtgcagttcttaatttcctctcctcctggggaatttccaccgtgccaggaggctaggagacaaaggagatacggctgtgaagagtcacaatgtcagttctgtgtcccaaataaatgtagactttcgtgctt

SEQ ID NO: 525 - DNA, 3066 bp, Homo sapiens
aaaaaggacagcgagcggggagccccgaggacccccttttccctgcccagggattgagctccagagcctgttagggagctacccagacaggctttagttcctaaagtgctgaggaaacgcacggggcggtaaaggggaggctcgtcggtgagatggcgccggatctcgcttctcagaggcattcagagagcttccccagcgtgaactctcggccgaatgtaattttgccaggccgcgagggacgcagagaggggctgccaccaggcgggggcacgcgcggtagtcttgtccctacccgcccggtgccgccgtccccggctcccctcgggacgagtccgtacagctggagccgttccggacccggaaggggcggtggcgcagggtcctcgcgcgtcccacgtggggtcccgggcccagcagtctgcgcaccgggctcgctgctgcaccacgcgtcacccacgcagaccatggcagccgccgacggttcgctcttcgacaaccccaggacgttctccagacgtcccccagcccaggcgagtcggcaagcaaaggctacgaaaagaaaataccaagcgtccagtgaggctcccccagcgaaacggaggaacgaaacttcatttctcccagccaagaaaactagtgttaaagaaactcagaggacttttaaggggaacgcacaaaaaatgttttctccaaagaagcattcggttagcacaagtgatagaaaccaggaggagagacagtgcattaagacttcatcactgtttaaaaacaaccctgacattccagaactccacagacctgtggtaaagcaggtgcaagaaaaagtgtttacttcagctgcttttcatgagctgggcctccacccacatttaatttccacaataaatacggtcttaaaaatgtctagtatgaccagtgttcagaagcaaagtattcctgtgttgctggaaggcagagatgctctcgtgagatcccagacgggctcaggtaaaactcttgcctattgcatccctgtggtccagtcccttcaagcaatggagtcaaaaatacagcgcagtgatggcccctatgccctggtgctcgtgccaacgagagagctagctctacaaagctttgacactgtccagaaactgcttaagcctttcacctggattgtgcctggagtgttaatgggaggagagaagagaaaatcagaaaaggccagactccgcaaaggaataaatatccttatctcaactcctggacgcctggtggatcatataaaatccacaaagaacattcattttagtcggctgcggtggttggtgtttgatgaagcagacagaatcttggatttgggttttgaaaaggacatcacagtgatacttaatgctgtaaatgctgaatgccaaaaacgacagaatgtcttgctatcagcgacactcacagaaggtgtaacgcggctagctgatatcagtttgcatgatccagtcagtatttctgtcctggacaagagccatgaccagttgaacccaaaggacaaagcggtccaggaggtctgtcctccaccagctggcgacaagctggacagctttgcaataccagagagtctcaagcagcatgtgactgtggttcccagcaaactgaggcttgtctgcctagcggccttcatccttcagaaatgcaagtttgaggaagaccagaagatggttgtctttttctcaagttgcgagctggtggagttccactacagcctcttcctacagaccctgctgagcagctcaggggcgccggcatcagggcagttgccatctgcctccatgcgattaaaattcctacggctgcatggcggcatggagcaggaggaaagaacagcagtgtttcaggaattttcacattccagaagaggcgtccttctttgcacggatgttgcagctcggggcttagatctccctcaagtcacgtggattgttcagaatacatccaccggattggaagaaccgcccggattggctgccatgggagcagcctgctcattttggctccttcggaggcagaatatgtcaactcgttggcttctcacaaaatcaactctgcagtccttcatccaagcctacgccacctaccccagggagctgaagcacatcttccacgtccgatccctccaccttgggcatgtggcgaagagcttcggactaagagatgcccccaggaatcttagtgccttgactagaaagaagaggaaagcacacgtgaaaaggcctgaccttcataagaagacccagagtaaacacagcctcgctgaaatcctacgttcggaatactcaagcggcatggaggccgacatcgccaaggtcaaaaagcaaaacgcacctggagagcctggtggccggcccctgcagcacagtctgcagccgacaccctgctttggccgtgggaaaacattaaaatggagaaaaacccaaaaaggtgtacagcgggacagcaagacttcccagaaagtttaaaatctctctgggtcttcgagtggaacctggaagccccgggtggcagtggattgatgtccagttcttgtcagaggaggcttgtgaaaaataactgcgcctttgcctgaataccacgtccccaagaatcagaggggccacagcccttctcctccatgggaggccctggagcctgatagaaatcagtggtgtggggcactgtagagactagccagctcccgacggaaggggtctgtgtcttgtattgatcccatcagtgcccggcactcccttcacccaggtgctgacgtgccggggttgagctggcaccccgggatgtgatgtaagaacgccctgcgcgtcagcctggaacgggcttgattgctgcccttaactgtgttctgaagtttcacagcttggcttcagcctatcagcgcatacattggcatgaattttgtgaattagggtgttaaaaactggaattgaatttgtacaaaaagagaatatatttatcactaattattttcttaatgtaggaatgtaccgttaaaaaggaccaaaagtttttggtctgggtcaaaaaatacgaatgtgttctcag

SEQ ID NO: 526 - DNA, 4635 bp, Homo sapiens
aaaaaggacagcgagcggggagccccgaggacccccttttccctgcccagggattgagctccagagcctgttagggagctacccagacaggctttagttcctaaagtgctgaggaaacgcacggggcggtaaaggggaggctcgtcggtgagatggcgccggatctcgcttctcagaggcattcagagagcttccccagcgtgaactctcggccgaatgtaattttgccaggccgcgagggacgcagagaggggctgccaccaggcgggggcacgcgcggtagtcttgtccctacccgcccggtgccgccgtccccggctcccctcgggacgagtccgtacagctggagccgttccggacccggaaggggcggtggcgcagggtcctcgcgcgtcccacgtggggtcccgggcccagcagtctgcgcaccgggctcgctgctgcaccacgcgtcacccacgcagaccatggcagccgccgacggttcgctcttcgacaaccccaggacgttctccagacgtcccccagcccaggcgagtcggcaagcaaaggctacgaaaagaaaataccaagcgtccagtgaggctcccccagcgaaacggaggaacgaaacttcatttctcccagccaagaaaactagtgttaaagaaactcagaggacttttaaggggaacgcacaaaaaatgttttctccaaagaagcattcggttagcacaagtgatagaaaccaggaggagagacagtgcattaagacttcatcactgtttaaaaacaaccctgacattccagaactccacagacctgtggtaaagcaggtgcaagaaaaagtgtttacttcagctgcttttcatgagctgggcctccacccacatttaatttccacaataaatacggtcttaaaaatgtctagtatgaccagtgttcagaagcaaagtattcctgtgttgctggaaggcagagatgctctcgtgagatcccagacgggctcaggtaaaactcttgcctattgcatccctgtggtccagtcccttcaagcaatggagtcaaaaatacagcgcagtgatggcccctatgccctggtgctcgtgccaacgagagagctagctctacaaagctttgacactgtccagaaactgcttaagcctttcacctggattgtgcctggagtgttaatgggaggagagaagagaaaatcagaaaaggccagactccgcaaaggaataaatatccttatctcaactcctggacgcctggtggatcatataaaatccacaaagaacattcattttagtcggctgcggtggttggtgtttgatgaagcagacagaatcttggatttgggttttgaaaaggacatcacagtgatacttaatgctgtaaatgctgaatgccaaaaacgacagaatgtcttgctatcagcgacactcacagaaggtgtaacgcggctagctgatatcagtttgcatgatccagtcagtatttctgtcctggacaagagccatgaccagttgaacccaaaggacaaagcggtccaggaggtctgtcctccaccagctggcgacaagctggacagctttgcaataccagagagtctcaagcagcatgtgactgtggttcccagcaaactgaggcttgtctgcctagcggccttcatccttcagaaatgcaagtttgaggaagaccagaagatggttgtctttttctcaagttgcgagctggtggagttccactacagcctcttcctacagaccctgctgagcagctcaggggcgccggcatcagggcagttgccatctgcctccatgcgattaaaattcctacggctgcatggcggcatggagcaggaggaaagaacagcagtgtttcaggaattttcacattccagaagaggcgtccttctttgcacggatgttgcagctcggggcttagatctccctcaagtcacgtggattgttcagtacaacgctccatcttcacctgcagaatacatccaccggattggaagaaccgcccggattggctgccatgggagcagcctgctcattttggctccttcggaggcagaatatgtcaactcgttggcttctcacaaaatcaacgtttctgagattaagatggaagatattttgtgtgttctgacaagagatgattgttttaaagggaaacgatggggagcccagaaatcccatgctgttggcccccaggaaatccgagagcgagccacagtcttgcagacggtatttgaagattacgtgcactccagtgagaggagggtctcctgggcaaagaaagtttggagcttggagaccccggtcctgacagcttccctccccgctctcttttctttcagctctgcagtccttcatccaagcctacgccacctaccccagggagctgaagcacatcttccacgtccgatccctccaccttgggcatgtggcgaagagcttcggactaagagatgcccccaggaatcttagtgccttgactagaaagaagaggaaagcacacgtgaaaaggcctgaccttcataagaagacccagagtaaacacagcctcgctgaaatcctacgttcggaatactcaagcggcatggaggccgacatcgccaaggtcaaaaagcaaaacgcacctggagagcctggtggccggcccctgcagcacagtctgcagccgacaccctgctttggccgtgggaaaacattaaaatggagaaaaacccaaaaaggtgtacagcgggacagcaagacttcccagaaagtttaaaatctctctgggtcttcgagtggaacctggaagccccgggtggcagtggattgatgtccagttcttgtcagaggaggcttgtgaaaaataactgcgcctttgcctgaataccacgtccccaagaatcagaggggccacagcccttctcctccatgggaggccctggagcctgatagaaatcagtggtgtggggcactgtagagactagccagctcccgacggaaggggtctgtgtcttgtattgatcccatcagtgcccggcactcccttcacccaggtgctgacgtgccggggttgagctggcaccccgggatgtgatgtaagaacgccctgcgcgtcagcctggaacgggcttgattgctgcccttaactgtgttctgaagtttcacagcttggcttcagcctatcagcgcatacattggcatgaattttgtgaattagggtgttaaaaactggaattgaatttgtacaaaaagagaatatatttatcactaattattttcttaatgtaggaatgtaccgttaaaaaggaccaaaagtttttggtctgggtcaaaaaatacgaatgtgttctcaggctcgtggtccctcttattttcttctggaaacacgaggttgcatttacatgcattgctccctctttcatgtccactgaaaactcactctctcagggctaattgatttactgttggctttttattatttgcctttgaagtcaaaaggcaccagtatcccaagctttttttccctatcgaatcctgtcttgtcttcaagaaaggtctgggggtctttgtattgtgacccaggccacagctgcccgccccccgcccccgacccaccccgccctgcccctgcattgtgttttctgggaggtttgaaagaggccccctggagcatattgatttcccaataaatgtaagatttgggcacttgcagaggggtccagaagagaaagggttggaggcctccacacctgtgggcaccgctcctgtcctctccactgtgtcttgccttctcagtttccttctcctctgcagtgactgtgccgccctctgtggtctccccaggaccagtgttgaggcaccacttcagtagatccccccagatccttggaaggtctgagtggccacgagagggtggtgagagttggcaaggtgggccttcctgcagggaccacggggggtcagcatccttgcctccgttctagacacaggtgaatgtcagtgggcacccacactggcggagactccagtgtgagggcaaggaggagcctagtgagactggatcctctgcaggtggaaaaataggaccttctcagagttggctgtcacatacaaattaacagggactgtgggtgacgtttctaacaataataattaaaaaacaacaaccctgcagcacatgtcagcctggcgttgggcaagtctgccacctttcttttatttcgatgtgtaatggttcacatgatttggatgagaaaaggagggatcaaactttatagacaaaacccagctgtgtgaaaaacaggattaatgccagtgattggggatgatcaaagagaaaccttactttttctcccccagtactcattccactaaagggcgaattggcagagttcggcatccctggggggaaagagaagtgctagaatcatgcaacgtgtgagtgacgataattccaagatcaaaacttacacacttaatctgctaactcttatggtgagggtttcttgccatagatgctatgtgggtctgtttctaagtagaatcactatattaccccagttaataaagaaacatggatttagcagatttaaggttaatattgtttaaatttaaataaccttaaaataaatctctttctcttcta

SEQ ID NO: 527 - DNA, 4577 bp, Homo sapiens
aaaaaggacagcgagcggggagccccgaggacccccttttccctgcccagggattgagctccagagcctgttagggagctacccagacaggctttagttcctaaagtgctgaggaaacgcacggggcggtaaaggggaggctcgtcggtgagatggcgccggatctcgcttctcagaggcattcagagagcttccccagcgtgaactctcggccgaatgtaattttgccaggccgcgagggacgcagagaggggctgccaccaggcgggggcacgcgcggtagtcttgtccctacccgcccggtgccgccgtccccggctcccctcgggacgagtccgtacagctggagccgttccggacccggaaggggcggtggcgcagggtcctcgcgcgtcccacgtggggtcccgggcccagcagtctgcgcaccgggctcgctgctgcaccacgcgtcacccacgcagaccatggcagccgccgacggttcgctcttcgacaaccccaggacgttctccagacgtcccccagcccaggcgagtcggcaagcaaaggctacgaaaagaaaataccaagcgtccagtgaggctcccccagcgaaacggaggaacgaaacttcatttctcccagccaagaaaactagtgttaaagaaactcagaggacttttaaggggaacgcacaaaaaatgttttctccaaagaagcattcggttagcacaagtgatagaaaccaggaggagagacagtgcattaagacttcatcactgtttaaaaacaaccctgacattccagaactccacagacctgtggtaaagcaggtgcaagaaaaagtgtttacttcagctgcttttcatgagctgggcctccacccacatttaatttccacaataaatacggtcttaaaaatgtctagtatgaccagtgttcagaagcaaagtattcctgtgttgctggaaggcagagatgctctcgtgagatcccagacgggctcaggtaaaactcttgcctattgcatccctgtggtccagtcccttcaagcaatggagtcaaaaatacagcgcagtgatggcccctatgccctggtgctcgtgccaacgagagagctagctctacaaagctttgacactgtccagaaactgcttaagcctttcacctggattgtgcctggagtgttaatgggaggagagaagagaaaatcagaaaaggccagactccgcaaaggaataaatatccttatctcaactcctggacgcctggtggatcatataaaatccacaaagaacattcattttagtcggctgcggtggttggtgtttgatgaagcagacagaatcttggatttgggttttgaaaaggacatcacagtgatacttaatgctgtaaatgctgaatgccaaaaacgacagaatgtcttgctatcagcgacactcacagaaggtgtaacgcggctagctgatatcagtttgcatgatccagtcagtatttctgtcctggacaagagccatgaccagttgaacccaaaggacaaagcggtccaggaggtctgtcctccaccagctggcgacaagctggacagctttgcaataccagagagtctcaagcagcatgtgactgtggttcccagcaaactgaggcttgtctgcctagcggccttcatccttcagaaatgcaagtttgaggaagaccagaagatggttgtctttttctcaagttgcgagctggtggagttccactacagcctcttcctacagaccctgctgagcagctcaggggcgccggcatcagggcagttgccatctgcctccatgcgattaaaattcctacggctgcatggcggcatggagcaggaggaaagaacagcagtgtttcaggaattttcacattccagaagaggcgtccttctttgcacggatgttgcagctcggggcttagatctccctcaagtcacgtggattgttcagtacaacgctccatcttcacctgcagaatacatccaccggattggaagaaccgcccggattggctgccatgggagcagcctgctcattttggctccttcggaggcagaatatgtcaactcgttggcttctcacaaaatcaacgtttctgagattaagatggaagatattttgtgtgttctgacaagagatgattgttttaaagggaaacgatggggagcccagaaatcccatgctgttggcccccaggaaatccgagagcgagccacagtcttgcagacggtatttgaagattacgtgcactccagtgagaggagggtctcctgggcaaagaaagctctgcagtccttcatccaagcctacgccacctaccccagggagctgaagcacatcttccacgtccgatccctccaccttgggcatgtggcgaagagcttcggactaagagatgcccccaggaatcttagtgccttgactagaaagaagaggaaagcacacgtgaaaaggcctgaccttcataagaagacccagagtaaacacagcctcgctgaaatcctacgttcggaatactcaagcggcatggaggccgacatcgccaaggtcaaaaagcaaaacgcacctggagagcctggtggccggcccctgcagcacagtctgcagccgacaccctgctttggccgtgggaaaacattaaaatggagaaaaacccaaaaaggtgtacagcgggacagcaagacttcccagaaagtttaaaatctctctgggtcttcgagtggaacctggaagccccgggtggcagtggattgatgtccagttcttgtcagaggaggcttgtgaaaaataactgcgcctttgcctgaataccacgtccccaagaatcagaggggccacagcccttctcctccatgggaggccctggagcctgatagaaatcagtggtgtggggcactgtagagactagccagctcccgacggaaggggtctgtgtcttgtattgatcccatcagtgcccggcactcccttcacccaggtgctgacgtgccggggttgagctggcaccccgggatgtgatgtaagaacgccctgcgcgtcagcctggaacgggcttgattgctgcccttaactgtgttctgaagtttcacagcttggcttcagcctatcagcgcatacattggcatgaattttgtgaattagggtgttaaaaactggaattgaatttgtacaaaaagagaatatatttatcactaattattttcttaatgtaggaatgtaccgttaaaaaggaccaaaagtttttggtctgggtcaaaaaatacgaatgtgttctcaggctcgtggtccctcttattttcttctggaaacacgaggttgcatttacatgcattgctccctctttcatgtccactgaaaactcactctctcagggctaattgatttactgttggctttttattatttgcctttgaagtcaaaaggcaccagtatcccaagctttttttccctatcgaatcctgtcttgtcttcaagaaaggtctgggggtctttgtattgtgacccaggccacagctgcccgccccccgcccccgacccaccccgccctgcccctgcattgtgttttctgggaggtttgaaagaggccccctggagcatattgatttcccaataaatgtaagatttgggcacttgcagaggggtccagaagagaaagggttggaggcctccacacctgtgggcaccgctcctgtcctctccactgtgtcttgccttctcagtttccttctcctctgcagtgactgtgccgccctctgtggtctccccaggaccagtgttgaggcaccacttcagtagatccccccagatccttggaaggtctgagtggccacgagagggtggtgagagttggcaaggtgggccttcctgcagggaccacggggggtcagcatccttgcctccgttctagacacaggtgaatgtcagtgggcacccacactggcggagactccagtgtgagggcaaggaggagcctagtgagactggatcctctgcaggtggaaaaataggaccttctcagagttggctgtcacatacaaattaacagggactgtgggtgacgtttctaacaataataattaaaaaacaacaaccctgcagcacatgtcagcctggcgttgggcaagtctgccacctttcttttatttcgatgtgtaatggttcacatgatttggatgagaaaaggagggatcaaactttatagacaaaacccagctgtgtgaaaaacaggattaatgccagtgattggggatgatcaaagagaaaccttactttttctcccccagtactcattccactaaagggcgaattggcagagttcggcatccctggggggaaagagaagtgctagaatcatgcaacgtgtgagtgacgataattccaagatcaaaacttacacacttaatctgctaactcttatggtgagggtttcttgccatagatgctatgtgggtctgtttctaagtagaatcactatattaccccagttaataaagaaacatggatttagcagatttaaggttaatattgtttaaatttaaataaccttaaaataaatctctttctcttcta

SEQ ID NO: 528 - DNA, 2551 bp, Homo sapiens
atcatgcatttaagcacattcctgtaatggaaataagaagcaacaggcaagagatccctagtgctgtgtagcctgtaatccgcaatcaggcagagactcggggactcagagactcgaaaggcaagggaggtaggaagtaattgtggtagaggtgatggatggagcagcattctcatttggaatgggaacagggcgtaggaattttctccaggccgtctgaatctggaggagcagcttgagaggagagaatgagagagatccaggcgctagggtagaatgcaagcaaaggctacgaaaagaaaataccaagcgtccagtgaggctcccccagcgaaacggaggaacgaaacttcatttctcccagccaagaaaactagtgttaaagaaactcagaggacttttaaggggaacgcacaaaaaatgttttctccaaagaagcattcggttagcacaagtgatagaaaccaggaggagagacagtgcattaagacttcatcactgtttaaaaacaaccctgacattccagaactccacagacctgtggtaaagcaggtgcaagaaaaagtgtttacttcagctgcttttcatgagctgggcctccacccacatttaatttccacaataaatacggtcttaaaaatgtctagtatgaccagtgttcagaagcaaagtattcctgtgttgctggaaggcagagatgctctcgtgagatcccagacgggctcaggtaaaactcttgcctattgcatccctgtggtccagtcccttcaagcaatggagtcaaaaatacagcgcagtgatggcccctatgccctggtgctcgtgccaacgagagagctagctctacaaagctttgacactgtccagaaactgcttaagcctttcacctggattgtgcctggagtgttaatgggaggagagaagagaaaatcagaaaaggccagactccgcaaaggaataaatatccttatctcaactcctggacgcctggtggatcatataaaatccacaaagaacattcattttagtcggctgcggtggttggtgtttgatgaagcagacagaatcttggatttgggttttgaaaaggacatcacagtgatacttaatgctgtaaatgctgaatgccaaaaacgacagaatgtcttgctatcagcgacactcacagaaggtgtaacgcggctagctgatatcagtttgcatgatccagtcagtatttctgtcctggacaagagccatgaccagttgaacccaaaggacaaagcggtccaggaggtctgtcctccaccagctggcgacaagctggacagctttgcaataccagagagtctcaagcagcatgtgactgtggttcccagcaaactgaggcttgtctgcctagcggccttcatccttcagaaatgcaagtttgaggaagaccagaagatggttgtctttttctcaagttgcgagctggtggagttccactacagcctcttcctacagaccctgctgagcagctcaggggcgccggcatcagggcagttgccatctgcctccatgcgattaaaattcctacggctgcatggcggcatggagcaggaggaaagaacagcagtgtttcaggaattttcacattccagaagaggcgtccttctttgcacggatgttgcagctcggggcttagatctccctcaagtcacgtggattgttcagtacaacgctccatcttcacctgcagaatacatccaccggattggaagaaccgcccggattggctgccatgggagcagcctgctcattttggctccttcggaggcagaatatgtcaactcgttggcttctcacaaaatcaacgtttctgagattaagatggaagatattttgtgtgttctgacaagagatgattgttttaaagggaaacgatggggagcccagaaatcccatgctgttggcccccaggaaatccgagagcgagccacagtcttgcagacggtatttgaagattacgtgcactccagtgagaggagggtctcctgggcaaagaaagctctgcagtccttcatccaagcctacgccacctaccccagggagctgaagcacatcttccacgtccgatccctccaccttgggcatgtggcgaagagcttcggactaagagatgcccccaggaatcttagtgccttgactagaaagaagaggaaagcacacgtgaaaaggcctgaccttcataagaagacccagagtaaacacagcctcgctgaaatcctacgttcggaatactcaagcggcatggaggccgacatcgccaaggtcaaaaagcaaaacgcacctggagagcctggtggccggcccctgcagcacagtctgcagccgacaccctgctttggccgtgggaaaacattaaaatggagaaaaacccaaaaaggtgtacagcgggacagcaagacttcccagaaagtttaaaatctctctgggtcttcgagtggaacctggaagccccgggtggcagtggattgatgtccagttcttgtcagaggaggcttgtgaaaaataactgcgcctttgcctg

SEQ ID NO: 529 - DNA, 1510 bp, Homo sapiens
ctcgcgcgtcccacgtggggtcccgggcccagcagtctgcgcaccgggctcgctgctgcaccacgcgtcacccacgcagaccatggcagccgccgacggttcgctcttcgacaaccccaggacgttctccagacgtcccccagcccaggcgagtcggggatgcgcctggaagcggggagtggagcggtgtggaggggcggggagctggctcctgcgcctagaaaagtaaaggaaggaattagaggctgtttcccgtggaagcaagcaaaggctacgaaaagaaaataccaagcgtccagtgaggctcccccagcgaaacggaggaacgaaacttcatttctcccagccaagaaaactagtgttaaagaaactcagaggacttttaaggggaacgcacaaaaaatgttttctccaaagaagcattcggttagcacaagtgatagaaaccaggaggagagacagtgcattaagacttcatcactgtttaaaaacaaccctgacattccagaactccacagacctgtggtaaagcaggtgcaagaaaaagtgtttacttcagctgcttttcatgagctgggcctccacccacatttaatttccacaataaatacggtcttaaaaatgtctagtatgaccaggtaagaacttcaggctcctcttgatttcttaggcattacgtgggtataaccggacgaaacctgtgtgtgcaaggcagagcaaatttgtgtcttggcgttggaacacagtgccaggttatcgaccataaagggttgtcgtctcacttagctactcattctctccacctgttaaatggaaagactggctttccatccagttctgcccttggctctgaaccgcaagagacgtctcatccagaaggtgggctgcatgagcgccgctgttttctgtgcttccctgaaaagaatttggccaaaatatagcatgtgaccatgtcgtttcttagtagtaagaattagggtcaaccaaaaagacaagagtaaatgttcagttggatagagtgggatactgaaaaaatgttttcaatgtttgttacagggaatgactcctggaaaataaagaagtaaaataggtgcgaggagatgagcttccttgttttgagtatttgtgcttctgtgcattttcataatgattttttacttttactagtaaaaattaataggaatattaaagtccaaattaagggacctccccacaagttttttatcaaccaaatttaagtgatttttgtgtctcttttgtttcttgttttaaaatacatgtgtagacacacatttcagcatgtccataaccttttcctggagaatggacagctgctgctggctctctgaatagttggcgagcttcctcctgctatcctgcatggaaacctttccattatgtttcgttgtgtttcatattcctgttagtgagggcaagagtgtgtgatacacttggtggtaactctgatttgttgtcatgcctgtttctttttcttttttttttttttttt

SEQ ID NO: 530 - DNA, 1493 bp, Homo sapiens
ggaagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccggcctgtgtgcaggaagttcatgcaggatcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatgg

SEQ ID NO: 531 - DNA, 1353 bp, Homo sapiens
ggcggaaaaccgaagttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccggcctgtgtgcaggaagttcatgcaggatcccatggaggtgtttgtggacgacgagaccaagctcacgctgcacggcctgcagcagtactacgtcaaactcaaagacagtgagaagaaccgcaagctctttgatctcttggatgtgctggagtttaaccagcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatgg

SEQ ID NO: 532 - DNA, 1600 bp, Homo sapiens
atgcgctaggggtgggccagccgttggcgcgcggtgctcggggctcggggcccgcttctcggaggggctgtcatggcctacggcgctccgagccccacttggagtctgtcagttcgtccgaatagaccccgcggcggcctggggccatttggagaggttcaagtgattctcctgcctccaagtagctgggattacagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccggcctgtgtgcaggaagttcatgcaggatcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatgg

SEQ ID NO: 533 - DNA, 804 bp, Homo sapiens
atggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccggcctgtgtgcaggaagttcatgcaggatgtcctctgggaagtgtcgcacaaaggagtcgcccactggaaggttctgggcaggcgagatgcccagaggtga

SEQ ID NO: 534 - DNA, 3821 bp, Homo sapiens
ggccgccacagctgtaggtgctgctagtgtttagcgctggtctttgccgggcgttgagggcagctcagcctccttgtttgtccggttcgcctgtgcgtggtactcaagggcaccagtattcccgcggtcggcagcatgggtcgggagtcacgccactatcgaaaacgatcggcatcccggggtcgctctggaagtcggtctagaagtcgctcaccctcagacaaaagaagtaaacgtggagatgacagacggtctagaagtagagatagagataggaggagagagaggtctcgtagcagggataaaagaagatctcggtcaagggacaggaagcgtctgagacgttccagaagtagagagagagacagaagccgagagcgaagaagatctcgaagtagagacaggagacgctcaaggagtagaagccggggccggcgatcccgatcctccagtcctggaaataaaagcaagaaaactgagaatagatctaggtccaaagagaaaactgatggtggggaaagttctaaagagaagaaaaaagacaaagatgacaaggaggatgaaaaagaaaaagatgctggcaactttgaccagaataagctggaagaagaaatgagaaagcgaaaagaaagagtagaaaaatggcgagaagagcaacgtaaaaaggctatggaaaacataggagaactgaaaaaggaaatcgaagagatgaaacaagggaaaaagtggagtttagaggacgatgatgatgacgaagatgatcctgcagaagctgaaaaggagggaaatgaaatggagggtgaggagttagatccattagatgcttacatggaagaagtgaaagaggaagtaaaaaaatttaacatgagaagtgtaaaaggtggtgggggaaatgaaaagaagtctgggccaacggtcacaaaagttgtcactgttgtgacaaccaaaaaagcagttgtggattctgataagaagaaaggtgagctgatggagaatgaccaggatgccatggagtattcttcagaggaggaagaagttgatcttcagacagcccttacagggtatcaaacaaaacagcgaaagcttctagaaccagttgatcatggaaaaattgagtatgagccatttaggaaaaacttctatgttgaagttccagaactagcaaaaatgtctcaagaagaggtaaatgtgtttcgattggaaatggagggcattacagttaaaggaaaaggttgccccaaaccaattaaatcctgggtccagtgtggaatttccatgaagatcttaaattccctcaagaagcatggctatgaaaagcccacgcccatccaaacccaagctattcctgctataatgtctggacgagatttgattggcattgccaaaacaggaagtggaaagaccattgcttttctgttgcccatgtttagacacatcatggatcagaggtcattagaggaaggagaggggccaatagctgtcatcatgactccaactcgagaactggctttacagattactaaagagtgtaagaagttttccaagactttgggacttagagtggtctgtgtttacggaggaacaggaatcagtgagcagattgctgagctgaaaagaggtgctgaaattattgtttgcacacctggtcgaatgattgacatgttagccgctaacagtggtcgggtcacaaatcttcgaagagtgacatatgttgttttagatgaagcagacagaatgtttgacatgggttttgaaccccaggtcatgcgcatcgtggataatgttcgtcctgatcgacagacggttatgttttcagctactttccccagagctatggaggctttggctcgcaggatcctcagtaaacctattgaagtacaagttggaggcaggagtgtggtttgctcagatgtggagcaacaagtgattgtgattgaagaagaaaagaaattcttgaagttacttgagcttctaggccattatcaagagtcaggatctgtcattatatttgtggataagcaggaacatgctgatggtcttcttaaggatttaatgagagcatcttatccttgcatgtctcttcatggaggcattgatcaatatgacagagatagcatcataaatgactttaagaatgggacctgcaaacttcttgtggctacctctgttgctgcccgaggtctagatgtgaaacatctgattcttgtagtaaattatagctgccccaaccattatgaggattatgtacacagagcagggcggactggaagagcaggaaacaagggttatgcttatacttttatcacagaggatcaagctcgctatgctggtgacataattaaagctcttgaattgtcagggactgcagtacctcctgatttagagaaactgtggagtgatttcaaagatcagcagaaagctgaggggaaaataattaaaaagagtagtgggttctctggtaagggattcaagtttgatgaaacagaacaagctttggctaatgagaggaagaagttacaaaaagcagctcttggtctacaagattcagatgatgaggatgctgcagttgatattgatgagcaaattgaaagcatgtttaattcaaagaagagagtaaaggatatggctgctcctggaacatcaagtgttcctgctccaactgcaggaaatgctgagaaattagaaattgctaagagattggctcttagaatcaatgcccagaagaatttgggcatcgagtctcaggatgtgatgcagcaggccaccaatgcaattcttaggggtggcaccattctggctcccactgtttctgcaaaaaccattgcagaacaacttgctgaaaagatcaatgccaagctcaattatgtgccgttagagaaacaagaagaagagagacaggatggtggacagaatgaatcttttaagagatatgaagaagaattagagatcaatgacttcccacagactgctaggtggaaagttacctctaaggaagctctgcagagaatcagtgaatactctgaagccgcaattacaatcagaggaacctacttccctcctggcaaagaacccaaggaaggcgagcggaagatttacttggcaattgaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatgggttgagagtttttgtttcaatttttatcatcataaatgggcaaaaagtagttggactaatttcggtttttatacaagtaaagatttaatagta

SEQ ID NO: 535 - DNA, 5689 bp, Homo sapiens
gttttcgttggccgcgctgggatggccgccacagctgtaggtgctgctagtgtttagcgctggtctttgccgggcgttgagggcagctcagcctccttgtttgtccggttcgcctgtgcgtggtactcaagggcaccagtattcccgcggtcggcagcatgggtcgggagtcacgccactatcgaaaacgatcggcatcccggggtcgctctggaagtcggtctagaagtcgctcaccctcagacaaaagaagtaaacgtggagatgacagacggtctagaagtagagatagagataggaggagagagaggtctcgtagcagggataaaagaagatctcggtcaagggacaggaagcgtctgagacgttccagaagtagagagagagacagaagccgagagcgaagaagatctcgaagtagagacaggagacgctcaaggagtagaagccggggccggcgatcccgatcctccagtcctggaaataaaagcaagaaaactgagaatagatctaggtccaaagagaaaactgatggtggggaaagttctaaagagaagaaaaaagacaaagatgacaaggaggatgaaaaagaaaaagatgctggcaactttgaccagaataagctggaagaagaaatgagaaagcgaaaagaaagagtagaaaaatggcgagaagagcaacgtaaaaaggctatggaaaacataggagaactgaaaaaggaaatcgaagagatgaaacaagggaaaaagtggagtttagaggacgatgatgatgacgaagatgatcctgcagaagctgaaaaggagggaaatgaaatggagggtgaggagttagatccattagatgcttacatggaagaagtgaaagaggaagtaaaaaaatttaacatgagaagtgtaaaaggtggtgggggaaatgaaaagaagtctgggccaacggtcacaaaagttgtcactgttgtgacaaccaaaaaagcagttgtggattctgataagaagaaaggtgagctgatggagaatgaccaggatgccatggagtattcttcagaggaggaagaagttgatcttcagacagcccttacagggtatcaaacaaaacagcgaaagcttctagaaccagttgatcatggaaaaattgagtatgagccatttaggaaaaacttctatgttgaagttccagaactagcaaaaatgtctcaagaagaggtaaatgtgtttcgattggaaatggagggcattacagttaaaggaaaaggttgccccaaaccaattaaatcctgggtccagtgtggaatttccatgaagatcttaaattccctcaagaagcatggctatgaaaagcccacgcccatccaaacccaagctattcctgctataatgtctggacgagatttgattggcattgccaaaacaggaagtggaaagaccattgcttttctgttgcccatgtttagacacatcatggatcagaggtcattagaggaaggagaggggccaatagctgtcatcatgactccaactcgagaactggctttacagattactaaagagtgtaagaagttttccaagactttgggacttagagtggtctgtgtttacggaggaacaggaatcagtgagcagattgctgagctgaaaagaggtgctgaaattattgtttgcacacctggtcgaatgattgacatgttagccgctaacagtggtcgggtcacaaatcttcgaagagtgacatatgttgttttagatgaagcagacagaatgtttgacatgggttttgaaccccaggtcatgcgcatcgtggataatgttcgtcctgatcgacagacggttatgttttcagctactttccccagagctatggaggctttggctcgcaggatcctcagtaaacctattgaagtacaagttggaggcaggagtgtggtttgctcagatgtggagcaacaagtgattgtgattgaagaagaaaagaaattcttgaagttacttgagcttctaggccattatcaagagtcaggatctgtcattatatttgtggataagcaggaacatgctgatggtcttcttaaggatttaatgagagcatcttatccttgcatgtctcttcatggaggcattgatcaatatgacagagatagcatcataaatgactttaagaatgggacctgcaaacttcttgtggctacctctgttgctgcccgaggtctagatgtgaaacatctgattcttgtagtaaattatagctgccccaaccattatgaggattatgtacacagagcagggcggactggaagagcaggaaacaagggttatgcttatacttttatcacagaggatcaagctcgctatgctggtgacataattaaagctcttgaattgtcagggactgcagtacctcctgatttagagaaactgtggagtgatttcaaagatcagcagaaagctgaggggaaaataattaaaaagagtagtgggttctctggtaagggattcaagtttgatgaaacagaacaagctttggctaatgagaggaagaagttacaaaaagcagctcttggtctacaagattcagatgatgaggatgctgcagttgatattgatgagcaaattgaaagcatgtttaattcaaagaagagagtaaaggatatggctgctcctggaacatcaagtgttcctgctccaactgcaggaaatgctgagaaattagaaattgctaagagattggctcttagaatcaatgcccagaagaatttgggcatcgagtctcaggtagatgtgatgcagcaggccaccaatgcaattcttaggggtggcaccattctggctcccactgtttctgcaaaaaccattgcagaacaacttgctgaaaagatcaatgccaagctcaattatgtgccgttagagaaacaagaagaagagagacaggatggtggacagaatgaatcttttaagagatatgaagaagaattagagatcaatgacttcccacagactgctaggtggaaagttacctctaaggaagctctgcagagaatcagtgaatactctgaagccgcaattacaatcagaggaacctacttccctcctggcaaagaacccaaggaaggcgagcggaagatttacttggcaattgaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatgggttgagagtttttgtttcaatttttatcatcataaatgggcaaaaagtagttggactaatttcggtttttatacaagtaaagatttaatagtataaggatttttttgcatttctttacactgagtgtaaaactctacaaagagttatagtatttactactttgaggtttccctcacaacttctggctccatacctagcccctcttttataatcttccttaaaagaaagagtgtagcctataaatactaaatatgataccttttccttctagaaagtgtttatttatatatctatacatgttgtatgtacaaatatcctactacttttaatctgatttttcttcaggattattgagtaggttgtgaattttctttcttaaaaattgtaaaacataatggtacccaagttttaaacttagatgtgcttcatcttagtgaaatttaattcacaaggaatcataaattgtgtttttgaggctgggcgcagtgactcacacctgtatcccagcaatttgggaggccgaggtgggcagatcacttgaggtcaggagttcaagactagcctggtcaacatggtgaaaccctgtctctactaaaaatacaaaaattagtcggcatggtggtgggtggctgtaatcccagctactcaggaggctgaggcagaagaatctgagccaagataacaccattgcactccagcctgggcgacagagtgagactatctcaaaaataaataaataaataaataaatagtatttttgagccttcaagatacagttcctgaatattctaatttaaattgttataattggattacctaatattcttttcaagactcctgatgtattaacttcatgttattgtcacttttcaaaaaaggaatttttttcaggagttaaataaagtcagtcttttatatccaagggtttcaaacccacagattaaaccaaccacagatcaaaaatagaaaaaaaaaaaaaaagaaaaaaagaatgtaaaattttaaaaatacagtttaacagctgtaaaagttttactataacatttacattgtgttaggtattttaagtaatttaaaggttacagtatacaggcggttaaagtatacaggaggatgtgcatcggttatatgcatatagcaagccatttcatataagaggcttgaacatccatggattttggtatagaggaggggtttaaggggtgtcctgcaatcagtccccctctcataccaaaggatgactgtatatttcttaaatgaagagactttcattctttaaatattattgacttacagtttaaaaataaataaataaaagcatactatagttgtaaaaacaaataattttaatagtatattcagtggctgaagtgatagggagtattaatcattatttcttcagtataaagttattcttcctgaaaaagtaagatatacctgggaaatattcttggatccttcacacatccacttaatttcttgaaggaagaaaacagacaaaagacatgtaacaacagaaacaaataaaccacttactgtaaaatttcagaaattgtgggctcattccctccctctagtttatttatttgctcatctttatcacctaatggtagtttgttttctttggtagagtatatggcagtcccacatcgatgataattggtgctcccttcatccaactggatcactttgagattcagttttacatcattttagcattttgtttgtatatcagttgtgatgagccactgataaaattttgttctaaaatgaaacatattactttgttagtacattttttagtgtcacactgacttttaaaatttgaatgatatatagactttgtttttttaatgcaatatgaatatttgctcatgttttctaaattccttataaaataaaattaattcgaattcaatctgcactttcttaaaa

SEQ ID NO: 536 - DNA, 921 bp, Homo sapiens
cgctgggatggccgccacagctgtaggtgctgctagtgtttagcgctggtctttgccgggcgttgagggcagctcagcctccttgtttgtccggttcgcctgtgcgtggtactcaagggcaccagtattcccgcggtcggcagcatgggtcgggagtcacgccactatcgaaaacgatcggcatcccggggtcgctctggaagtcggtctagaagtcgctcaccctcagacaaaagaagtaaacgtggagatgacagacggtctagaagtagagatagagataggaggagagagaggtctcgtagcagggataaaagaagatctcggtcaagggacaggaagcgtctgagacgttccagaagtagagagagagacagaagccgagagcgaagaagatctcgaagtagagacaggagacgctcaaggagtagaagccggggccggcgatcccgatcctccagtcctggaaataaaagcaagaaaactgagaatagatctaggtccaaagagaaaactgatggtggggaaagttctaaagagaagaaaaaagacaaagatgacaaggaggatgaaaaagaaaaagatgctggcaactttgaccagaataagctggaagaagaaatgagaaagcgaaaagaaagagtagaaaaatggcgagaagagcaacgtaaaaaggctatggaaaacataggagaactgaaaaaggaaatcgaagagatgaaacaagggaaaaagtggagtttagaggacgatgatgatgacgaagatgatcctgcagaagctgaaaaggagggaaatgaaatggagggtgaggagttagatccattagatgcttacatggaagaagtgaaagaggaagtaaaaaaatttaacatgagaagtgtaaaagccgtctcaaaaaaaaaaaaaaaaaaaaaaaaa

SEQ ID NO: 537 - DNA, 1698 bp, Homo sapiens
atttcccagcatcccgcgcgccgcagacccacttccggagacctcacacaagatggcggcacccgaggaacacgattctccgaccgaagcgtcccagccgattgtggaagaggaggaaactaaaacatttaaagacctgggtgtgacagatgtgttgtgtgaagcttgtgaccagttgggatggacaaaacccaccaagatccagattgaagctattcctttggccttacaaggtcgtgatatcattgggcttgcagaaactggctctggaaagacaggcgcctttgctttgcccattctaaacgcactgctggagaccccgcagcgtttgtttgccctagttcttaccccgactcgggagctggcctttcagatctcagagcagtttgaagccctggggtcctctattggagtgcagagtgctgtgattgtaggtggaattgattcaatgtctcaatctttggcccttgcaaaaaaaccacatataataatagcaactcctggtcgactgattgaccacttggaaaatacgaaaggtttcaacttgagagctctcaaatacttggtcatggatgaagccgaccgaatactgaatatggattttgagacagaggttgacaagatcctcaaagtgattcctcgagatcggaaaacattcctcttctctgccaccatgaccaagaaggttcaaaaacttcagcgagcagctctgaagaatcctgtgaaatgtgccgtttcctctaaataccagacagttgaaaaattacagcaatattatatttttattccctctaaattcaagagtaagcgcctaggatcccttaataagtttaaggccaaggcccgttccattcttctagcaactgacgttgccagccgaggtttggacatacctcatgtagatgtggttgtcaactttgacattcctacccattccaaggattacatccatcgagtaggtcgaacagctagagctgggcgctccggaaaggctattacttttgtcacacagtatgatgtggaactcttccagcgcatagaacacttaattgggaagaaactaccaggttttccaacacaggatgatgaggttatgatgctgacagaacgcgtcgctgaagcccaaaggtttgcccgaatggagttaagggagcatggagaaaagaagaaacgctcgcgagaggatgctggagataatgatgacacagagggtgctattggtgtcaggaacaaggtggctggaggaaaaatgaagaagcggaaaggccgttaatcacttttatgaaggctcgagttctgctgttctgtaaaagagaattggagaatgaaacctgctccaacagagatcatgagactgaaattggtcagaattgtgtccagaatgtgctcagctaattcagtattcttccccattctgggttggagtttactgcagagtaattcttacagtgctgatgtcaagactgttactgttcttcgactttgattccttgctcatgacatgagtagggtgtgctcttctgtcacttcacacagaccttttgccttttttagctgcaagtcaaggactaggttgatgatgcccatgacctgtaattgtaaagaagcttggacatctgcaaatgatatttaaaccatcttggcttgtgctttattcaaactaatgtgaaacaataaatttaaatattatttttaaaa

SEQ ID NO: 538 - DNA, 1817 bp, Homo sapiens
acttccggagacctcacacaagatggcggcacccgaggaacacgattctccgaccgaagcgtcccagccgattgtggaagaggaggaaactaaaacatttaaagacctgggtgtgacagatgtgttgtgtgaagcttgtgaccagttgggatggacaaaacccaccaagatccagattgaagctattcctttggccttacaaggtcgtgatatcattgggcttgcagaaactggctctggaaagacaggcgcctttgctttgcccattctaaacgcactgctggagaccccgcagcgtttgtttgccctagttcttaccccgactcgggagctggcctttcagatctcagagcagtttgaagccctggggtcctctattggagtgcagagtgctgtgattgtaggtggaattgattcaatgtctcaatctttggcccttgcaaaaaaaccacatataataatagcaactcctggtcgactgattgaccacttggaaaatacgaaaggtttcaacttgagagctctcaaatacttggtcatggatgaagccgaccgaatactgaatatggattttgagacagaggttgacaagatcctcaaagtgattcctcgagatcggaaaacattcctcttctctgccaccatgaccaagaaggttcaaaaacttcagcgagcagctctgaagaatcctgtgaaatgtgccgtttcctctaaataccagacagttgaaaaattacagcaatattatatttttattccctctaaattcaaggatacctacctggtttatattctaaatgaattggctggaaactcctttatgatattctgcagcacctgtaataatacccagagaacagctttgctactgcgaaatcttggcttcactgccatccccctccatggacaaatgagtcagagtaagcgcctaggatcccttaataagtttaaggccaaggcccgttccattcttctagcaactgacgttgccagccgaggtttggacatacctcatgtagatgtggttgtcaactttgacattcctacccattccaaggattacatccatcgagtaggtcgaacagctagagctgggcgctccggaaaggctattacttttgtcacacagtatgatgtggaactcttccagcgcatagaacacttaattgggaagaaactaccaggttttccaacacaggatgatgaggttatgatgctgacagaacgcgtcgctgaagcccaaaggtttgcccgaatggagttaagggagcatggagaaaagaagaaacgctcgcgagaggatgctggagataatgatgacacagagggtgctattggtgtcaggaacaaggtggctggaggaaaaatgaagaagcggaaaggccgttaatcacttttatgaaggctcgagttctgctgttctgtaaaagagaattggagaatgaaacctgctccaacagagatcatgagactgaaattggtcagaattgtgtccagaatgtgctcagctaattcagtattcttccccattctgggttggagtttactgcagagtaattcttacagtgctgatgtcaagactgttactgttcttcgactttgattccttgctcatgacatgagtagggtgtgctcttctgtcacttcacacagaccttttgccttttttagctgcaagtcaaggactaggttgatgatgcccatgacctgtaattgtaaagaagcttggacatctgcaaatgatatttaaaccatcttggcttgtgctttattcaaactaatgtgaaacaataaatttaaatattatttttaaaaga

SEQ ID NO: 539 - DNA, 2538 bp, Homo sapiens
gcatggccaaggccgggcggccgccttgcccccgcttcctttcacgctgtcgctgcccgtaggtggttgtggccactgtgcccggagggaggcggcggtggccagtaatgcctgggaaactcctctggggggacattatggagctggaagcacccttggaggagtccgagagccagaagaaggagaggcaaaagagtgacagaaggaagtcaaggcaccattatgactcggatgagaaatcagaaacaagagaaaatggtgttacagatgacctggatgctcccaaggccaaaaaatctaaaatgaaagagaagctaaatggagacactgaagaaggatttaatagactttcagatgaattctccaaatctcataagtcaagaagaaaagatctaccaaatggagatatagatgaatatgaaaaaaaatcaaagcgagtatcatctttagatacttctactcataaatcaagtgataataaactagaggagaccttaacacgtgaacagaaagaaggagccttctccaattttcctatttctgaagagactataaagcttctgaaaggtcgaggggtaacatatctctttcctattcaagttaagacctttggtcctgtatatgaaggaaaagatttaatagctcaagcacggacaggaacaggaaagacattctcttttgccatccccttaattgaaagactccaaagaaatcaagaaacaattaaaaaaagccgctcaccaaaggtacttgttttggctccaacaagggaactggcaaaccaagtagccaaagacttcaaagatataactaggaaactcagcgtggcgtgtttttatggtggaacatcatatcaaagccaaattaatcatattcgaaatggtattgacatcttggttggaacacctggtcgtatcaaagaccatctgcagagtggccgattggatctttctaaactgcgacatgttgtgcttgatgaagtggatcagatgttagatttaggtttcgctgaacaagttgaagatattattcatgaatcctacaaaactgattctgaagacaatcctcagactttacttttttctgcaacttgcccacagtgggtatacaaagttgcaaaaaaatacatgaaatccagatatgaacaggttgaccttgttggaaaaatgactcaaaaggctgcaactactgtggaacatttggccatccagtgtcattggtctcagaggccagcagttattggagatgtccttcaagtctacagtgggtctgaagggagggctattattttctgtgagaccaagaagaatgtaactgaaatggccatgaatccacacataaaacagaatgcccagtgtttacatggggacattgcacagtcacaaagagaaattacactaaaaggcttcagagaaggtagttttaaagttttggtggcaaccaatgtggctgcccgtggtttggacattcctgaagttgacctggtgattcaaagttctcctcctcaggatgttgagtcctatatccatcgctctggacgcacaggtagagctggacggacagggatttgtatatgtttttatcaaccaagagaaagaggtcaactaagatatgtggaacaaaaagcaggaattacttttaaacgtgtaggtgttccttctacaatggatttagttaaatctaaaagcatggatgccatcaggtctctggcttccgtttcttacgctgctgttgattttttccgaccatcagctcagagactgatagaagagaaaggtgcagtggatgcattggctgcagctttagcccacatttctggtgcatcaagctttgaaccacgatctttgatcacctctgataaggggtttgtgaccatgactctggaaagcctagaggaaatacaggatgtcagctgtgcttggaaagaacttaacagaaagctgagtagtaatgcagtgtctcagattaccagaatgtgcctcctgaaaggaaatatgggtgtttgctttgatgttcctacaactgagtcagaaaggttacaggcagagtggcatgattccgactggatactctcagtgccagccaaattacctgaaattgaagaatattatgatggaaacacatcttctaattccagacagaggagtggctggtcaagtggtcgatcaggccggtcaggccggtcaggtggtcgatctggcggccggtcaggtagacagagtcgacaaggaagtcgctcaggaagtcgacaagatggtagaagacgaagtgggaatagaaatcgatcaagaagtgggggccacaaacggagttttgactgagtatttgatagttaatctaccagtgtgagcttgcctatttctgcctaatcatgtacattatccaccaaaaattaggtcatcatagttgaggtatgtgtctgctatttgcaaagaagttggtcgtatttttttaaaaagtatttcacaagaatggaacaaatctacttatccagttatacctttgaataaaaaaacctccttttattgtctcttttca

SEQ ID NO: 540 - DNA, 2417 bp, Homo sapiens
cacgctgtcgctgcccgtaggtggttgtggccactgtgcccggagggaggcggcggtggccagtaatgcctgggaaactcctctggggggacattatggagctggaagcacccttggaggagtccgagagccagaagaaggagaggcaaaagagtgacagaaggaagtcaaggcaccattatgactcggatgagaaatcagaaacaagagaaaatggtgttacagatgacctggatgctcccaaggccaaaaaatctaaaatgaaagagaagctaaatggagacactgaagaaggatttaatagactttcagatgaattctccaaatctcataagtcaagaagaaaagatctaccaaatggagatatagatgaatatgaaaaaaaatcaaagcgagtatcatctttagatacttctactcataaatcaagtgataataaactagaggagaccttaacacgtgaacagaaagaaggagccttctccaattttcctatttctgaagagactataaagcttctgaaaggtcgaggggtaacatatctctttcctattcaagttaagacctttggtcctgtatatgaaggaaaagatttaatagctcaagcacggacaggaacaggaaagacattctcttttgccatccccttaattgaaagactccaaagaaatcaagaaacaattaaaaaaagccgctcaccaaaggtacttgttttggctccaacaagggaactggcaaaccaagtagccaaagacttcaaagatataactaggaaactcagcgtggcgtgtttttatggtggaacatcatatcaaagccaaattaatcatattcgaaatggtattgacatcttggttggaacacctggtcgtatcaaagaccatctgcagagtggccgattggatctttctaaactgcgacatgttgtgcttgatgaagtggatcagatgttagatttaggtttcgctgaacaagttgaagatattattcatgaatcctacaaaactgattctgaagacaatcctcagactttacttttttctgcaacttgcccacagtgggtatacaaagttgcaaaaaaatacatgaaatccagatatgaacaggttgaccttgttggaaaaatgactcaaaaggctgcaactactgtggaacatttggccatccagtgtcattggtctcagaggccagcagttattggagatgtccttcaagtctacagtgggtctgaagggagggctattattttctgtgagaccaagaagaatgtaactgaaatggccatgaatccacacataaaacagaatgcccagtgtttacatggggacattgcacagtcacaaagagaaattacactaaaaggcttcagagaaggtagttttaaagttttggtggcaaccaatgtggctgcccgtggtttggacattcctgaagttgacctggtgattcaaagttctcctcctcaggatgttgagtcctatatccatcgctctggacgcacaggtagagctggacggacagggatttgtatatgtttttatcaaccaagagaaagaggtcaactaagatatgtggaacaaaaagcaggaattacttttaaacgtgtaggtgttccttctacaatggatttagttaaatctaaaagcatggatgccatcaggtctctggcttccgtttcttacgctgctgttgattttttccgaccatcagctcagagactgatagaagagaaaggtgcagtggatgcattggctgcagctttagcccacatttctggtgcatcaagctttgaaccacgatctttgatcacctctgataaggggtttgtgaccatgactctggaaagcctagaggaaatacaggatgtcagctgtgcttggaaagaacttaacagaaagctgagtagtaatgcagtgtctcagattaccagaatgtgcctcctgaaaggaaatatgggtgtttgctttgatgttcctacaactgagtcagaaaggttacaggcagagtggcatgattccgactggatactctcagtgccagccaaattacctgaaattgaagaatattatgatggaaacacatcttctaattccagacagagtcgacaaggaagtcgctcaggaagtcgacaagatggtagaagacgaagtgggaatagaaatcgatcaagaagtgggggccacaaacggagttttgactgagtatttgatagttaatctaccagtgtgagcttgcctatttctgcctaatcatgtacattatccaccaaaaattaggtcatcatagttgaggtatgtgtctgctatttgcaaagaagttggtcgtatttttttaaaaagtatttcacaagaatggaacaaatctacttatccagttatacctttgaataaaaaaacctccttttattgtctcttttc

SEQ ID NO: 541 - DNA, 4718 bp, Homo sapiens
gcagcgcgccacgcccgagtcccaggcgtgcggctggccatggcgctgttctacgtcgcgcggtacccgggccccgatgcggcagctgcggcggggccggagggcgcggaggccggggcgcacggcagggcccgcgcgctgctcgagcggctgcagagccgggcccgcgaacggcagcagcagcgggagcccgcgcagaccgaggcggctgcatcgaccgagccggcgaccaggaggcgacggcggccccggcggcggcggcgggtgaacgacgcggagccggggagcccggaggcgccgcagggaaagcgacggaaggcggacggcgaggacgcgggcgcagaaagcaacgaggaggcgccaggggagcccagcgcagggagcagcgaggaggcgccaggggagcccagcgcagggagcagcgaggaggcgccgggggagcgcagcaccagcgccagcgccgaggcggccccagatggaccggccctggaggaggcggccggacccctggtccccggcctggtgctgggggggttcgggaagaggaaggcgccgaaggtccagcctttcctgccaaggtggctggctgagcctaactgtgtcagaaggaatgtcaccgaagacctggttcctatcgaggacatccctgacgtccatcctgacctgcagaagcagctgcgggcacacggcatctcgtcctactttccagtccaggcagctgtgattcctgccctcctggagagcgcagcctgtgggtttctggtgggcagaggtggctaccggcctagcgacctctgtgtttctgccccaacaggcagtgggaagacactggccttcgtcatccctgtggtgcaggccctgctttcgagagtggtctgccacatccgtgccctggttgtgctgcccaccaaggagctggcccagcaggtgagcaaagttttcaacatctacacagatgccacacctctgagagtctccctggttacgggacagaagtctctggccaaggagcaggagagcctcgtccagaaaacagctgatgggtaccgctgcttggctgacatcgtggtagccacccccggccgcctggtggaccacatcgaccagaccccaggattcagcctccagcagctccgcttcctgattatcgacgaggctgaccggatgattgacagcatgcatcagtcctggctgccgcgggtggtggcggccgccttccagagcgaggaccccgcggacccctgtgccctgctccagcgaaggcaggcccaggctgtgacagccgccagcacctgctgtccccagatgcccctgcagaagctgctcttctcagctactctgacccagaaccctgaaaagctgcagcagctgggcctccaccagccccggcttttctccacagggctagcacacaggggcctggaagatacagatggggacggggattcggggaagtatgcctttcctgttgggctcacgcaccactacgtgccctgcagcctcagctctaagccgctggtcgtcctgcacctggtcctggagatgggcttctcgagggttctctgcttcactaactcccgagagaactcccacaggctcttcctgctggtgcaagcttttgggggtgtggacgtggctgagttctcctcgcgctacgggcctggccagaggaggatgatcctgaagcagtttgaacaggggaagatccagctgctcatcagcacggacgccaccgcgcgaggcatcgacgtgcagggtgtggagctggtggtgaactacgacgccccccagtacctgagaacctacgtgcaccgggttgggaggacagctcgcgctgggaaaactggacaggccttcacactgctcctgaaagtgcaggagaggagattcctccgaatgctaactgaagctggggcacctgagttgcagcggcacgagctctccagcaagctgctgcagccgctggttcctcggtacgaggaggccctgtcccagctggaggagtctgtcaaggaagagcgcaagcagagggcggcctaggctggggctcagagggccggagggactgaacgctcaccaccctgaccctccttccagagcagtgctgatcactggatcctgtatgtgaggaaaggaatcccccagtggacacagccttcctccccaagcacgtggtctctgcgccaggcagcccgggcgtcagagctcaagcacctgccccgactggagacttcagggcttgtcactttcagagtgtggaggtcaggatggctgcgggcaatgaagccttagtaaaacggtgaaaagtactcccagacggacgcgggcacccgtcatgcttttgctgagagttgggggcattaaccttgagctaatgttaaaaatcaagctcttggccaggcatggtggctcatgcctgtaattccagcactttgggaggccaaggcgggtggatcacctgaggtcacgagttcgagaccagcctgaccaacatggagaaaccctgtctctactaaaaatacaaaattagccaggcgtggtggtgcatgcctgtaatccagctacttgggaggctgaggcaggaaaatggcttgaacccgggaggtggaggttgcagtgagctgagattgcgccactgcactccagcctgggcaacaagagcaaaactccgtctcaaaaaaaaaaattgccgggcgcggtggcaaatgcctgtaatcccagcactttgggaggccgaggcaggtggatcacaaggtcaggagatagagaccatcattgctaacatggtgaaaccccgtctctactaaaaatacaaaaaaaaaaaaaaaacaactagccgggcgtggtggcgggcacctatagtcccagctactcgggaggctgaggcaggagaatggcgtgaacccgggaggcggagcttgcagtgagcggagactgcgccactgcactccagcctgggcaacagagtgagactccgtcaaaaaaaaagctctcctccccagatttgtgaaccttgtgactgttcagtggacacctcacatattgctggtgggaaggtcacgtggagacagctgggcaaagccttggggcgttaaacacagagtcactcatgacccagcacttcctctcctatgcaccttgtacaccccagatcaatgaaacctacatccacacagaaacgtacacaaatctctcagcagcactgttcacagtagccaaaaactagaaaccacatgtccgtcagctgatgaatggagaataaaacgtgggaaatccacaccaggagagaaaaaggagtgaggcaccagcataggcaccccgtggatgaacccggaacctgacgctaactgaaggaaggctccggctatagggagtgtcccaggcacagccagagattgaagggtgccggggccgggagttggtgggggttggggctggggacacagtggccagtgtgtgggtttgttttggggatgatgaaaatgttcttaggttgtgtgtggtgatggctgctcacctctataaaccttttactaaaaaccatggactgggtggatacagtgtgtgaattctctcagtccagtgctttgtttgaaaaaggtggatgatgccaacatcactaaccgccagggagacgcaggccacggccacacccggctcactggagttgtgaggatggaaacaccagcccaccccactcagttcagacctcagcttagatgcaaagaatgtctgggatggggactggcagctgattagagatgcaaccactgaacctgtggactgtgttcaaacaaatgccagcagaacacaaaaggcgactgttacaggaggcagaaagaaatgatttaggtagacggggtaaagccagtccccagcagaaaatttgccttttaacaaaaagcagctcaaaaatagctccctttctaacctcggggttcaaaatcacttctcacgacaagcagccagaaagagcagactgtgaatcacagatgagacagctcgggcacaggagtgcggggggtgtctcctgggtgatcaccaaacttcacacttccacaatgggccccagtaaaacagtggaccctaataagcacattcccgtccccttaggtgcactaagggaagctaaaagcagactgaggggtgcctgtaaccccaagaagatgtctgggagcagacccagagaccctcgcagaaaagtgtcacagagcagcacagactgagtctgacagaaactctctatacaaatagcacaccttgtcccagctaaaaccctgggccctgggaggacaagacatccctcctctaacccctcgtcactagcccatttgtaaaaaccttgacaggccgggcacggtggctcacacctgtaatcccagcactttgggaggctgaggcaggcgcatcacctgaggtcaggagatcgagaccatcctggccaacatggtgaaaccccatctctactaaaaatacaaaacttagctgagcgtggtggcgtgtgcctggagtcccaactactcaagaggctgaggcaggagaatcacttgcccgggaggtggaggttgcagtgggccaagatcagcccactgcactgcagcctggcgacagaaaaaaaagaaaccttgacatctttactacaacttagcaacccgctcaggccccctctgcaacggagagctcttcttcctttttgcttattaaacttctgctccaaa

SEQ ID NO: 542 - DNA, 2118 bp, Homo sapiens
gcagaaggtgacgggaaacaggccgcagacctgaacttccaaccgtatgtaggcgagaagccggtgccgatactcccactatcccacaatgtcccactgggccccagagtggaagagggcggaggctaatccaagagaccttggggccagctgggatgtcaggggcagcagaggcagtggctggagtggccccttcggccatcagggaccgagagcagcaggctcccgtgaaccaccactctgctttaaaataaagaacaatatggttggtgtggtcattggttacagtggatcaaaaataaaagatctacaacattcgacaaacactaaaatacagatcataaacggggaatctgaagcaaaagtcagaatttttggcaatagggaaatgaaagcaaaggccaaagcggctatagaaacacttattagaaaacaagaaagctacaactcagaatccagtgtggataatgctgcatcccaaacccctattggaagaaatctaggcagaaatgacattgttggagaagctgagccattgtcaaattgggatcgcattagggcagcagtcgtggagtgcgaaaagagaaaatgggcagatctaccaccagttaagaaaaacttttacatagaatccaaagcaacaagctgcatgtctgaaatgcaggtgattaactggagaaaggaaaatttcaacataacgtgtgatgacttgaaaagtggtgaaaagcgtctcattccaaaaccaacttgcaggtttaaagacgcttttcagcaataccctgatcttctgaaaagcataataagggtagggattgtaaagccaacgccaattcagtcacaggcatggccaattattctacaaggaatagatcttatagtagttgcacaaaccggaacagggaaaacattgtcctatctaatgcctgggtttattcatcttgattctcaaccaatatctagagagcaaaggaatgggcctgggatgctagtccttacacccactagagagttggctcttcacgtggaagctgaatgttcaaagtattcatataaaggtctcaaaagcatttgcatatatggtggtagaaacagaaatggacaaatagaagacattagcaaaggtgtagatatcattattgcaactcctgggaggctgaatgacctacaaatgaataactctgtcaacctaagaagcataacctacttggttatagatgaggcagataaaatgctggatatggaatttgaaccccagataaggaagattttattagatgtgcgcccagaccgacagactgttatgacaagtgcaacttggccagatactgtacgtcaactagcactttcttatttgaaagatcctatgattgtttatgttggtaatctgaatctagtggctgtaaatacagtgaagcaaaatataattgttaccacagaaaaagaaaaacgagctctcacccaagaattcgtagagaacatgtcacccaacgacaaagtcatcatgtttgtcagccaaaaacatattgctgatgacttgtcaagcgacttcaatatccaaggcatatctgcagaatcattacatggcaacagtgaacagagtgatcaagagcgagcagtagaggactttaaaagcggaaacataaagatactgattacaactgatatagtatcccgaggtcttgatcttaatgatgtcacacatgtatataattatgatttcccaaggaatattgacgtatatgtacacagagtagggtacattggacggacaggaaagactggcacatcagttaccctcatcactcagagagattcgaaaatggccggtgaattgattaaaattctggacagagcaaatcagagtgttccggaagatcttgtagtaatggctgagcaatacaagttaaatcaacaaaagaggcacagagaaacacgatcaagaaaacctggacaaagacgcaaggagttttattttttaagttgaaaagttgtaccaggctactggaagattccaggcatgttaaagatatgcagtattgaatatatgtaaggaagtattggaaacatactagccatttgaagacataactaattcttaaataatactgctaaactttc

SEQ ID NO: 543 - DNA, 2336 bp, Homo sapiens
ccgggaagtgacttcgtctccgaagccgattggttgttgctttgctcccgctcgcgtcggtggcgtttttcctgcagcgcgtgcgtgctgcgctactgagcagcgccatggaggactctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcgacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagagagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctgtcacttgccccggatttaccaggcttttctcatgtcagctacttttaacgaggacgtacaagcactcaaggagctgatattacataacccggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccaggtgccacatcatctcacagttcaaccaaggcttctacgactgtgtcatagcaactgatgctgaagtcctgggggccccagtcaagggcaagcgtcggggccgagggcccaaaggggacaaggcctctgatccggaagcaggtgtggcccggggcatagacttccaccatgtgtctgctgtgctcaactttgatcttcccccaacccctgaggcctacatccatcgagctggcaggacagcacgcgctaacaacccaggcatagtcttaacctttgtgcttcccacggagcagttccacttaggcaagattgaggagcttctcagtggagagaacaggggccccattctgctcccctaccagttccggatggaggagatcgagggcttccgctatcgctgcagggatgccatgcgctcagtgactaagcaggccattcgggaggcaagattgaaggagatcaaggaagagcttctgcattctgagaagcttaagacatactttgaagacaaccctagggacctccagctgctgcggcatgacctacctttgcaccccgcagtggtgaagccccacctgggccatgttcctgactacctggttcctcctgctctccgtggcctggtgcgccctcacaagaagcggaagaagctgtcttcctcttgtaggaaggccaagagagcaaagtcccagaacccactgcgcagcttcaagcacaaaggaaagaaattcagacccacagccaagccctcctgaggttgttgggcctctctggagctgagcacattgtggagcacaggcttacacccttcgtggacaggcgaggctctggtgcttactgcacagcctgaacagacagttctggggccggcagtgctgggccctttagctccttggcacttccaagctggcatcttgccccttgacaacagaataaaaattttagctgccccagtttgtgcctccagcatatgaaaaggactatttgaatccccaaaacatcaggagtcgggaaacttcggaagacagctgtgcctggctctgtggctgcatgcagtgcttcacttggccagcagaggtcagctgtgccgagctgccccagccatgagaagagaagcctgcccttgctggcaggtggctatggccggcccagagccttcctgcccagctcctgcagccctgctgcctgggatcaggctgggagatgggccttcctgaccgccagccttcctctccccgagcacacgcacatgtagattcggggggaagctgcctgctcttccttagaggagccggggcagctatctgctggtccctttctgaacaactgttgatgtgtga

SEQ ID NO: 544 - DNA, 3325 bp, Homo sapiens
ggtggagctagcctcgtgaccttttaccccaacatggctgcgcccgtgggaccggtgaagttctggcgacccggtacagaggggccaggtgtaagcatctctgaagagagacaaagtctggctgaaaactctgggacaacggttgtttacaacccttatgctgccctttccatagagcagcagaggcagaagctgccggtattcaagcttaggaatcatattttatacttgatagaaaattatcagacagtggtgattgttggtgaaacaggatgtgggaagagcacacagattcctcagtaccttgcagaagccggctggacagctgaaggaagagtggtaggagtgacccagcctcgaagagtggctgctgttacagttgcagggagagtagctgaagaaaggggtgcagtgctgggccacgaggtgggctactgcatccgctttgatgactgcaccgaccagctggccacgagaattaagtttcttactgatggaatgctggtcagggaaatgatggttgatccgttgttaacaaaatatagtgtcatcatgctggatgaagcccacgagaggaccttgtacactgacattgccattggcttgctaaaaaagattcagaaaaagcgaggggatcttcgattgattgtagcttcagccactctggatgcagacaaattccgggatttctttaatcaaaatgaaaccagtgatccagcaagggatacatgtgtgatccttacagtggaagggagaacatttccggtggatatcttttatctacaaagtcctgttccagattatatcaaatcaactgtcgaaactgtggtgaaaattcaccagacagagggagacggagacgttttagcatttcttactggccaggaagaggtagaaactgttgtgtcgatgctcatcgagcaggctcgagcactagctcgcactgggatgaagagacacctccgagttctccccatgtatgcaggactgccttcctttgagcaaatgaaagtgtttgaaagggtgtcacgcagtgtcagaaaggtgatagtggccaccaatgtggcagaaacctctatcacaatcagcggcattgtgtatgtgatcgactgtggctttgtgaaactccgagcctacaatcccaggacagctattgaatgcttggtggtggtgccagtctcccaggcatcagctaatcagcgagcaggacgtggtggtcgtagtcgctcgggaaaatgttatcgcctttatacagaggaagcctttgacaagttgcctcagtctacggttcctgagatgcagcgtagtaatttggcacctgtcatcctgcagctgaaagcactaggaattgacaatgtcctcaggttccacttcatgtcgccccctccagcacagtcgatggttcaagccttggagttactgtatgctctgggaggtctggacaaagactgtcgcctaactgaaccgcttggcatgagaattgcagagtttcctttgaatcccatgtttgccaaaatgctgcttgaatcaggaaacttcggctgttctcaggaaattctaagcatcgctgccatgatgcagatccagaatatctttgtggtccccccaaaccagaagtctcacgcaattcgagtgcaccgtaaatttgctgtggaggagggcgaccacctcactatgctcaatatatatgaagcatttatcaaacacaataaggactctaaatggtgtcaggaacatttcctgaattacaagggtcttgtcagagctgcgactgtaagagaacaattgaaaaagcttcttgtcaagtttcaagtgcccaggaagtctagtgaaggtgacccggatctggttctgaggtgcattgtctccggcttcttcgccaatgcagcgaggtttcattctactggagcttataggaccatccgtgatgaccatgagctgcacatacaccctgcgtcagtcctctatgcagagaagccgcctcgctgggtcatctataacgaagttatacagacctccaagtactacatgagagatgtgactgccattgaatcggcctggctgttggagctggctccacacttttatcaacaaggaacgcacctgtctctgaaagccaaaagggccaaggtccaggacccgtgagaggagcccacagctacagctgcagggactgctggcgtcctctcctccatgctgctgcccctggtcccaggtggggtgagctggcaccagctcctgtggaatgtttggttgctctgaagtgggctgcggcctgttcattagtcctttcttcccgctgcccacagcatttgcatccttgctgggatcctggaggactttgtgcatgggcaggcatccttctgtgctgcagcgggcagagtgggagttggctcactcagcacgctcactaacccagcatgccacttccagcaggcatgcagtcctggcccagctctatgggaaacaaggaggaaagttagccactgaaggccaaaacaccatgtggggtggacagagggtttgctgggctggctttgctttccctgctggggccacagctgtgttaaccaatgaggtctgctgccaggtgtgaacaagcatgtctctacgaatgaacgaaacattggggatctctgccgaaaccaccaaagggcatgtctgatgggcacagggtctcccaaacccagtggcttctgtctgtcctcagcccttgtccctgtttatctgcagccaggagacttgcaagggattggtgattgacagagaggactcgtgcgctgttttgtgttagcagaggatttgtgtttcacaggtaggcttagcgtcctctcagagtgtagtgccaggtcctggtgccacgctagctgagcactcaggagagttcatcagctcagatcccacagggcctcctctttagcaggaattcacaacagtttggatgccctaaacttctgtagctcaggaacatcactggtgtatttgtttttttgtttgtttgcttgggttcttgcaagagcgcgtggggacagttcttccagcaggcactggttttgttgccccagggctgctttgctgtgatgatgattgcatttcaacacatgccagatgcagattttttcccccttactgtttcaatgacctttattttaaaaacacatagcttgaaaatttatttttatactgatattagtttggatgtgccacttttggcaccaaacgtgtatgtcatttttatttccattttataaacatgtaaataatagtgataacttgttaataatagtaaacctttatacctaaagtaaatgtcttccctcccaca

SEQ ID NO: 545 - DNA, 3227 bp, Homo sapiens
gaccttttaccccaacatggctgcgcccgtgggaccggtgaagttctggcgacccggtacagaggggccaggtgtaagcatctctgaagagagacaaagtctggctgaaaactctgggacaacggttgtttacaacccttatgctgccctttccatagagcagcagaggcagaagctgccggtattcaagcttaggaatcatattttatacttgatagaaaattatcagacagtggtgattgttggtgaaacaggatgtgggaagagcacacagattcctcagtaccttgcagaagccggctggacagctgaaggaagagtggtaggagtgacccagcctcgaagagtggctgctgttacagttgcagggagagtagctgaagaaaggggtgcagtgctgggccacgaggtgggctactgcatccgctttgatgactgcaccgaccagctggccacgagaattaagtttcttactgatggaatgctggtcagggaaatgatggttgatccgttgttaacaaaatatagtgtcatcatgctggatgaagcccacgagaggaccttgtacactgacattgccattggcttgctaaaaaagattcagaaaaagcgaggggatcttcgattgattgtagcttcagccactctggatgcagacaaattccgggatttctttaatcaaaatgaaaccagtgatccagcaagggatacatgtgtgatccttacagtggaagggagaacatttccggtggatatcttttatctacaaagtcctgttccagattatatcaaatcaactgtcgaaactgtggtgaaaattcaccagacagagggagacggagacgttttagcatttcttactggccaggaagaggtagaaactgttgtgtcgatgctcatcgagcaggctcgagcactagctcgcactgggatgaagagacacctccgagttctccccatgtatgcaggactgccttcctttgagcaaatgaaagtgtttgaaagggtgtcacgcagtgtcagaaaggtgatagtggccaccaatgtggcagaaacctctatcacaatcagcggcattgtgtatgtgatcgactgtggctttgtgaaactccgagcctacaatcccaggacagctattgaatgcttggtggtggtgccagtctcccaggcatcagctaatcagcgagcaggacgtggtggtcgtagtcgctcgggaaaatgttatcgcctttatacagaggaagcctttgacaagttgcctcagtctacggttcctgagatgcagcgtagtaatttggcacctgtcatcctgcagctgaaagcactaggaattgacaatgtcctcaggttccacttcatgtcgccccctccagcacagtcgatggttcaagccttggagttactgtatgctctgggaggtctggacaaagactgtcgcctaactgaaccgcttggcatgagaattgcagagtttcctttgaatcccatgtttgccaaaatgctgcttgaatcaggaaacttcggctgttctcaggaaattctaagcatcgctgccatgatgcagatccagaatatctttgtggtccccccaaaccagaagtctcacgcacacaataaggactctaaatggtgtcaggaacatttcctgaattacaagggtcttgtcagagctgcgactgtaagagaacaattgaaaaagcttcttgtcaagtttcaagtgcccaggaagtctagtgaaggtgacccggatctggttctgaggtgcattgtctccggcttcttcgccaatgcagcgaggtttcattctactggagcttataggaccatccgtgatgaccatgagctgcacatacaccctgcgtcagtcctctatgcagagaagccgcctcgctgggtcatctataacgaagttatacagacctccaagtactacatgagagatgtgactgccattgaatcggcctggctgttggagctggctccacacttttatcaacaaggaacgcacctgtctctgaaagccaaaagggccaaggtccaggacccgtgagaggagcccacagctacagctgcagggactgctggcgtcctctcctccatgctgctgcccctggtcccaggtggggtgagctggcaccagctcctgtggaatgtttggttgctctgaagtgggctgcggcctgttcattagtcctttcttcccgctgcccacagcatttgcatccttgctgggatcctggaggactttgtgcatgggcaggcatccttctgtgctgcagcgggcagagtgggagttggctcactcagcacgctcactaacccagcatgccacttccagcaggcatgcagtcctggcccagctctatgggaaacaaggaggaaagttagccactgaaggccaaaacaccatgtggggtggacagagggtttgctgggctggctttgctttccctgctggggccacagctgtgttaaccaatgaggtctgctgccaggtgtgaacaagcatgtctctacgaatgaacgaaacattggggatctctgccgaaaccaccaaagggcatgtctgatgggcacagggtctcccaaacccagtggcttctgtctgtcctcagcccttgtccctgtttatctgcagccaggagacttgcaagggattggtgattgacagagaggactcgtgcgctgttttgtgttagcagaggatttgtgtttcacaggtaggcttagcgtcctctcagagtgtagtgccaggtcctggtgccacgctagctgagcactcaggagagttcatcagctcagatcccacagggcctcctctttagcaggaattcacaacagtttggatgccctaaacttctgtagctcaggaacatcactggtgtatttgtttttttgtttgtttgcttgggttcttgcaagagcgcgtggggacagttcttccagcaggcactggttttgttgccccagggctgctttgctgtgatgatgattgcatttcaacacatgccagatgcagattttttcccccttactgtttcaatgacctttattttaaaaacacatagcttgaaaatttatttttatactgatattagtttggatgtgccacttttggcaccaaacgtgtatgtcatttttatttccattttataaacatgtaaataatagtgataacttgttaataatagtaaacctttatacctaaagtaaatgtcttccctccc

SEQ ID NO: 546 - DNA, 3226 bp, Homo sapiens
ggagctagcctcgtgaccttttaccccaacatggctgcgcccgtgggaccggtgaagttctggcgacccggtacagaggggccaggtgtaagcatctctgaagagagacaaagtctggctgaaaactctgggacaacggttgtttacaacccttatgctgccctttccatagagcagcagaggcagaagctgccggtattcaagtaccttgcagaagccggctggacagctgaaggaagagtggtaggagtgacccagcctcgaagagtggctgctgttacagttgcagggagagtagctgaagaaaggggtgcagtgctgggccacgaggtgggctactgcatccgctttgatgactgcaccgaccagctggccacgagaattaagtttcttactgatggaatgctggtcagggaaatgatggttgatccgttgttaacaaaatatagtgtcatcatgctggatgaagcccacgagaggaccttgtacactgacattgccattggcttgctaaaaaagattcagaaaaagcgaggggatcttcgattgattgtagcttcagccactctggatgcagacaaattccgggatttctttaatcaaaatgaaaccagtgatccagcaagggatacatgtgtgatccttacagtggaagggagaacatttccggtggatatcttttatctacaaagtcctgttccagattatatcaaatcaactgtcgaaactgtggtgaaaattcaccagacagagggagacggagacgttttagcatttcttactggccaggaagaggtagaaactgttgtgtcgatgctcatcgagcaggctcgagcactagctcgcactgggatgaagagacacctccgagttctccccatgtatgcaggactgccttcctttgagcaaatgaaagtgtttgaaagggtgtcacgcagtgtcagaaaggtgatagtggccaccaatgtggcagaaacctctatcacaatcagcggcattgtgtatgtgatcgactgtggctttgtgaaactccgagcctacaatcccaggacagctattgaatgcttggtggtggtgccagtctcccaggcatcagctaatcagcgagcaggacgtggtggtcgtagtcgctcgggaaaatgttatcgcctttatacagaggaagcctttgacaagttgcctcagtctacggttcctgagatgcagcgtagtaatttggcacctgtcatcctgcagctgaaagcactaggaattgacaatgtcctcaggttccacttcatgtcgccccctccagcacagtcgatggttcaagccttggagttactgtatgctctgggaggtctggacaaagactgtcgcctaactgaaccgcttggcatgagaattgcagagtttcctttgaatcccatgtttgccaaaatgctgcttgaatcaggaaacttcggctgttctcaggaaattctaagcatcgctgccatgatgcagatccagaatatctttgtggtccccccaaaccagaagtctcacgcaattcgagtgcaccgtaaatttgctgtggaggagggcgaccacctcactatgctcaatatatatgaagcatttatcaaacacaataaggactctaaatggtgtcaggaacatttcctgaattacaagggtcttgtcagagctgcgactgtaagagaacaattgaaaaagcttcttgtcaagtttcaagtgcccaggaagtctagtgaaggtgacccggatctggttctgaggtgcattgtctccggcttcttcgccaatgcagcgaggtttcattctactggagcttataggaccatccgtgatgaccatgagctgcacatacaccctgcgtcagtcctctatgcagagaagccgcctcgctgggtcatctataacgaagttatacagacctccaagtactacatgagagatgtgactgccattgaatcggcctggctgttggagctggctccacacttttatcaacaaggaacgcacctgtctctgaaagccaaaagggccaaggtccaggacccgtgagaggagcccacagctacagctgcagggactgctggcgtcctctcctccatgctgctgcccctggtcccaggtggggtgagctggcaccagctcctgtggaatgtttggttgctctgaagtgggctgcggcctgttcattagtcctttcttcccgctgcccacagcatttgcatccttgctgggatcctggaggactttgtgcatgggcaggcatccttctgtgctgcagcgggcagagtgggagttggctcactcagcacgctcactaacccagcatgccacttccagcaggcatgcagtcctggcccagctctatgggaaacaaggaggaaagttagccactgaaggccaaaacaccatgtggggtggacagagggtttgctgggctggctttgctttccctgctggggccacagctgtgttaaccaatgaggtctgctgccaggtgtgaacaagcatgtctctacgaatgaacgaaacattggggatctctgccgaaaccaccaaagggcatgtctgatgggcacagggtctcccaaacccagtggcttctgtctgtcctcagcccttgtccctgtttatctgcagccaggagacttgcaagggattggtgattgacagagaggactcgtgcgctgttttgtgttagcagaggatttgtgtttcacaggtaggcttagcgtcctctcagagtgtagtgccaggtcctggtgccacgctagctgagcactcaggagagttcatcagctcagatcccacagggcctcctctttagcaggaattcacaacagtttggatgccctaaacttctgtagctcaggaacatcactggtgtatttgtttttttgtttgtttgcttgggttcttgcaagagcgcgtggggacagttcttccagcaggcactggttttgttgccccagggctgctttgctgtgatgatgattgcatttcaacacatgccagatgcagattttttcccccttactgtttcaatgacctttattttaaaaacacatagcttgaaaatttatttttatactgatattagtttggatgtgccacttttggcaccaaacgtgtatgtcatttttatttccattttataaacatgtaaataatagtgataacttgttaataatagtaaacctttatacctaaagtaaatgtcttccctccc

SEQ ID NO: 547 - DNA, 2540 bp, Homo sapiens
gactacgtgggtctggagctgactgccgtcctgacacgtcctagagctgcaagtcctgccagagagccaccatgacctctcagcctctcaggctagcagaagagtatggcccaagtcctggggagtctgaactggctgtgaacccctttgatgggcttcccttctcttcccgctactatgagctgctgaagcagcgccaagccttgcccatctgggctgctcgctttaccttcttggagcagttggagagtaaccccactggagtggtgctggtgtctggggagcctggttctggcaagagcacccagatccctcagtggtgtgcagagtttgcgctggccagagggttccagaaaggacaggttactgttactcagccctaccctcttgcagcccggagcctggctctgcgggttgctgatgagatggacctgaccctgggtcatgaggttggatacagcatcccccaggaggactgcacggggcccaacaccctgctcaggttctgctgggacaggctgcttctgcaggaggtggcctcgacccgaggcactggagcctggggcgtgctggtactagatgaggctcaggagcggtcggtggcatcagattcactccaggggctactgcaagatgccaggctggaaaaacttccgggggacctcagagtggttgtggttactgacccagcccttgaacctaagctccgagctttctggggcaatcctcctattgtgcatatacccagagagcctggtgagagaccttcccccatctactgggacaccatcccacctgatcgggtggaagctgcctgccaagcagtgcttgaattgtgtcggaaggagcttccaggagatgtgctagtgttcctgcccagtgaggaggaaatttccctgtgctgtgaatccttgtccagggaggtagagtccttgcttctccaagggcttccaccacgagtactgccccttcacccagactgtggacgagccgttcaggctgtgtatgaggacatggatgcccgaaaggttgtggtcactcactggctggctgacttctccttctccctcccttccatccaacatgtcatcgactcaggactggagctccgaagtgtttacaatcctaggatccgagcagaattccaagtgttgaggccaatcagcaagtgtcaggcagaggcaagacgattgcgagcaagagggttcccaccaggatcctgcctctgcctgtatcctaagtccttcttagaactagaagctccaccattgccacaacccagggtgtgtgaggagaatctgagctccctggtgttactactaaaaaggagacagattgcagagccaggggagtgtcacttcctggaccagcctgctccagaagcactgatgcaagccctggaagatttagactatctggcagccctggatgatgatggggacctgtcagatctgggtgtcatactatcagaattccctctggcccctgagctggccaaagccctgctggcctcatgcgagtttgactgtgtggacgagatgctcaccctggctgccatgctcacagctgcccctgggtttacccgtcctccactcagtgcagaagaagctgccctgcgtcgggccctggaacacacggatggtgaccacagttctctgatccaggtgtatgaagcctttatacaaagtggagcagatgaggcttggtgccaggctcgaggtctgaattgggcagcattgtgccaagcccataaacttcggggagaactcctagaactcatgcaacgaattgaacttcccttgtccctaccagcctttggctctgagcagaatcgcagagaccttcagaaagcactggtgtcaggatactttctcaaggtggccagagacacagacgggactggaaattaccttctcctaacccataagcatgtggcccagctctcctcatactgctgctaccgaagccgcagagctcctgccagacccccaccatgggtgctctaccacaatttcaccatatccaaagacaactgcctttccattgtttctgagattcaaccacagatgctggtggaattggcccctccatacttcctgagtaacttgcctcccagtgagagcagagaccttctgaaccagctaagggaaggaatggcagattctacagcagggagcaaatcatcctcagcccaggagttcagagatccctgtgtcctgcagtgacctgcctgcctatggaatggagctgggttcatctcatcacattagattatccctcagggtgacaccaaagcacccagacagatttagaagcccaaagtttagggtcaaatgtaaaccctggaacctgagtcccaagaaatggtagactgggaatggaaagaatggggtaaaccacagtctacatagggaaggactctttccttagccttctcttattgattggagagggactgacatgctcctcattctcttaactttgccaaacccattcttgtactcccttgtgatctataaaagatttttctatgatgccaa

SEQ ID NO: 548 - DNA, 2689 bp, Homo sapiens
gttttccataggttcctgactaggttaaataaggtggagcaaatagccccaccccaaaagcaggcttcaggatttgaagtttgagcccatccctgaggtagagccggaatttacctttgtacttcacacggtcagggttggtggtgactacgtgggtctggagctgactgccgtcctgacacgtcctagagctgcaagcaggtcctgccagagagccaccatgacctctcagcctctcaggctagcagaagagtatggcccaagtcctggggagtctgaactggctgtgaacccctttgatgggcttcccttctcttcccgctactatgagctgctgaagcagcgccaagccttgcccatctgggctgctcgctttaccttcttggagcagttggagagtaaccccactggagtggtgctggtgtctggggagcctggttctggcaagagcacccagatccctcagtggtgtgcagagtttgcgctggccagagggttccagaaaggacaggttactgttactcagccctaccctcttgcagcccggagcctggctctgcgggttgctgatgagatggacctgaccctgggtcatgaggttggatacagcatcccccaggaggactgcacggggcccaacaccctgctcaggttctgctgggacaggctgcttctgcaggaggtggcctcgacccgaggcactggagcctggggcgtgctggtactagatgaggctcaggagcggtcggtggcatcagattcactccaggggctactgcaagatgccaggctggaaaaacttccgggggacctcagagtggttgtggttactgacccagcccttgaacctaagctccgagctttctggggcaatcctcctattgtgcatatacccagagagcctggtgagagaccttcccccatctactgggacaccatcccacctgatcgggtggaagctgcctgccaagcagtgcttgaattgtgtcggaaggagcttccaggagatgtgctagtgttcctgcccagtgaggaggaaatttccctgtgctgtgaatccttgtccagggaggtagagtccttgcttctccaagggcttccaccacgagtactgccccttcacccagactgtggacgagccgttcaggctgtgtatgaggacatggatgcccgaaaggttgtggtcactcactggctggctgacttctccttctccctcccttccatccaacatgtcatcgactcaggactggagctccgaagtgtttacaatcctaggatccgagcagaattccaagtgttgaggccaatcagcaagtgtcaggcagaggcaagacgattgcgagcaagagggttcccaccaggatcctgcctctgcctgtatcctaagtccttcttagaactagaagctccaccattgccacaacccagggtgtgtgaggagaatctgagctccctggtgttactactaaaaaggagacagattgcagagccaggggagtgtcacttcctggaccagcctgctccagaagcactgatgcaagccctggaagatttagactatctggcagccctggatgatgatggggacctgtcagatctgggtgtcatactatcagaattccctctggcccctgagctggccaaagccctgctggcctcatgcgagtttgactgtgtggacgagatgctcaccctggctgccatgctcacagctgcccctgggtttacccgtcctccactcagtgcagaagaagctgccctgcgtcgggccctggaacacacggatggtgaccacagttctctgatccaggtgtatgaagcctttatacaaagtggagcagatgaggcttggtgccaggctcgaggtctgaattgggcagcattgtgccaagcccataaacttcggggagaactcctagaactcatgcaacgaattgaacttcccttgtccctaccagcctttggctctgagcagaatcgcagagaccttcagaaagcactggtgtcaggatactttctcaaggtggccagagacacagacgggactggaaattaccttctcctaacccataagcatgtggcccagctctcctcatactgctgctaccgaagccgcagagctcctgccagacccccaccatgggtgctctaccacaatttcaccatatccaaagacaactgcctttccattgtttctgagattcaaccacagatgctggtggaattggcccctccatacttcctgagtaacttgcctcccagtgagagcagagaccttctgaaccagctaagggaaggaatggcagattctacagcagggagcaaatcatcctcagcccaggagttcagagatccctgtgtcctgcagtgacctgcctgcctatggaatggagctgggttcatctcatcacattagattatccctcagggtgacaccaaagcacccagacagatttagaagcccaaagtttagggtcaaatgtaaaccctggaacctgagtcccaagaaatggtagactgggaatggaaagaatggggtaaaccacagtctacatagggaaggactctttccttagccttctcttattgattggagagggactgacatgctcctcattctcttaactttgccaaacccattcttgtactcccttgtgatctataaaagatttttctatgatgccaa

SEQ ID NO: 549 - DNA, 1887 bp, Homo sapiens
cgcccaggagtcatcggacgccagaatctggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctgcaggccctgcggggcgtgttcctgactgaggccctgcgagaggctgtgggccgggaggctgttcgcctgctggtcagtgtggatgaggctgactatgaggctggccggcgccgcctgttgctgatggaggaggaaggggggcggcgcccgacagaggcctcctgatccaggactggcaggattgatcccacctccaagtctccgggccaccttctcctgggaggacgaccatctctacccctagaggactgtcactctagcatctttgaggactgcgacaggaccgggacagcaggccccttgacagcccctcccacaggatgtgggctctgaggcctaaaccatttccagctgagtttccttcccagactcctcctacccccaggtgtgcccccttagcctccggaggcgggggctgggcctgtatctcagaagggaggggcacagctacacactcaccaaaggcccccctgcacattgtatctctgatcttgggctgtctgcactgtcacaggtgcacacactcgctcatgctcacactgcccctgctgagatcttccctgggcctctgccctggcctgcttcccagcacacacttctttggcctaagggcttctctctcaggacctctaatttgaccacaaccaacctgggcttcagccacatcagtgggcactggagctggggtgcacatggggcctgctcaccttgcccacacatctccagccagccagggccctgcccagcttcaatttacagacctgactctcctcaccttcccccctgctgtccagagctgaacatagacttgcacttggatgtcacctggagtgtcacatgggagtgttatggcagcatcataccaaggcctactgttgcacatggggccaaaaccagtaaacagccaccttcttggaaagggaatgcaaaggctttgggggtgatggaaaagaccttttacaaatgataccaattaaactgccctggaaagggcataggtggg

SEQ ID NO: 550 - DNA, 1894 bp, Homo sapiens
tcccgggctaagcgtcggcaagttctgtagagaaactcgggcaacctttggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctgcaggccctgcggggcgtgttcctgactgaggccctgcgagaggctgtgggccgggaggctgttcgcctgctggtcagtgtggatgaggctgactatgaggctggccggcgccgcctgttgctgatggaggaggaaggggggcggcgcccgacagaggcctcctgatccaggactggcaggattgatcccacctccaagtctccgggccaccttctcctgggaggacgaccatctctacccctagaggactgtcactctagcatctttgaggactgcgacaggaccgggacagcaggccccttgacagcccctcccacaggatgtgggctctgaggcctaaaccatttccagctgagtttccttcccagactcctcctacccccaggtgtgcccccttagcctccggaggcgggggctgggcctgtatctcagaagggaggggcacagctacacactcaccaaaggcccccctgcacattgtatctctgatcttgggctgtctgcactgtcacaggtgcacacactcgctcatgctcacactgcccctgctgagatcttccctgggcctctgccctggcctgcttcccagcacacacttctttggcctaagggcttctctctcaggacctctaatttgaccacaaccaacctgggcttcagccacatcagtgggcactggagctggggtgcacatggggcctgctcaccttgcccacacatctccagccagccagggccctgcccagcttcaatttacagacctgactctcctcaccttcccccctgctgtccagagctgaacatagacttgcacttggatgtcacctggagtgtcacatgggagtgttatggcagcatcataccaaggcctactgttgcacatggggccaaaaccagtaaacagccaccttcttggaaagggaatgcaaaggctttgggggtgatggaaaagaccttttacaaatgataccaattaaactgccctggaaa

SEQ ID NO: 551 - DNA, 2666 bp, Homo sapiens
gatctggaaaccggaagtgaattattttgcaggagtctacacccaggcggtggctatacttattaaagttggcgggagctgagcgatcagtcggtcctgggctggctgtggtgtagggcgttgcaggcagcgctcacctcctcaggccggcagaatgcgggtggctgtggctggctgctgccacggcgagctggataagatctatgagacgctggcgctggcagagcggcgcggcccggggcctgtcgacctcttgctgtgctgcggcgacttccaggcggtgcgcaacgaggcggatctacgctgcatggccgtgccgcccaagtatcgtcacatgcaaaccttctacaggtattactctggagagaaaaaggctccagttctcacgctcttcattgggggaaaccatgaagcctcaaatcatttgcaagagttaccctatggtggctgggtggcaccaaacatttattatttaggtttggctggtgtggtaaaataccgaggtgtaaggatcggtggaatctctggtatctttaaatctcatgactatcgaaaaggtcattttgagtgccccccttataattcatctacaatcaggagtatatatcatgtgagaaatattgaagtctataaattaaaacagctgaagcagcctatagatatattcttgtctcatgattggccaagaagtatatatcattatggaaataagaagcaacttcttaagactaaatcttttttccgacaagaagtggaaaataacacattaggaagtccagctgcctcagagcttttagagcatctcaaacctacttattggttttctgcccaccttcatgtgaagtttgccgccttgatgcagcatcaggcaaaggataaaggacagacagccagagcaaccaaatttttagccttggacaaatgcttaccacatagagattttcttcagatattagagatagaacatgaccccagtgctcctgattacttggaatatgatattgaatggctcactattctcagggctacggatgatcttattaatgtgactgggcgcctgtggaatatgccagaaaataatggcctgcatgcaaggtgggattatagtgcaacagaagaaggtatgaaagaagtattggaaaaattgaatcatgatctcaaggttccatgtaactttagtgtaacagctgcttgttatgatcctagcaagccacagacacaaatgcagctgattcataggatcaatcctcagacaactgaattttgtgcccaacttggcatcatagacatcaatgttaggcttcagaagtccaaggaagaacatcatgtgtgtggtgaatatgaagaacaggatgatgtggagagtaatgactctggagaagaccagagtgaatataatacagacacatctgctctgtcttctattaatccagatgaaataatgttagatgaagaagaagatgaagatagtattgtaagtgcacatagtggcatgaatacaccatcggtagaaccttctgatcaagcttctgagttttctgcaagtttctctgatgtcaggatcttgccaggctctatgattgtatcttctgatgatacggtggattccacaattgatagagaggggaaacctggtgggactgtggagtcagggaatggagaggacttaaccaaggtgccattgaagaggctgagtgatgaacatgaacctgaacaaagaaagaaaattaagaggaggaatcaagccatttacgctgcagtggatgatgatgatgacgatgcagcttaagatgatttacttgttttgtttttgtgtttgttttgtttttttgagatggagtttcactcttgtcacctagactggagtgcaatggcgtgatctcggctcaccgcaacctccgcctcccaggttcaagcaattctcctgcctcagcctcccaagtaggtgggactacaggtgcccgccaccacacccggctaatttttgcatttttagtaatgacagggtttcaccgtgttggccaggctggtctccaactcctgacctcaggcgatccacctgtcttggccttctaaagtgctgggattacaggcgtgagccactgtgcctggccgacaatttacttgtcttagtattatatgtagatatgtgattttttgagactgtatttttagagctgaatttttgactaaagacttaactttataataatgaagatacattagagaattttagttagatattgactttatctttaggcttttgtatgtttcagatgcaaacatattaaagtttcatatatttacttgactgggtatctttttttttgaagacatacattattcacttccatttttacaataaacacttacttaacatctactctgtgccaagcactctgctataatatgggaccataaagatgagtaagacaaggatttttgcctccaaggacttgttatcactgtaaacattttgatgtatacaatatggctatattatattttgttttataaaatcaagtcattgtatatattatgatgtatgctttcttttcatttattataaatatttttcctgatcagcttttaatatctgtcaaataaaaattgaaattgaagatggtatataagatttcaggaaataaactactctgaatactaaa

SEQ ID NO: 552 - DNA, 2189 bp, Homo sapiens
aaagttggcgggagctgagcgatcagtcggtcctgggctggctgtggtgtagggcgttgcaggcagcgctcacctcctcaggccggcagaatgcgggtggctgtggctggctgctgccacggcgagctggataagatctatgagacgctggcgctggcagagcggtgcgcaacgaggcggatctacgctgcatggccgtgccgcccaagtatcgtcacatgcaaaccttctacaggtattactctggagagaaaaaggctccagttctcacgctcttcattgggggaaaccatgaagcctcaaatcatttgcaagagttaccctatggtggctgggtggcaccaaacatttattatttaggtttggctggtgtggtaaaataccgaggtgtaaggatcggtggaatctctggtatctttaaatctcatgactatcgaaaaggtcattttgagtgccccccttataattcatctacaatcaggagtatatatcatgtgagaaatattgaagtctataaattaaaacagctgaagcagcctatagatatattcttgtctcatgattggccaagaagtatatatcattatggaaataagaagcaacttcttaagactaaatcttttttccgacaagaagtggaaaataacacattaggaagtccagctgcctcagagcttttagagcatctcaaacctacttattggttttctgcccaccttcatgtgaagtttgccgccttgatgcagcatcaggcaaaggataaaggacagacagccagagcaaccaaatttttagccttggacaaatgcttaccacatagagattttcttcagatattagagatagaacatgaccccagtgctcctgattacttggaatatgatattgaatggctcactattctcagggctacggatgatcttattaatgtgactgggcgcctgtggaatatgccagaaaataatggcctgcatgcaaggtgggattatagtgcaacagaagaaggtatgaaagaagtattggaaaaattgaatcatgatctcaaggttccatgtaactttagtgtaacagctgcttgttatgatcctagcaagccacagacacaaatgcagctgattcataggatcaatcctcagacaactgaattttgtgcccaacttggcatcatagacatcaatgttaggcttcagaagtccaaggaagaacatcatgtgtgtggtgaatatgaagaacaggatgatgtggagagtaatgactctggagaagaccagagtgaatataatacagacacatctgctctgtcttctattaatccagatgaaataatgttagatgaagaagaagatgaagatagtattgtaagtgcacatagtggcatgaatacaccatcggtagaaccttctgatcaagcttctgagttttctgcaagtttctctgatgtcaggatcttgccaggctctatgattgtatcttctgatgatacggtggattccacaattgatagagaggggaaacctggtgggactgtggagtcagggaatggagaggacttaaccaaggtgccattgaagaggctgagtgatgaacatgaacctgaacaaagaaagaaaattaagaggaggaatcaagccatttacgctgcagtggatgatgatgatgacgatgcagcttaagatgatttacttgttttgtttttgtgtttgttttgtttttttgagatggagtttcactcttgtcacctagactggagtgcaatggcgtgatctcggctcaccgcaacctccgcctcccaggttcaagcaattctcctgcctcagcctcccaagtaggtgggactacaggtgcccgccaccacacccggctaatttttgcatttttagtaatgacagggtttcaccgtgttggccaggctggtctccaactcctgacctcaggcgatccacctgtcttggccttctaaagtgctgggattacaggcgtgagccactgtgcctggccgacaatttacttgtcttagtattatatgtagatatgtgattttttgagactgtatttttagagctgaatttttgactaaagacttaactttataataatgaagatacattagagaattttagttagatattgactttatctttaggcttttgtatgtttcagatgcaaacatattaaagtttcatatattt

SEQ ID NO: 553 - DNA, 2267 bp, Homo sapiens
ggtggctggcggaaacgggaacgtgcagccgcgggtgcaggagtcctggggcatggcgggggcggggcagggggaggcgcgcacagaacaggctggggcatccctcgccctggctctttgagcccggaccagacagagatgtgataatggatcatcatgtttctaccatcaagcctcgaagaatccaaaaccaaaatgtcattcaccgcttggaacgccggcggatcagttcaggcaaggcaggtacccactggcaccaagtccgagtgttccatcagaatgtcttccccaacttcacagttgtcaacgttgaaaagcctccttgtttcttgcgtaaattctcacctgatggacgctactttattgctttttcttcagaccagacatctcttgaaatctatgagtaccagggctgccaggcagcagaggacctactgcagggatacgaaggagaaatcctgtccaatggcaatgaccagcggtcagtgaatatccggggccggctctttgaacgcttttttgtcctgctgcacattaccaatgttgcggccaatggtgagcacctgaaccgggagtgtagtctcttcactgatgactgccgctgtgtcatcgtgggctcagctgcctacctcccagatgagcctcaccctccattttttgaggtatatcggaacagtgaatcagtgacccccaacccacggtcccctctagaagactattccctccatatcattgaccttcacaccggccgcttatgtgatacacgcacgttcaagtgtgacaaggtggtcttgtcacacaaccaagggctgtacttgtacaaaaacatcctggccatcttgtctgtgcaacaacagaccatccatgtcttccaggtgactcctgaaggcactttcattgatgtgcggaccattggccgcttttgctatgaggatgacctgctcactgtgtcagctgttttccctgaggtacagcgggacagtcagacaggcatggccaatccctttagggatcctttcatcaattccctcaaacaccggttgctggtatatttgtggcgccgggcagaacaggatggtagtgcaatggccaagaggcgcttcttccagtattttgaccaactgcggcagctgcgaatgtggaaaatgcagcttctggatgaaaaccacctgtttatcaagtacactagtgaggatgtagtaacactgcgagtcacagatccatcacaggcatctttctttgtggtgtacaatatggtgacgacagaggtgattgctgtgtttgagaatacatcagatgagcttttggagctctttgagaacttctgtgacctttttcgtaatgctaccctgcacagtgaagttcagtttccctgctcagcttctagcaacaattttgcaaggcagatccagcgccggttcaaagacactattataaatgccaagtatggagggcacacagaggcagtacgccggctgctgggtcagctccccatcagtgctcagtcttacagcggtagcccctatctggatttgtctctcttcagttatgatgacaagtgggtatctgtcatggagcggcccaagacttgtggagatcacccaatcaggttctatgcccgggactcgggcctgctcaagtttgagatccaggcggggttattgggccgccccatcaaccacacagtgcgacgccttgttgccttcacctttcacccttttgagcctttcgctatttctgtgcagaggactaatgctgagtatgttgtcaacttccatatgcgacactgctgcacgtaggtgcctcaccagagccagattatctggtcttccaagactttgccactcacttatctcagtggactccaaagcaaaagctcccgactactagctctgttagttccagcctgctatacctcagatgggagagagccagagagaggagtgagggtggctcaacctaatggaatttttaaattgtatacaatactgctactgattgttataatatcctcttgcgttttccctgtgggaatgcccagcattaattaagtccatttcatttttgctttactttgcatttgattgctgtgaagatgaaagcattagacttttatccccttcatgtcacttcttcggcattatggtttgcatctgaaagcagttaaatcttgtttactgatgagaatgacatacatcctttccatttagctcataagcacggctatctttttaagagaaaaataaagccatggtattttcatactt

SEQ ID NO: 554 - DNA, 2154 bp, Homo sapiens
atggtgggacagatactaaaaagagatgtgataatggatcatcatgtttctaccatcaagcctcgaagaatccaaaaccaaaatgtcattcaccgcttggaacgccggcggatcagttcaggcaaggcaggtacccactggcaccaagtccgagtgttccatcagaatgtcttccccaacttcacagttgtcaacgttgaaaagcctccttgtttcttgcgtaaattctcacctgatggacgctactttattgctttttcttcagaccagacatctcttgaaatctatgagtaccagggctgccaggcagcagaggacctactgcagggatacgaaggagaaatcctgtccaatggcaatgaccagcggtcagtgaatatccggggccggctctttgaacgcttttttgtcctgctgcacattaccaatgttgcggccaatggtgagcacctgaaccgggagtgtagtctcttcactgatgactgccgctgtgtcatcgtgggctcagctgcctacctcccagatgagcctcaccctccattttttgaggtatatcggaacagtgaatcagtgacccccaacccacggtcccctctagaagactattccctccatatcattgaccttcacaccggccgcttatgtgatacacgcacgttcaagtgtgacaaggtggtcttgtcacacaaccaagggctgtacttgtacaaaaacatcctggccatcttgtctgtgcaacaacagaccatccatgtcttccaggtgactcctgaaggcactttcattgatgtgcggaccattggccgcttttgctatgaggatgacctgctcactgtgtcagctgttttccctgaggtacagcgggacagtcagacaggcatggccaatccctttagggatcctttcatcaattccctcaaacaccggttgctggtatatttgtggcgccgggcagaacaggatggtagtgcaatggccaagaggcgcttcttccagtattttgaccaactgcggcagctgcgaatgtggaaaatgcagcttctggatgaaaaccacctgtttatcaagtacactagtgaggatgtagtaacactgcgagtcacagatccatcacaggcatctttctttgtggtgtacaatatggtgacgacagaggtgattgctgtgtttgagaatacatcagatgagcttttggagctctttgagaacttctgtgacctttttcgtaatgctaccctgcacagtgaagttcagtttccctgctcagcttctagcaacaattttgcaaggcagatccagcgccggttcaaagacactattataaatgccaagtatggagggcacacagaggcagtacgccggctgctgggtcagctccccatcagtgctcagtcttacagcggtagcccctatctggatttgtctctcttcagttatgatgacaagtgggtatctgtcatggagcggcccaagacttgtggagatcacccaatcaggttctatgcccgggactcgggcctgctcaagtttgagatccaggcggggttattgggccgccccatcaaccacacagtgcgacgccttgttgccttcacctttcacccttttgagcctttcgctatttctgtgcagaggactaatgctgagtatgttgtcaacttccatatgcgacactgctgcacgtaggtgcctcaccagagccagattatctggtcttccaagactttgccactcacttatctcagtggactccaaagcaaaagctcccgactactagctctgttagttccagcctgctatacctcagatgggagagagccagagagaggagtgagggtggctcaacctaatggaatttttaaattgtatacaatactgctactgattgttataatatcctcttgcgttttccctgtgggaatgcccagcattaattaagtccatttcatttttgctttactttgcatttgattgctgtgaagatgaaagcattagacttttatccccttcatgtcacttcttcggcattatggtttgcatctgaaagcagttaaatcttgtttactgatgagaatgacatacatcctttccatttagctcataagcacggctatctttttaagagaaaaataaagccatggtattttcatactt

SEQ ID NO: 555 - DNA, 2315 bp, Homo sapiens
gtgcagccgcgggtgcaggagtcctggggcatggcgggggcggggcagggggaggcgcgcacagaacaggctggggcatccctcgccctggctctttgagcccggaccagacaggtgctgggaatacagcaaggaattagaccagttccctgctctctggtatggtgggacagatactaaaaagagatgtgataatggatcatcatgtttctaccatcaagcctcgaagaatccaaaaccaaaatgtcattcaccgcttggaacgccggcggatcagttcaggcaaggcaggtacccactggcaccaagtccgagtgttccatcagaatgtcttccccaacttcacagttgtcaacgttgaaaagcctccttgtttcttgcgtaaattctcacctgatggacgctactttattgctttttcttcagaccagacatctcttgaaatctatgagtaccagggctgccaggcagcagaggacctactgcagggatacgaaggagaaatcctgtccaatggcaatgaccagcggtcagtgaatatccggggccggctctttgaacgcttttttgtcctgctgcacattaccaatgttgcggccaatggtgagcacctgaaccgggagtgtagtctcttcactgatgactgccgctgtgtcatcgtgggctcagctgcctacctcccagatgagcctcaccctccattttttgaggtatatcggaacagtgaatcagtgacccccaacccacggtcccctctagaagactattccctccatatcattgaccttcacaccggccgcttatgtgatacacgcacgttcaagtgtgacaaggtggtcttgtcacacaaccaagggctgtacttgtacaaaaacatcctggccatcttgtctgtgcaacaacagaccatccatgtcttccaggtgactcctgaaggcactttcattgatgtgcggaccattggccgcttttgctatgaggatgacctgctcactgtgtcagctgttttccctgaggtacagcgggacagtcagacaggcatggccaatccctttagggatcctttcatcaattccctcaaacaccggttgctggtatatttgtggcgccgggcagaacaggatggtagtgcaatggccaagaggcgcttcttccagtattttgaccaactgcggcagctgcgaatgtggaaaatgcagcttctggatgaaaaccacctgtttatcaagtacactagtgaggatgtagtaacactgcgagtcacagatccatcacaggcatctttctttgtggtgtacaatatggtgacgacagaggtgattgctgtgtttgagaatacatcagatgagcttttggagctctttgagaacttctgtgacctttttcgtaatgctaccctgcacagtgaagttcagtttccctgctcagcttctagcaacaattttgcaaggcagatccagcgccggttcaaagacactattataaatgccaagtatggagggcacacagaggcagtacgccggctgctgggtcagctccccatcagtgctcagtcttacagcggtagcccctatctggatttgtctctcttcagttatgatgacaagtgggtatctgtcatggagcggcccaagacttgtggagatcacccaatcaggttctatgcccgggactcgggcctgctcaagtttgagatccaggcggggttattgggccgccccatcaaccacacagtgcgacgccttgttgccttcacctttcacccttttgagcctttcgctatttctgtgcagaggactaatgctgagtatgttgtcaacttccatatgcgacactgctgcacgtaggtgcctcaccagagccagattatctggtcttccaagactttgccactcacttatctcagtggactccaaagcaaaagctcccgactactagctctgttagttccagcctgctatacctcagatgggagagagccagagagaggagtgagggtggctcaacctaatggaatttttaaattgtatacaatactgctactgattgttataatatcctcttgcgttttccctgtgggaatgcccagcattaattaagtccatttcatttttgctttactttgcatttgattgctgtgaagatgaaagcattagacttttatccccttcatgtcacttcttcggcattatggtttgcatctgaaagcagttaaatcttgtttactgatgagaatgacatacatcctttccatttagctcataagcacggctatctttttaagagaaaaataaagccatggtattttcatactt

SEQ ID NO: 556 - DNA, 7200 bp, Homo sapiens
attgccaagatggcgccggtcgcggtggccgcggaggctagagtcggagaaagaggcggaggcagtggcggccgcgaggggagggggagtcccgtctgactgagacggcaggcctgggcgggcgggcgggggtgccgcgaagggcggagcgccgggctggggatgagctaagcgggctcagagcgccgcggcattcagcccctcgtgttccgctaccgcgcgtgcgggattccggcgccgctctccgagctcgatccgctgctcgcacgggagccagctgggtgttatttctcaaactctgaggctgcggagttcacacattgaaatctgtcatctttttcagagagaaactttcgatgtaaccttctgtaatggaagatgattgaagacaaggggcctcgtgttgctgactactttgttgtagcaggattaactgatgtttcaaagcctctagaagaagaaattcacttcaatgatgcttgtcataaagtagctaaaccaaaagaacctattacagatgtttcagttattatcaaatctcttggggaggaagtcccacaggattatatctgtattgatgttaccccaactggattgtcagctgatcttaataatggaagtcttgtggggccacagatttacctttgctatagaagaggaagagataagcctccacttacagatctgggggttttatatgactggaaagaaagattgaaacagggttgtgaaattattcagagtactccctatgggcgccccgcaaatattagtgggagtacctcatcacaaagaatttatatcacttaccgaagagcctctgaaaacatgactcagaatacgttggctgtcactgacatatgtattattatacccagtaaaggagaaagcccaccacacacgttctgcaaagtcgacaagaatctcaataacagtatgtggggatcagcagtatacttgtgttataaaaaatcggtggcaaagacgaacactgtatcttacaaagctggcctaatttgtagatatcctcaagaagattatgagtcattctcactaccggaatctgttcctctattttgtttaccaatgggtgcaaccattgaatgttggccatcaaatagcaaataccctctgcctgtattttctacttttgttttaactggagcctcagctgaaaaggtttatggtgctgctattcagttttatgaaccatactctgaggagaatctcacagaaaagcagagacttcttttgggtttaacatcagcagatgggaagtctgatagttccaaaacaattcatactaacaaatgcatctgtcttctttctcactggcctttttttgatgcattcaggaagtttctgacttttctgtatcgttattccatctctgggcctcatgtccttccaattgagaagcatatttctcattttatgcataaagttccttttccatctcctcagagaccacggattttagttcagttatcaccacatgataatctgattctcagtcagcctgtgtcttcacctcttccactaagtggtggcaagttttcaacactactgcagaatttaggccctgaaaatgctgtgacactactggtgtttgcagtaacagaacataaaattcttatccattccctacggccatccgtgcttactagtgtgacagaagcattagtgtctatgattttccctttccactggccatgcccgtatgttcctctctgcccactggctttagcagatgtcttgagtgcaccatgtccattcatagtagggattgattcaagatactttgatctctatgatcctccaccagatgtcagttgtgttgatgtagataccaacactatttctcaaattggtgacaagaaaaatgtagcctggaagatacttccaaagaagccatgtaaaaatctgatgaacacactgaataatttgcatcagcaattggcaaaattgcagcagagaccgagagatgatggactcatggatttagcaataaatgactatgattttaattctggaaagaggttgcacatgatagatttggaaatccaagaggcatttttgtttttcatggcctctattttaaaaggttacagatcatacttaaggccaataacacaagccccatctgagacagccacagatgcagcctctctctttgccctacaagctttcttaagaagccgggaccggtcacatcaaaaattctataacatgatgaccaaaacacaaatgtttattcgcttcattgaagaatgttcttttgttagtgacaaagatgcaagcctggcattttttgatgattgtgtagataaagtggatatggacaagagcggtgaagtacgacttatagaactggatgaatctttcaaaagtgaacacactgtttttgtaacaccacctgagatcccccacctacccaatggtgaagaaccccctttacagtacagctataatggatttccagttcttaggaacaatttatttgaaagacctgaaggatttctacaagcaaagaagaacaaattgccttcaaaatcaagtagtcctaatagccctttgcccatgttcagaagaacaaaacaggaaattaaatcagcccataaaattgcaaagaggtactcttccatccctcagatgtggtctaggtgtctactgcgccactgttatggactgtggtttatttgtctcccagcttatgtgaaagtctgtcattcaaaagtcagggctctgaaaacagcatatgatgtgcttaaaaaaatgcagtcaaagaagatggatccacctgatgaggtatgctaccgcattcttatgcaactctgtggacaatatgatcagccagtgcttgcagttcgagtgctttttgaaatgcagaaagctggtattgaccccaatgccattacttatggttattataataaggctgttttggaaagtacctggccttcaagaagtcgtagtggctattttctttggacaaaagtaagaaatgttgttttaggagtaacacagttcaaaagagctttaaagaagcatgcacacttatcacaaacaactctctcaggtggccagtctgatcttggatataattcattatctaaagatgaagttagaagaggggatacatctactgaagacattcaagaagaaaaagataaaaaagggagtgattgtagttccttgtcagagagtgagagtacaaaaggaagtgctgattgccttcctaagctcagttatcaaaattcttccagtatcgttcgcctcactggtacaagtaacaacagtgctggtaaaatatcaggagaaagcatggaaagcacacctgagctgctcttaatatcatctcttgaagatacaaatgaaacacgaaacattcaaagtagatgcttcaggaaaagacataaaagtgacaatgaaactaatttgcagcagcaagtggtctggggaaatagaaaccgtaatcttagtggaggggtactgatgggatttatgctcaatagaattaaccaggaagcaacccctggagatatagttgaaaaattgggagctgatgcaaaaattctttcaaatgttatctcaaaaagcacgagaccaaatactcttgatattgggaagccacctttaagatcaaaaagagacagtctagaaaaggaatctagtgatgatgatacaccttttgatggttctaactatttggcagataaagtggattctcctgttatttttgacttagaagacttagacagtgaaacagatgtatcaaaagcaggatgtgttgctacacaaaatcccaagaggattcaacgtatgaacagcagcttttcagtaaaaccttttgaaaaaactgatgtcgcaacaggatttgatcccctctctcttttggttgctgagactgaacagcagcaaaaagaagaagaggaggaggatgaagatgatagcaaaagcatttcaacaccatctgctaggcgtgatttagctgaagaaattgtgatgtatatgaataacatgagcagtcctttgacaagtcgtacaccaagcattgatttacaacgggcatgtgatgataaattaaataagaaaagtccaccattggtcaaggcatgcagaagatctagtctgcctcctaattctcctaagccagtgagacttaccaaatctaaaagttacacaaaaagtgaggagaaaccaagggatagactttggtcttctccagccttctcacctacttgcccatttagggaagaatctcaggatacattaacccactcatcaccttcatttaacttagatacactactagtacctaaactagatgttctaagaaacagtatgttcactgctggaaaaggagttgcagagaaagcaagcaaatggtattcaagattcaccatgtacaccacatcatctaaggatcaaagttctgatcgtaccagtctttcttcagtgggagcccaggattctgaatctacctctttaacagatgaagatgtctgccatgagttggaaggacctatctcctctcaagagaccagtgctacttcagggactaagagaattgatctcagccgaataagcctggaaagttctgcatccttggaaggatctctgtcgaagtttgccttacctgggaaatcagaagtgacatcttccttcaacgcgagtaatacaaatatcttccagaactatgcaatggaggttctcatctcaagttgctctcggtgtagaacttgtgattgtcttgtccatgatgaggaaatcatggctggctggacagcagatgattcaaatctcaatactacatgcccattctgtggcaatatcttcttaccctttctgaatatagaaataagagatttaagacgacctggaagatactttctaaagtcaagcccatcaacagaaaatatgcactttccatcctccatttcaagtcagacgaggcagtcttgcatttcaacatcagcctctggtcttgacacatctgctctctctgttcaagggaattttgatctaaatagcaaatctaaactgcaggaaaatttttgcacccgaagtattcagatccctgctaatagatcaaaaacagctatgtctaaatgtccaatatttccaatggccaggagtattagtacttctggccccttggataaggaagatactggaagacagaagctcatttctacaggcagcctgccagctactttacaaggagctacagattctttaggtttagaatggcaccttccaagtcccgatcctgtcactgttccgtatcttagtcctttagtggtatggaaagaacttgaaagcttattggaaaatgaaggtgatcatgcaataacagtagcagactttgtggaccatcatccaattgttttttggaacctggtatggtatttcagacgtcttgacttgcccagtaacttacctggattgattctttcttctgagcactgtaacaagtattcaaagattccccgccactgtatgtctgaagatagcaaatatgttttaatacaaatgttatgggacaatatgaagttacatcaggatccgggacagcccttgtacattctctggaatgcacacacccaaaaatatccaatggtccatttattgcaaaaaagtgataactcatttaaccaggaactgttgaaaagtatggtaaaaagcattaaaatgaatgatgtctatggaccaatgagtcagattttagagacactgaataagtgtccacattttaaaagacagaggagtttatacagagaaatactatttctctcacttgtggcactgggaagagaaaacattgatatagatgcttttgataaagagtacaagatggcatacgatcgtctcacacctagtcaagtcaagagtacacacaactgtgatagaccaccaagtacaggggtgatggaatgtcgaaaaacctttggagaaccttatctttaagatgtatttgtatgtgtaaacattcaatgtatattgtatagtcagtgtataaaataacacttttagactctaaatattttttcttcaatttttgaaaatacaatttgtaaatggttcaaaagactcagacagcttatgtacagaatgtttgaagaagagaatagtgacaagtggggagaaagccactttgtttctcatttcttttttcttcttctttaactcccctgtaataggaaataaagtatttttgtgatgaggaaatccctaaacaaaattagttgccataaaatatgacaactgctttatggtttcttttggaagagacagattgaaaaatcatgaatggaatctaaacagaaatgtcagatgaacgtatttcctgttttcatagactattcaaatgttttgaccatgaagttgtattatacatattttaaattgtttatagtaagttgatatttttttaatttttaaatttaatatagcaaacttaaaatgaatttaaacttaagcaagcaagcgtgtattttccttgtctgctgctatttgaagtaattagtacagctgcagatctctctgtgtatatctatctatatatatattttttattacttgggagaatgaattttaaaatgtcagtgctagtgtcaagtgttgtcctaggattgcatgttagtacccctaagcctgagtgtggggagtgagttatgcaagggtagcgtgcactgcccagactgactcatggagccttgtgcaaggagagccagagaggttcactataccatgactccaaaattgtctctattgctaatagatacgtatagtatacagggaaaacagcttataaatccaaatatcaatttaaattttaatattctacatgaaaacttacattgggaaatatgcagacaagtgattatattccaaattttacccttattttaatatctaaaatattgggtatgatgcaaattatactatagaatatttatctgaaatatgacttactggggtattctgttaatactatatataaatattcagaatttttttcaaaagtagaaaaattcccctctaaaagtacagccagatagattttcatccatattgaggaacttagctttttcaacaagcttcagaatctgaagtctgtagaatctaaaatacagaaatatccagaaatcagacaataaattgaaagtttagacatcatgagtattaaatagcttt

SEQ ID NO: 557 - DNA, 7336 bp, Homo sapiens
attgccaagatggcgccggtcgcggtggccgcggaggctagagtcggagaaagaggcggaggcagtggcggccgcgaggggagggggagtcccgtctgactgagacggcaggcctgggcgggcgggcgggggtgccgcgaagggcggagcgccgggctggggatgagctaagcgggctcagagcgccgcggcattcagcccctcgtgttccgctaccgcgcgtgcgggattccggcgccgctctccgagctcgatccgctgctcgcacgggagccagctgggtgttatttctcaaactctgaggctgcggagttcacacattgaaatctgtcatctttttcagagagaaactttcggtaatgtatgtaaccttctgtaatggaagatgattgaagacaaggggcctcgtgttgctgactactttgttgtagcaggattaactgatgtttcaaagcctctagaagaagaaattcacttcaatgatgcttgtcataaagtagctaaaccaaaagaacctattacagatgtttcagttattatcaaatctcttggggaggaagtcccacaggattatatctgtattgatgttaccccaactggattgtcagctgatcttaataatggaagtcttgtggggccacagatttacctttgctatagaagaggaagagataagcctccacttacagatctgggggttttatatgactggaaagaaagattgaaacagggttgtgaaattattcagagtactccctatgggcgccccgcaaatattagtgggagtacctcatcacaaagaatttatatcacttaccgaagagcctctgaaaacatgactcagaatacgttggctgtcactgacatatgtattattatacccagtaaaggagaaagcccaccacacacgttctgcaaagtcgacaagaatctcaataacagtatgtggggatcagcagtatacttgtgttataaaaaatcggtggcaaagacgaacactgtatcttacaaagctggcctaatttgtagatatcctcaagaagattatgagtcattctcactaccggaatctgttcctctattttgtttaccaatgggtgcaaccattgaatgttggccatcaaatagcaaataccctctgcctgtattttctacttttgttttaactggagcctcagctgaaaaggtttatggtgctgctattcagttttatgaaccatactctgaggagaatctcacagaaaagcagagacttcttttgggtttaacatcagcagatgggaagtctgatagttccaaaacaattcatactaacaaatgcatctgtcttctttctcactggcctttttttgatgcattcaggaagtttctgacttttctgtatcgttattccatctctgggcctcatgtccttccaattgagaagcatatttctcattttatgcataaagttccttttccatctcctcagagaccacggattttagttcagttatcaccacatgataatctgattctcagtcagcctgtgtcttcacctcttccactaagtggtggcaagttttcaacactactgcagaatttaggccctgaaaatgctgtgacactactggtgtttgcagtaacagaacataaaattcttatccattccctacggccatccgtgcttactagtgtgacagaagcattagtgtctatgattttccctttccactggccatgcccgtatgttcctctctgcccactggctttagcagatgtcttgagtgcaccatgtccattcatagtagggattgattcaagatactttgatctctatgatcctccaccagatgtcagttgtgttgatgtagataccaacactatttctcaaattggtgacaagaaaaatgtagcctggaagatacttccaaagaagccatgtaaaaatctgatgaacacactgaataatttgcatcagcaattggcaaaattgcagcagagaccgagagatgatggactcatggatttagcaataaatgactatgattttaattctggaaagaggttgcacatgatagatttggaaatccaagaggcatttttgtttttcatggcctctattttaaaaggttacagatcatacttaaggccaataacacaagccccatctgagacagccacagatgcagcctctctctttgccctacaagctttcttaagaagccgggaccggtcacatcaaaaattctataacatgatgaccaaaacacaaatgtttattcgcttcattgaagaatgttcttttgttagtgacaaagatgcaagcctggcattttttgatgattgtgtagataaagtggatatggacaagagcggtgaagtacgacttatagaactggatgaatctttcaaaagtgaacacactgtttttgtaacaccacctgagatcccccacctacccaatggtgaagaaccccctttacagtacagctataatggatttccagttcttaggaacaatttatttgaaagacctgaaggatttctacaagcaaagaagaacaaattgccttcaaaatcaagtagtcctaatagccctttgcccatgttcagaagaacaaaacaggaaattaaatcagcccataaaattgcaaagaggtactcttccatccctcagatgtggtctaggtgtctactgcgccactgttatggactgtggtttatttgtctcccagcttatgtgaaagtctgtcattcaaaagtcagggctctgaaaacagcatatgatgtgcttaaaaaaatgcagtcaaagaagatggatccacctgatgaggtatgctaccgcattcttatgcaactctgtggacaatatgatcagccagtgcttgcagttcgagtgctttttgaaatgcagaaagctggtattgaccccaatgccattacttatggttattataataaggctgttttggaaagtacctggccttcaagaagtcgtagtggctattttctttggacaaaagtaagaaatgttgttttaggagtaacacagttcaaaagagctttaaagaagcatgcacacttatcacaaacaactctctcagatggcagtgacctggatgctgttagtcatggcagcatggatagtggtcatgggacacacactgtggagcaggcaccttttaatacgggtttaatcaaagtatatgctactgatgatagatctagtacaggtggccagtctgatcttggatataattcattatctaaagatgaagttagaagaggggatacatctactgaagacattcaagaagaaaaagataaaaaagggagtgattgtagttccttgtcagagagtgagagtacaaaaggaagtgctgattgccttcctaagctcagttatcaaaattcttccagtatcgttcgcctcactggtacaagtaacaacagtgctggtaaaatatcaggagaaagcatggaaagcacacctgagctgctcttaatatcatctcttgaagatacaaatgaaacacgaaacattcaaagtagatgcttcaggaaaagacataaaagtgacaatgaaactaatttgcagcagcaagtggtctggggaaatagaaaccgtaatcttagtggaggggtactgatgggatttatgctcaatagaattaaccaggaagcaacccctggagatatagttgaaaaattgggagctgatgcaaaaattctttcaaatgttatctcaaaaagcacgagaccaaatactcttgatattgggaagccacctttaagatcaaaaagagacagtctagaaaaggaatctagtgatgatgatacaccttttgatggttctaactatttggcagataaagtggattctcctgttatttttgacttagaagacttagacagtgaaacagatgtatcaaaagcaggatgtgttgctacacaaaatcccaagaggattcaacgtatgaacagcagcttttcagtaaaaccttttgaaaaaactgatgtcgcaacaggatttgatcccctctctcttttggttgctgagactgaacagcagcaaaaagaagaagaggaggaggatgaagatgatagcaaaagcatttcaacaccatctgctaggcgtgatttagctgaagaaattgtgatgtatatgaataacatgagcagtcctttgacaagtcgtacaccaagcattgatttacaacgggcatgtgatgataaattaaataagaaaagtccaccattggtcaaggcatgcagaagatctagtctgcctcctaattctcctaagccagtgagacttaccaaatctaaaagttacacaaaaagtgaggagaaaccaagggatagactttggtcttctccagccttctcacctacttgcccatttagggaagaatctcaggatacattaacccactcatcaccttcatttaacttagatacactactagtacctaaactagatgttctaagaaacagtatgttcactgctggaaaaggagttgcagagaaagcaagcaaatggtattcaagattcaccatgtacaccacatcatctaaggatcaaagttctgatcgtaccagtctttcttcagtgggagcccaggattctgaatctacctctttaacagatgaagatgtctgccatgagttggaaggacctatctcctctcaagagaccagtgctacttcagggactaagagaattgatctcagccgaataagcctggaaagttctgcatccttggaaggatctctgtcgaagtttgccttacctgggaaatcagaagtgacatcttccttcaacgcgagtaatacaaatatcttccagaactatgcaatggaggttctcatctcaagttgctctcggtgtagaacttgtgattgtcttgtccatgatgaggaaatcatggctggctggacagcagatgattcaaatctcaatactacatgcccattctgtggcaatatcttcttaccctttctgaatatagaaataagagatttaagacgacctggaagatactttctaaagtcaagcccatcaacagaaaatatgcactttccatcctccatttcaagtcagacgaggcagtcttgcatttcaacatcagcctctggtcttgacacatctgctctctctgttcaagggaattttgatctaaatagcaaatctaaactgcaggaaaatttttgcacccgaagtattcagatccctgctaatagatcaaaaacagctatgtctaaatgtccaatatttccaatggccaggagtattagtacttctggccccttggataaggaagatactggaagacagaagctcatttctacaggcagcctgccagctactttacaaggagctacagattctttaggtttagaatggcaccttccaagtcccgatcctgtcactgttccgtatcttagtcctttagtggtatggaaagaacttgaaagcttattggaaaatgaaggtgatcatgcaataacagtagcagactttgtggaccatcatccaattgttttttggaacctggtatggtatttcagacgtcttgacttgcccagtaacttacctggattgattctttcttctgagcactgtaacaagtattcaaagattccccgccactgtatgtctgaagatagcaaatatgttttaatacaaatgttatgggacaatatgaagttacatcaggatccgggacagcccttgtacattctctggaatgcacacacccaaaaatatccaatggtccatttattgcaaaaaagtgataactcatttaaccaggaactgttgaaaagtatggtaaaaagcattaaaatgaatgatgtctatggaccaatgagtcagattttagagacactgaataagtgtccacattttaaaagacagaggagtttatacagagaaatactatttctctcacttgtggcactgggaagagaaaacattgatatagatgcttttgataaagagtacaagatggcatacgatcgtctcacacctagtcaagtcaagagtacacacaactgtgatagaccaccaagtacaggggtgatggaatgtcgaaaaacctttggagaaccttatctttaagatgtatttgtatgtgtaaacattcaatgtatattgtatagtcagtgtataaaataacacttttagactctaaatattttttcttcaatttttgaaaatacaatttgtaaatggttcaaaagactcagacagcttatgtacagaatgtttgaagaagagaatagtgacaagtggggagaaagccactttgtttctcatttcttttttcttcttctttaactcccctgtaataggaaataaagtatttttgtgatgaggaaatccctaaacaaaattagttgccataaaatatgacaactgctttatggtttcttttggaagagacagattgaaaaatcatgaatggaatctaaacagaaatgtcagatgaacgtatttcctgttttcatagactattcaaatgttttgaccatgaagttgtattatacatattttaaattgtttatagtaagttgatatttttttaatttttaaatttaatatagcaaacttaaaatgaatttaaacttaagcaagcaagcgtgtattttccttgtctgctgctatttgaagtaattagtacagctgcagatctctctgtgtatatctatctatatatatattttttattacttgggagaatgaattttaaaatgtcagtgctagtgtcaagtgttgtcctaggattgcatgttagtacccctaagcctgagtgtggggagtgagttatgcaagggtagcgtgcactgcccagactgactcatggagccttgtgcaaggagagccagagaggttcactataccatgactccaaaattgtctctattgctaatagatacgtatagtatacagggaaaacagcttataaatccaaatatcaatttaaattttaatattctacatgaaaacttacattgggaaatatgcagacaagtgattatattccaaattttacccttattttaatatctaaaatattgggtatgatgcaaattatactatagaatatttatctgaaatatgacttactggggtattctgttaatactatatataaatattcagaatttttttcaaaagtagaaaaattcccctctaaaagtacagccagatagattttcatccatattgaggaacttagctttttcaacaagcttcagaatctgaagtctgtagaatctaaaatacagaaatatccagaaatcagacaataaattgaaagtttagacatcatgagtattaaatagcttt

SEQ ID NO: 558 - DNA, 99 bp, Homo sapiens
atcatcaaatacctactattgtacagttttttgtgtgtgctgataaaatgtcaggattcttttaagatatattgttttccttgttatcctttttataat

SEQ ID NO: 559 - DNA, 1290 bp, Homo sapiens
agtgacgtcacggcgccactttccggccggtgacagagtccagcggagttgtgggggccgggggcgccatgggagccactggcgacgccgagcagccgcggggacctagcggggccgagaggggcggcttggagctgggggatgcgggcgcagcggggcagctggttcttacgaacccttggaacataatgataaagcaccggcaggtgcagcggaggggccgccgctcacagatgacaacaagtttcacagatcctgccatctccatggatctcctccgagctgtcctgcagcccagcatcaacgaggagatccagactgtcttcaacaagtacatgaagttcttccagaaggcagcactgaacgtgcgagacaatgttggggaggaggtggacgcagagcagctgatccaggaagcctgtcggagctgcctggagcaggctaaactgctcttttcagatggagaaaaagtaatacccagattgacccatgagcttccaggaataaagcgtggccgtcaggcagaagaagaatgtgcccatcgaggaagcccccttcctaaaaagaggaaaggacggcctcctggacacatcctgtcaagcgaccgggcagccgccggcatggtatggaaaccaaaatcctgtgaaccaattcgccgggaaggccccaagtgggacccagctcgcctgaatgaatctaccacctttgtgttgggatctcgagccaacaaagccctggggatggggggcaccagaggaagaatctacatcaagcacccacacctctttaagtatgcagctgacccccaggataagcactggctggctgagcagcatcacatgcgggcaacagggggcaagatggcctacctcctcatcgaggaggacatccgggaccttgcggccagtgatgattacagaggatgcctggatctgaagctagaggaattgaaatcctttgtcctaccctcctggatggtggagaagatgagaaagtatatggagacactacggacagagaatgagcatcgtgctgttgaagcacctccacagacctgaggccgggtcccctggccacacttggcagccctcctccaaagccctcttcctcacgtggctgaggccaccgctgggactgctcctagatggatctcagcggcattaagctgtgcctgagcgagtttgtagtgactcactgcacagcacccccagactagcatgtggttctatatttgtaaagttattgggataagaaacaattaaacagtttgtagtaaacacagatggtgaa

SEQ ID NO: 560 - DNA, 4363 bp, Homo sapiens
gcatttccggagcgccagggaagagggaagtcgtggtggtcgcgagggagccggaaagatggtggttaccagatctgcacgggctaaggccagcatccaagccgcgtcggctgaaagttccgggcaaaagagttttgctgctaatgggattcaagcgcatccagaaagtagtactggatctgatgcccgaactactgctgaatcacagaccactgggaagcaaagtttaatccctagaactcctaaagctagaaagaggaagagcagaactacaggctcactaccaaaggggactgaaccatctacggatggagaaacctctgaggcagagtcaaattattctgtgtctgagcaccatgataccattttaagggtaactaggagaaggcagatcttaattgcatgctccccagtgtccagtgttaggaaaaagccgaaagtaactccaacaaaggagtcttacactgaagaaatagtgtctgaagcagaatctcatgtttcaggtatttctagaattgtgcttcctacagaaaaaactacaggagccagaagaagtaaggctaaatctctgacagatccaagccaagaatctcatacagaagctatatctgatgctgagacatcaagctcagacatttcattctctggaattgcaactagaagaaccaggagtatgcagaggaaattaaaggcacaaactgaaaagaaagatagtaagattgtaccaggaaatgagaaacagatcgtgggtacacctgtgaattcagaggattcagataccagacaaacttcccatttacaagcaagatctctttctgagataaataagccaaatttctataataatgactttgatgatgatttctcccacagaagttcagaaaatatattaacagtgcacgaacaggccaatgttgaatctcttaaagaaacaaaacagaattgtaaggatttggatgaagatgccaatggaataacagatgaggggaaagaaattaatgagaaaagttctcagctgaagaatctttctgaacttcaggacactagccttcaacagttagtttctcagagacattcaaccccccaaaataaaaatgctgtatcagtgcactctaatctgaactctgaggctgtaatgaaatcattaactcaaacatttgcaactgtggaagtaggcagatggaataacaacaaaaagagccccataaaagcaagtgacttgacaaagtttggtgattgtggtggtagtgatgatgaagaagagtccacagttataagtgtcagtgaagacatgaacagtgaagggaatgtagattttgaatgtgataccaaactatacacgtctgcgcccaacacatctcagggtaaagataattctgtcttactagttctcagcagtgatgaaagccaacagtctgaaaacagtgagaatgaagaggatactttatgttttgttgaaaatagtggccaaagggagtcattaagtggagacacaggaagtctgtcatgtgacaatgcattgtttgtaattgacacaactcctggaatgagtgctgataaaaatttttacttggaagaggaagacaaggcaagtgaggttgccattgaggaagaaaaagaagaggaagaggatgaaaaaagtgaagaagattcatcagaccatgacgaaaatgaagatgagtttagtgatgaagaagacttcctaaatagcacaaaggctaaacttctgaagttgacaagcagcagcatagaccctggtctgagtatcaagcagttgggtggtttgtatattaattttaatgcagataaactacagtctaacaagagaaccctaacacagatcaaggagaaaaagaaaaatgagcttctgcagaaagccgtcattacacctgattttgaaaaaaaccactgtgttccaccatatagtgaatcaaagtatcaacttcagaaaaaacgcagaaaagaacgacaaaaaacagcaggggatggctggtttggtatgaaagctccagaaatgacaaatgaactgaaaaatgatctcaaagcactgaagatgagagccagcatggacccgaaaagattttacaagaaaaatgatagagatggcttccccaagtacttccagattggaaccattgttgacaatccagctgatttctaccattcacgaattcccaagaagcaaaggaaaagaactattgtggaagaactgctggctgattctgaattcagaagatacaaccgaaggaagtactcagagatcatggctgaaaaagcagcaaatgcagcaggaaaaaagttccgaaagaagaagaaatttcgcaattaagatttaccaagcaaactgcaacattttacattgctcctttatttacttattaaagacgtttggaaaactaacaccatcatctaaattaatttaccatagactggccctgttcatacaggaatttgtatttggaaaaagttgatttgagaatcgattacatgcccttagaaaataggggtgtctaaaagacccaccctggtgtagactctttatgggaaaaaaggaaaaaaaatctcaaccattttaagataactgatggtttgtaaagttttcaatgcttagttatttaaagaaaatttaattaaaagataggaagtataaagtttgctaacatgttcaaagaactttaaaaaatgatcaaagatatataaacattattgtaattaataggtagttttatgtgtgtatgtgtgtgtgtgtctgtgtaggggacgggagatggtagagaggcaatgccctatagttagctataaaattcagatccagaaagttgggatacaaagatatgaagaatatgacctagaaagcttgggcagaggagctgttttccttgcttggcaactgaaacagggaggaataattggtttttatctagatttaagtgttgtggtccaagtaaaacaggattaaactataatttaagttggccagggtttcttcgaagttaacccagcttacctcttctccagtggtacagtatgcaccctggctaagctggtttctggcacccaaggagtgttggtcatttctgttgatacttggtgagttgtagcttcctttatgttactattcactttacctctatttttccagcatactgcttccttgagatatcagcaaatatgaaatcttttttttttttaataatagttttggggtacatgtgtagaacatgcaggttacataggtatacacgtgccatggtggtttgctgcacccatcaacctatctacattaggtatttctcctagtgctatccctcccctagtcccccacccacaacaggccccagtgtgtgatgttcccctccctgtgtccatgtgttctcattgtttacctcccacttacgagtaagaacatgcagtgtttggttttctgttcttgtgttagttttctgttcttgctgagatgatttccagcttcagccatgtccctgcaaaggacatgaactcatgcttttttatggccacatagtattccatggtgtatatgtgccacattttctttatccagtctatcattcatgggcatttgggttggttccaagtcttttctattgtgaacagtgccacagtaaacatacttgtgtatgtgtctttatagtagaatgatttataatcctttgggtatatacccagtaatgggattgctgggtcaaatggtatttctggtcctagatccttgcggaatcaccacactgtcttccacaatggttgaactagtttacactcccaccaacagtgtaaaagtgttcctagttctccatatcctctccagcatctgttgtttcctgactttttaatgattgccattctaactggcaatgagatggtatctcattgtggttttgatttgcatttctctaatgagcagtgataatgagcgttttttcatgtttgttggctgcataaatgtcttcttttgagaagtgtctgttcatatccttcacccactttttgatggggttttttcttgtaaatttgtttaagttctttgtagattctggatattagccctttgtcagatggatagattacagaaattttctcccattctgtagattgcctgtgcactctgataatagtttcttttgctgtgcagaaactctttagtttaattagatcccacttgtcaattttgccttttgttgccattgcttttggtgttttagtcatgcagtctgcccatacctatgtccaaaatctcatatttactgcttggagtcaaaagctagtaatagcagaactgacaataacattcatagttggagttagggaagcatctatgtctgttctcttttattttaaaaaaaaa

SEQ ID NO: 561 - DNA, 2806 bp, Homo sapiens
atcgttccaagtccgccgccgtcccgggtggcctttcctccctgcctggctccgcgcgctccagccctgcgggaggcggcggcgagaagctgcggctctgggtgcggtgcggggcgcccgggcgacaggcgggcgcaaggcgggcgcgcagcagaccggttggcgccgcactatgctccccagcgcggtcgcagcccacgccggtgcgtactgggacgttgtggcttcctccgcgctcctcaacctccccgctgcgcccggctttggcaacctgggcaagagtttcctgatcgagaatttgctgcgggtcgggggcgccccaacgcccaggctgcagccgcccgcgccccacgacccggcgaccgccctggccaccgcgggcgcgcagctccggcccctgcctgctagcccagttcccctaaagctgtgccccgcagccgaacaagttagccccgccggggcgccctacggaacgcggtgggcttttcaagtgctcagtccctctgcggacagtgcgaggctgccgggccgggctccgggggaccgagactgtaccttccagccttcagcgccagcaccttccaaacctttccttctgagcaccccgccattctactcggcgtgctgcggtgggtcctgtcggcgccctgcatcctccactgcttttccaagagaagagagcatgctgcctctcctgacacaggactctaattccaaagctcggaggggcattttaagaagagctgtcttttctgaggaccagagaaaggctctggagaaaatgtttcagaaacagaaatatatcagcaaaacagaccgaaagaaacttgccatcaacttgggactaaaggaatcacaggtgaaaatttggtttcagaacaggaggatgaaatggcggaattccaaagaaaaggaagtgctttccaacaggtgtatccaagaagtaggtcttcaagaggatcccctctcacggtctgctctgggtttcccttctccatgtccttcaatatgggacgtcccccaacagcactcaagtccaagatggagggagaattctccagaaccttcagaaagactaatccaggagagttcaggggcaccacccccagaagcaaattcactgcaaggtgccttatatttatgttctgaagaagaagctggaagcaagggtgtacttactggggctgtctgaatggaagcattcctccgtgttcatttaaaagaacgcttaatagtaacatctggactctaatgccagctagcttgtacctcatcagtgcttagagcctaacaactttggagcgatgtatgaactaatgctttaggaaacccactctagtgttctcttgtttggccctagactcaggcttaatttgtaagtggaatagaatctcccagcaagtatgacagaactgaaaagaaggagagcaacagctggctcggtccctgctctgagtatgtgtatatatgtgtttgtctctatgtgtgtgtatatacataaatatccattaaaatgtattagtagaaactagtttctctttaactattgcattgagtaaattcacttccttttatgtgaagaaaactaccattgacagaatgttattaactttttgaaaataatgtaaaatttggactttagtgcaaactttcataccccaaaaacatgtttttaaaaattctctattttctgacttcttttggtatccagctgtaagtgaattttaacaccttagctcagcagtcctcaacaaatgagccactgctagatacatacactgagaatatatatttaaaatgaacctaacaagcaaattagaagaatttctgtatataactattagtatccttaatctccaagtctctggaccatcgggccatcatgagggagagacccatttaactaataattattttttgatctcttctctgtaaagatgggcctagaccagggtttgcaaaataaaatgcctttaagagcctgtcaggtaaatagagggtatggcccacccagagatatttgagtcaagtaatttttcaaatactgtattggccaaacaaaatgtctatgccaagaagtttgtgacctctggctaagactaaagaaagccgtggtgtcacagttcttaaaatttttctaactggacttaaaaccacaatactaacagaatcaatgatgatttctgtttgcgcttctagttagggactcaattttccacttaggtggcatacactttatatatcaggttatttttatgtattaacaaacaccacacagatgttttgtgttttttgactaccctgaaattgtatctttctaaaattgcatttctggtaacgatttgctgagttaatccagaagtttttactccaggaccaagaagaaattatgtttcactttgaaggaaatgaaacaaaaataggaaatgatgtggttttgcattaaactcttatcaatctgtggacaagaaacactatcagaagttcattaagtggcattttgttagtgagtaagctgcataatgatggtggcttctaatttgctgaactccactagagtctgagaagttaacgtcttttgagggtttagtgtttagaaaagatatttcaggagataacggttttaatcaacagcaggaaattattttgtacgaatagaattggacttggtatgtcaacctgtgtctttaccacatgatcttttacttaaaagtcattttagaagtgtgtctcagtgcctcattgtggggaatgggagcagggatctgctgacaaaagttaaaatttaaaacctgtcttaaaatga

SEQ ID NO: 562 - DNA, 2880 bp, Homo sapiens
aggcggatgccgccatgcagcactacggggtgaacggctactcactgcacgccatgaactcactcagcgccatgtacaacctgcaccagcaggcagcccagcaggcccagcatgcccccgactaccggccttcagtgcatgcgcttacattggctgagcgcctggctgacatcatcttggaggcccgttatggttcccagcaccgcaaacaacgtcgcagccgcacagcgttcacggctcagcagctcgaggccctggaaaagaccttccagaagactcactacccagatgtggtgatgcgtgagaggctggccatgtgcaccaacctgcctgaggcccgggtgcaggtgtggttcaagaaccgccgggccaagttccggaagaagcagcgtagcctgcagaaggaacagctccagaagcagaaggaggctgagggctcccatggggaaggcaaggccgaggcccccactccagatacccagctggacactgagcagcccccacgtctgcctggcagcgacccccctgctgagcttcacctgagtctgtctgagcagtcagccagtgagtcagcccccgaggatcagccggaccgtgaggaggaccccagggcaggggctgaggaccccaaagctgagaagagccctggggctgacagcaaggggctgggctgcaagaggggcagccccaaggcagattccccaggcagcctgaccatcactcctgtggccccagggggtggcctcctgggcccctcccactcctattcctcgtccccgctgagcctcttccgtctgcaggagcaattccgccagcacatggcggccaccaacaacctggtgcactactcgtccttcgaagtagggggtccggcccctgctgctgcagcggcggctgctgctgtgccctacctgggcgtcaacatggccccgctgggctcactgcactgccagtcctactaccagtccctgtcagcagccgctgctgcccaccagggtgtgtgggggtctcctctgctgcctgcacccccagcaggcctggctcctgcatcagctaccctgaacagtaaaaccacaagcatcgagaacctgcggctccgggccaagcagcacgcggcctccctgggactcgatacgctgcccaactgactgtctggcttccaacccagccaggggtcttaggtgtcccctcctagccctgtggttatccctaggtggctctcgaggagttaactccatgagcccagggatcctagggcctggggtcctgttccctgctccgcttccccataccccagcccgaggtgaagcccacacctacacaccctctgcatggccctgcctggaccccatggaggccgaatagggaggaggtgagaggctggggtgccccaagcttccctcggagaagtgagaggctctccctggctagatcctcatctcaatagcacctcctcccttttctccctatccttctgccccctagtaagtctacgtgtggaatgtgagatataaatataaatatataaagctatattttcaggctcctgcctgccccaggccccctgccccactcccatctcttcttccctgccacccctccctgcagcctccgcggctcactccagccatcccttctgtttctccttctctctccttccttcttcccttgatctccctcttcctgtctctgtcctggtccctgcccccgtctcggcccagcctctgtattctccacccttgatctttctccttgtctctcccgctgcccctggtttcttcctttggtgttggctgtgttggtatcatcagttcttgagctatattttgtttggggttgtggctggttttggttttagtaattttgcgacttcccgttgctctccttctattcccttccttctgccctgcctgcctccctgcacctgcggcctctctaggaagctgttcctttctatgcccaatagaagcaacaaggccctagctggagactctggggatctggagctgcaggcaggaggtggcactggctcccactcccacccctgcccaggctggcatctagaaggcgtcatgaattactttctcttctctcttctcaattttgaggtcctcattcccaagattgaggaggcagtagttaatctgggaaggcagtagaatggccagcattcctgcctgtaagtcttcccaagacagaggcccggtgacacagttcagccaggactgaccacagggctctagagctctctttggtgagacttccctggatggagagcagcagcaggggaagaggtgctctcagagacagcagggctggtgctcttctcccacaagctgagcctccacgttcagcagatactgtccaaggcaggggtacggctgaccaggaatgaaggttgaactctgctcctgagcacggtgcgtgcaaagcatatagcagcacataggctcaggcttctgtaggcttcctgtcccagagccaattatggaagtaagggcttccctccagctagtcactggaatggaaaagtgtgttcctgttcatagccaggaaacccagctcagcaaactccctttcaaagctgtgtgaccggctgggcatggtggctcacacctgtaatcccagcactttgggaggccaaggcaggcaatcacctgaggtcaggagttcaagaccagcctggctaacatgtgaaactaataataatacaaaaattagctgggcgtggtggcacatgcctgtaatcccagctacttgggaggctgagttgggaggattgctgcaatctgggaggtggaagttgcagtgagccgagatcatgccactgcactccagcctgggcgacggagtgagactccatctcaaaaaaaaaaaaaa

SEQ ID NO: 563 - DNA, 2882 bp, Homo sapiens
taggcggatgccgccatgcagcactacggggtgaacggctactcactgcacgccatgaactcactcagcgccatgtacaacctgcaccagcaggcagcccagcaggcccagcatgcccccgactaccggccttcagtgcatgcgcttacattggctgagcgcctggctggctgtacatttcaagacatcatcttggaggcccgttatggttcccagcaccgcaaacaacgtcgcagccgcacagcgttcacggctcagcagctcgaggccctggaaaagaccttccagaagactcactacccagatgtggtgatgcgtgagaggctggccatgtgcaccaacctgcctgaggcccgggtgcaggtgtggttcaagaaccgccgggccaagttccggaagaagcagcgtagcctgcagaaggaacagctccagaagcagaaggaggctgagggctcccatggggaaggcaaggccgaggcccccactccagatacccagctggacactgagcagcccccacgtctgcctggcagcgacccccctgctgagcttcacctgagtctgtctgagcagtcagccagtgagtcagcccccgaggatcagccggaccgtgaggaggaccccagggcaggggctgaggaccccaaagctgagaagagccctggggctgacagcaaggggctgggctgcaagaggggcagccccaaggcagattccccaggcagcctgaccatcactcctgtggccccagggggtggcctcctgggcccctcccactcctattcctcgtccccgctgagcctcttccgtctgcaggagcaattccgccagcacatggcggccaccaacaacctggtgcactactcgtccttcgaagtagggggtccggcccctgctgctgcagcggcggctgctgctgtgccctacctgggcgtcaacatggccccgctgggctcactgcactgccagtcctactaccagtccctgtcagcagccgctgctgcccaccagggtgtgtgggggtctcctctgctgcctgcacccccagcaggcctggctcctgcatcagctaccctgaacagtaaaaccacaagcatcgagaacctgcggctccgggccaagcagcacgcggcctccctgggactcgatacgctgcccaactgactgtctggcttccaacccagccaggggtcttaggtgtcccctcctagccctgtggttatccctaggtggctctcgaggagttaactccatgagcccagggatcctagggcctggggtcctgttccctgctccgcttccccataccccagcccgaggtgaagcccacacctacacaccctctgcatggccctgcctggaccccatggaggccgaatagggaggaggtgagaggctggggtgccccaagcttccctcggagaagtgagaggctctccctggctagatcctcatctcaatagcacctcctcccttttctccctatccttctgccccctagtaagtctacgtgtggaatgtgagatataaatataaatatataaagctatattttcaggctcctgcctgccccaggccccctgccccactcccatctcttcttccctgccacccctccctgcagcctccgcggctcactccagccatcccttctgtttctccttctctctccttccttcttcccttgatctccctcttcctgtctctgtcctggtccctgcccccgtctcggcccagcctctgtattctccacccttgatctttctccttgtctctcccgctgcccctggtttcttcctttggtgttggctgtgttggtatcatcagttcttgagctatattttgtttggggttgtggctggttttggttttagtaattttgcgacttcccgttgctctccttctattcccttccttctgccctgcctgcctccctgcacctgcggcctctctaggaagctgttcctttctatgcccaatagaagcaacaaggccctagctggagactctggggatctggagctgcaggcaggaggtggcactggctcccactcccacccctgcccaggctggcatctagaaggcgtcatgaattactttctcttctctcttctcaattttgaggtcctcattcccaagattgaggaggcagtagttaatctgggaaggcagtagaatggccagcattcctgcctgtaagtcttcccaagacagaggcccggtgacacagttcagccaggactgaccacagggctctagagctctctttggtgagacttccctggatggagagcagcagcaggggaagaggtgctctcagagacagcagggctggtgctcttctcccacaagctgagcctccacgttcagcagatactgtccaaggcaggggtacggctgaccaggaatgaaggttgaactctgctcctgagcacggtgcgtgcaaagcatatagcagcacataggctcaggcttctgtaggcttcctgtcccagagccaattatggaagtaagggcttccctccagctagtcactggaatggaaaagtgtgttcctgttcatagccaggaaacccagctcagcaaactccctttcaaagctgtgtgaccggctgggcatggtggctcacacctgtaatcccagcactttgggaggccaaggcaggcaatcacctgaggtcaggagttcaagaccagcctggctaacatgtgaaactaataataatacaaaaattagctgggcgtggtggcacatgcctgtaatcccagctacttgggaggctgagttgggaggattgctgcaatctgggaggtggaagttgcagtgagccgagatcatgccactgcactccagcctgggcgacggagtgagactccatctc

SEQ ID NO: 564 - DNA, 5392 bp, Homo sapiens
cctgtgacgcgcctgctgggcccgagctttttcctgggatagcgatggagacgccgggcgcatcagcgtcgtccttgttgcttcccgccgcgtccaggcccccgaggaagcgcgaggcgggagaggctggggctgcgacgagcaagcagcgggtcctggacgaggaagagtatatcgagggcctccagacggtcatccaaagggatttctttcctgatgtggagaagctccaggcacagaaggagtacctggaagccgaggagaatggagacttggaacggatgcgccagattgccatcaagtttggctctgccttgggcaagatgtcccgggagcccccgccaccctatgtgactccagccacatttgaaacccctgaggtgcatgcaggcactggagtggtgggcaacaagcccaggccccgcggccgaggcctggaggatggagaggctggagaggaggaggagaaggagccgctgcccagcctagatgtcttcctgagccgctacacgagtgaggacaatgcctccttccaggagatcatggaggtggccaaggagagaagccgggcacgccacgcttggctctaccaggctgaggaagagtttgagaagaggcagaaagataatctcgaactcccgtcagcagagcaccaggccatcgagagcagccaggccagtgtggagacctggaagtacaaggccaagaattccctcatgtactatccagagggtgtccctgacgaggagcagctgtttaagaagccccggcaggtggtacataagaacacgcgcttccttagggaccccttcagccaagccctgagcaggtgccagctccagcaggcagccgccctcaatgcccagcacaaacagggcaaggtgggccccgatggcaaggagctgatcccccaggagtcccctcgagtgggtggatttggatttgttgccactccttcccctgcccctggtgtgaacgagtccccgatgatgacctggggggaggttgagaacacacccttgagagttgaagggtcggaaacgccctacgtggacaggacacccggcccagcttttaagatcctggagccaggccgcagggagcggctgggtctgaagatggccaacgaggccgctgccaagaaccgggccaagaagcaggaagccttgcggagagtgacggagaatctggccagcctcacccccaaaggcctgagcccagccatgtcgccagccctacagcgccttgtgagcaggacggccagcaagtacacagaccgggccctgcgggccagctacacaccatccccagcacgctccacccacctcaagaccccggccagtgggctgcagacccccacaagcacaccggcgcctggctctgccacacgcacccctctcacacaggacccggcctccatcacggacaacctgctgcagctccctgcccggcgcaaagcttcggacttcttttagagccaggcctgggctgggctcatagacgcttcacagagcctgcagggcagctgtacacccagcagaggactccagccttctcggggcccaggcctgggccagaagctgttgaccataccaggagtcactggagaaaggggctgtgctggggccagactggcacaaggcactcgtgcccacaccacaccccagggccttgccaagctgtttgctgtttaattggccccttgaactgtcattaaagaacacctaggtacagtctggggggttgcctctccatcttgctccccacacgagccctagccttgccctggggcctgcatcacgtctcaggactgcggggcttgaagcgaggggccccccaggtgaggaagctgcaggtggggcggctgtgggagcaccgggtgactggcgttgctttctgcggcactcggaacctgtgttctgagttgagctcacatcctgcagtgctttctgcttctctggggggatatgaaggagaaacggagcccttggaagttgtacccttaggttcccctgcggttctgggcccaggtctgcagcctccactctgggcttgccggctgtgaggtgcgctggttataggactgtgtgggggctgcatatcaggtgatctcagctatcaccttctcccagcacctggcttccagctcatggggtgggactatcccactcacccctctgctataggcactgcccatcttatgctgctggccctggcctcacctggtcacttccaccaacaggagctcccagataacagtgggttgctggacagatcaggctgggactcttaaggggtgggggacgtggggccttcagtgctttatcccctaggaaagggtgcacgttatcccaagggagcccccaggaagtggggagggaggggggaggagcatgtctaggtgctgaccacctggagcacttggccagcaagtgggccgcatgctttgggagcaatgggtgacccagcaggaagcacaaaagaccggccagtgtgccatcatcaagggctgctgagcagcttgaagagccactgggtggggagggcacacggggaggtctcagctggggctgcccctggaggacagggcagggaacttgagggctgaggacagaaatctcacatgactccaggaaatagaggaagaggaggatgctgagcgagggattgtgagggagtgggggtaggtcagagggggctgaactgcaggaagccagggggagtcgtggaccactggagctggccagccccagggcattggggacaaggccaggtcagagggagacagtgtgggcctggtgggtggaccctggcagaggccctcttgtcccccacaaggccaggccacactgtgattctgcctgtacctgagcatctgtcctgtgctcctaggccggagaccactgtgtgtcaggtggggcggttggctgagtcccagagaaaaacactcctcactgggcactcttgatgcttgcacacaccctgtggtttatttggtggtcagtaaggaacgtctttgctgctaagtggaagaaagctaatggaacgtaatcaaaatagtggtttaattgacgaattttacttgcacctgtgccttcttcagatcctacctgcctacttagtttacgtgaaggccgactgcaccatgccccccaaccccgacccccaccacacacaacggggccattgtcatgctaggtgcttgctttccccacctcagctccggagatgtgatggtctttggccctggaggtctcggccagcctgtcctccatcctgttctcgttctcgggcaccaccagcagccggtgctgggttttggctccaagcttgtggtcgggccggtggtcgggcctcaagcctgtcttggtgtccagtttgcactcagcgcggtacttgccctccccctccctcttgaaggaggcagaagacgtggctttgggcttggggggctgcagccacgagtggctgaggatctcatcgatgtggagccgctggctgacgtcgggctgcagcatgcggtagatgaggtccttgcactcgcaggtcaggttcttggagcgcgggaagtccacacggtgctccttctggatacgcagcatcttcctgatgtcggagtcgtcatagggcatggagccgcagaccatgatgtacaggatcacgcccaggctccagatgtcatacaccttgggctggtaggggatgctctgcagcacctcgggggctgcatatgctgccgacccgcagaaggtcttgctgaggatgatgcgcccattgctgtcccgcaggcagcgcttggagaagccaaagtcagacagcttgatgttgaagtccttgtcgaggagaaggttctcgcacttgaggtcccggtggacgatgtccaggtcgtggcagtacttgacggcggaggagagctgtcggaacatcttgcgtgccacgtcctcatgcagggctccctggcacttgatgaactcgaggaggtcgccctggacgccaagctccatgatgatgtagatccgtccgtcagaggtctcaaagatctcgtaagtcttgatgatggagccgtggttgacagttgccaggatgtccatctcccgaggaaggaatctctccacaaagtcagtaggtgttttcttgcggtcgatgatcttgacagccacattgaacttgaggcgctcagagtaggcagatttgacttttgcgtaggaacccttgccaagattgatgcctacgatgtaacccttcttccttaggactgtggcatcgtccatggtgccaggagcgactggcgccgctgccgtctacatccccccgtcatgtgggccagcaggcattgtcctcatttacactaccggaggcgtctggctgggctgccctgggctgggcttcgactcaggggtggaacactcagcattgtctccgggtgacttcagccaatgaactcataaagccaaggagtgggggcggggactgggctgagggagaacagggtctctggaaccgtggaagccaggctggtctggcaggagcacccactccccgcccgctggaaggaagcctgtccccaggacaggactctggtggccctgctgctgctgcattggtttccctgtcacaagtcaagctggaggggaggcggcccacgtccagcctgtttgcatcacctggctgtggggactgaccctgcattggtctttgtcccactagggtgggtttcctgcagcttctttggctatgaagaaaagcacccccagggctgtgtccttggtgtggtaggacagttgtccctgacagtcacccagacaggcctgcatagcaccccagttacacagacagatttccacagcactgccttaccattgagcacatagttaaatctagggaaatcagtgcccagacatcaaagctagaaatgaaacatggtcagcaggagccttgcatgggcttctcttttgctggagcaagccaaaataataggaacggttttacattcctagtgccaggacccatctcgggtcgacaaaatctgaagacaagttaagggaacaggcagctgtttgaatagatcaattggatagtctaaggcagctctctggaccaagctgtaaaggagatacaatcgaaataatcactccggtaccacagtagacaggccttgaaggcactgggccccttttaatcggacttagcaagcattttttttgcctctgaccttctccttggaacaaaattagttaccagtagacttaggtgattgctgtactgcatgtaggcacataaccccaacctatataaacagtaagaaaattgtagcactttgagttggtctgctggaattatctccagccttctccctgtatccagttacagtgataaactcccttctttccta

SEQ ID NO: 565 - DNA, 2895 bp, Homo sapiens
actgctctacatggagctttttagctccacttcctcagcagtttcacctcaagatcctgttccttcctcttaccccactaaggctgctgttgctgtctgcacaggtactgatagtggtgccattccgggaagctgctttgcgggtggtgcagctcttcatcagcctcctcgagggtgacagcaagaagaaaatcattgtgagcaacaaaaagaggtttcagggagaatatggatcagatcccgaggagagaccacccaacttgaagaggcctgaggattatgaagccgtatttgtgggcaatattgatgaccacttcaggattggagtggcaatacttcagagaagcatccgactctatgccccgttttactcctcggatatcctcattgcttcccccctgggcttgaggaccatcattggtggagaaggagagaagaagagagattttgactttctgtcttctatcgagcttctcatcattgatcaagctgacatttacctgatgcagaactgggagcatgtcctgcatttgatgaatcacatgaacctactacccctggactcacatggggtagacttttctcgagtgcggatgtggagcctcaataattggtccaagtactatcgccagacactgctatttggggcccttcaggatgcccagatcaactcagtgttcaacaagtactgtgtcaacatgcaaggccaggtgggttctcgtcttgtttcctcagtatcttcatgagcactgtttattgtttgggtcctgaggtagaaggaggcgatagcttctggtcaagaaggggatggctgtccacctaacgctcttgttgactactggcaggtggccgtgaggaatgtcccaatgacaggctctatcagtcatgtcctggtgcagctcccacatgtcttccagaggatggaagctgaaaacctagcttcagtgattgatgccaggtaacccactcctcccagcaggcccctggggaccacatagagagatttgacttgggcatacaaacctagaattggattccattttgcttttattgataactaccaaatcagttgagataattgaacttaattatgtcatttgtcagaggaggaaactgaagcacagagagaaatagtgactttggcctaggtctcataactagttagtagcagggttattactataaatcaggactctttcactcttgactgtggcattttaaaattatacagctttatgctacaaagtgtctcatgtcagcaagttaattgtaagcccctcagggaaagaactatttttctaattgtataatttccccctttttcttcattgtgtttagttaggggaccccaaagaagcttagtgaggcttagtatatggtagatgttcagtgattatttgttgactgttggactgagtgactgagtgactgactgactgactgaatagtgtggtgtgtacttcctagagtaattctctgggatataatggtattacatctgttttttacaatgaatagtgttgacacttatttttttagtgtgcttatcaagttttatccttacataatctctttgagaggaggtaaatcatattggcctctggggaggtaatcttttaacacgagattgtaatttgctcagggtcacacagttaagagacaccataagcttagctctagacattaattttgccctttgccattccaaatcaggtttaacttttttgtgaacaagattttgccacagtatcgtgatgcagtcatgtctcacacgctcatctatatcccctcctactttgacttcgtgcgtcttcgaaattacttcaagaaggaggaattgaattttacccacatctgcgagtacacgcagaagtctggtgtctccagggccagacacttcttccttcaaggagagaaacagtttctacttttcacagagcgcttccatttctacaaaaggtaaagtggtgccaggtttcaagcctcctctctgaaggggaggtgcaggacaaatcatggcctgctctgaatgcatggcaggcttcgtggtgttgagatcatccctcactctcgcactcttacaaagtagccagagagtttttggtttggacagactcttcttggttggttagttggttttctcccaaaatgggcattgctgaagaaggatgtagaaaccaaagcataccctgtctatagacctggcatgtagctgtggttatacactgcaagaaggacattacaggacaactcaaatgaatacaaggaaggggagggaccttccctgtattcacttgagttgtccctgtctagactttttccctctgtttgccctcagtgcacagacaaaagcattgagaactgtgttttctggggagatggaggctgagtacagtgtcagtttccagacagttgcggtgttcctgaggtatgcacagatactccctaccaaggagaactaggaccgtgggctccttgacatttgcaggaggtaaaagggtaagggcttcaagttgaatgttgaagggtttcagcgtttgcttagatttcctaccaggtgactttgacaaaataagttgattggtcttcatgttatttttttaaaaactcaggccaggtgcagtggctcacacctgtaatcccagcactttgggaggccaaggcaggcgaatcacctgtggtcaggagttcaagaccatcccggctaacatggtgaaaccccgtttctactaaaaatataaaaaattagttgagcgtggtggtgtgtgcctataatcccagctactcgggaggctgaggcaggagaatagcttgaacccgggaggcagaggttgcagttagctgagatcgtgccattgcactccagcttgggcaacaagagcgaaactccatctc

SEQ ID NO: 566 - DNA, 3094 bp, Homo sapiens
caacttcctggtggaaaaccgcgactcttgcaagtgggcaaacttgacgttttcgctatgggcaaacgcgggagccggagccagagccagctactcaacaccctaactaaaaagcagaagaaacatcttcgagatttcggcgaggagcatcccttctatgacagggtttccagaaaggaagcaaagccacagatttgtcaactgtcagagagttcagattcttcagattctgaaagcgactcagagagtgaaccacaacaagtttctggctaccacagactacttgctacattaaagaatgtttctgaggaagaagaggaagatgaggaggaggaagaggaagaagacagtattgtagatgatgcagaaatgaacgatgaagatggtggtagcgatgtcagtgtggaagaagagatggctgcagagtctactgaaagtccagagaatgtagctttatctgctgaccctgagggaaaagaagatggggaagagccaccgggcacatcacaaacatcccccgaagagttcacagatgcaaaacacgagtcactgttcagcctggaaaccaattttctggaagaggaaagtggagacaactcttctttgaaagcctctcaagatccatttcttcaacatgtgaacaaagaactgaaagaaaaagcaattcaggctgttgccacaaatcccaaaactacccacgagcttaaatggcctattctgggccagcttttcttttcctctaagtttcagaagttggaaacatttaaacccccaaaggatattgacttaaagtcacttcatctccagaagcctctggaatccacctggactaagaccaacagccagttcctatctggtccccaaaaatcaagcagcccattcacccccctccagaaagaactcttcttaattatgaattcttaccgggacctgttctacccggaaaggactgctctgaagaacggggaagagatccgccatgtgtattgcctgcatgtgataaatcacatcctcaaagccaatgcccaggtgcttggcaacaatagcagacgccgaagccagaagtttggagtgggtgatgatgatgacttcagagaccaagggttaacaaggcccaaggtactgatagtggtgccattccgggaagctgctttgcgggtggtgcagctcttcatcagcctcctcgagggtgacagcaagaagaaaatcattgtgagcaacaaaaagaggtttcagggagaatatggatcagatcccgaggagagaccacccaacttgaagaggcctgaggattatgaagccgtatttgtgggcaatattgatgaccacttcaggattggagtggcaatacttcagagaagcatccgactctatgccccgttttactcctcggatatcctcattgcttcccccctgggcttgaggaccatcattggtggagaaggagagaagaagagagattttgactttctgtcttctatcgagcttctcatcattgatcaagctgacatttacctgatgcagaactgggagcatgtcctgcatttgatgaatcacatgaacctactacccctggactcacatggggtagacttttctcgagtgcggatgtggagcctcaataattggtccaagtactatcgccagacactgctatttggggcccttcaggatgcccagatcaactcagtgttcaacaagtactgtgtcaacatgcaaggccaggtggccgtgaggaatgtcccaatgacaggctctatcagtcatgtcctggtgcagctcccacatgtcttccagaggatggaagctgaaaacctagcttcagtgattgatgccaggtttaacttttttgtgaacaagattttgccacagtatcgtgatgcagtcatgtctcacacgctcatctatatcccctcctactttgacttcgtgcgtcttcgaaattacttcaagaaggaggaattgaattttacccacatctgcgagtacacgcagaagtctggtgtctccagggccagacacttcttccttcaaggagagaaacagtttctacttttcacagagcgcttccatttctacaaaaggtatacaataaaaggcatcaggaacctgattttctatgaactgccgacatatccacacttttacagtgaaatctgtaatatgctgagagccaccaacagaggagaagaggccacgtggacctgcactgttctctactccaaatatgatgcccagaggttagctgccgtggttggtgtggagcgggcggcacagatgctacagtccaacaagaatgtccacctcttcattactggagaaaaatgaaattttgttgggcaggaagtggtatttggcatgatacataatgtttgattctatgccatttggacccaattctgattacttacagaagaaggactgatacaaagaaagtgcatgaggcaatgtcagtattatctgacatctttcttttcaggtcatgtgtccctgaaaagttaaatgtaaaccagattttggtaaatcccatctttcagaagtgaagagggggctagaaggactctgagaagttggtagaagaaaactcccacttgtgaatatttttgtgagacataaattcttttattacgatttacctctaatttattacacttagtaaattcttccagatttttctatttgtttgacacttccttaaagtaaggaatacacattgcttgcgagaactggttatgagacattggaatacttcttgctgctacatgtcatcttaattttggatggcatgggttttgtaaaacttattctgccccagccaaacttttttgaaaccttaaatagtctaccttaattcagcctagaagagtacattgatttactgatcttttttcatattcataatactaaatgttttagttttgttcaaatatatgcttaaaatcacgttatttaaaaaacacatcagctctgtctcaagaagtaattttgttgaaactccatgttaaaatatccatcttcaacagtagtgtcttcataataactagtcattttttcagtcataaacagatgcaaataaaaaggaaattacactttt

SEQ ID NO: 567 - DNA, 2859 bp, Homo sapiens
gctcagagcgtacgggagggggcggacccttgcccctccggcgcttgggccagagtggtgcgggcggcgcgtggcggcgatccccacgtggtggctttctcacgctagccctctttggtcctccttgacgtcccgggcctgtgggcccgctttctgccgagatgccgaaggtcaagtcgggggccatcggccgccgccgcgggcggcaggagcagcgccgggagctgaagagcgctggaggactcatgttcaacacggggattgggcagcacattttgaaaaatcctctcattattaacagcattatcgataaggctgccttaagaccaactgatgtagtgctggaagttggacctggaactggcaacatgactgtaaagttgttagaaaaggcaaaaaaggttgttgcttgtgaacttgacccaaggctagtagctgaacttcacaaaagagttcagggcacgcctgtggccagcaaacttcaagtactggtgggtgatgtgctgaaaacagatttgccattctttgatacttgtgtggcaaatttgccttatcagatctcttcaccttttgtcttcaagctgttgctacatcgaccttttttcaggtgtgctatacttatgtttcaaagagaatttgccctccgactggttgcaaaacctggagataagttatactgcagactctcaattaatacacagctgttggcacgtgtggaccatctaatgaaagtgggaaagaataacttcagaccaccgcccaaggtggaatccagtgttgtaaggatagaacctaagaatccaccaccacccatcaattttcaggaatgggatggtctagtaaggataacctttgttaggaaaaacaagacactctctgctgcatttaaatcaagtgcagtgcaacaactcttggaaaaaaactacagaattcactgttcagtccataatattataataccagaagatttcagcatagcagataaaatacagcaaatcctaaccagcacaggttttagtgacaaacgggcccgttccatggacatagatgacttcatcagattgctacatggattcaacgcagaaggtattcatttttcctaggtatttggaaaacagaaattttcaaggtcaagaaaagaaatgaattttgtattttttgtatttgagaagataatgcttttgctttactgagacattatttacttgactatttttggttcaatactactactgttgtcaccatttatgattctgaattttaaagttggaaagttctaagtatcaaagtttttaatatataatgctggtccaatctattcataataatcttcaagttcaggagccgcagagacgcacaactttacacttatcatttctaacagtttattgtataaagatgttactcttctatttactgttatatactgtaaggccttctttaggcctttagctctgttcctccagtaataaaaaagttaaaatatgcttcactagtcacacattccccataccatttcgtgttattcacattccccgtaccatttcttgttattcacatgtacagtaaaacaattgtttcttaaattatttttattttggttctctcattctcttccctatttatcctatacagtgtctgttacgattgcctacctctttcgctatcctatagcgtcagagacttagggttctgggtaagcccaagtctgctactgccaccgtgcagtgccaggcatattaaagggcatgactcccaacatgtaaaatgaggaagctaaactggaatgaaattaacaataaaattatctttttttatggttcttagggagataactataggcttagcaaaatttcagagggttttgtaattgaaactggtttcaacttcagaaaaacagccatttcccataactacaggttcccagtattcctatgatttctggacaattaaaatttccagttcctttttcatatacctggtgcttagttttaagctattttaaaactgtcagactgagaatttcaatagatgtcataaactagttttattagctactatgtttaagtcaatataatactaagtgctgttaatatactataatagagttatagtagctattttgtttctataaaaaattaataaaaatatctttattgatatttggctttttttaatacctaacttaatagaagagtgtttccaattaatttaacaaagccagattttgaaatctggcttcaaagtcatagtaaatgttactacataattaaaataatgcttgttcttaatgtataatccagaacaaaggcatcaagctgcttttgttaaacaaatatgaaataatatacattaagagtagatttttttgtttaatttcacaaaactattttgcagagttcacttgtatcatctctatccttatagtaaaaattttaagatttaactcggctttctcaggttatttccctctacccctatgaactgctgagttttagttccttttctggccttcagttttcactatctgtaaagctgaaggactgtattatattacctccagtatcttttctggtactaatttttaaaatacctgatcagaatgaagccatcatagtgtaaggcagcatatttgtctataaggagactttccaaagacagtacccatccaatgcaaataataaatttgaagctaatcatctgttgtgctttaaaatgagcaaattcacatgtctttattgccctttgaaagttggttaatctcaaaaactaccttttttttaaatatcctttgcaaggtcaattgtaacagttctccatccttcctcttccctttgaaataaacacaaatagaatata

SEQ ID NO: 568 - DNA, 7293 bp, Homo sapiens
tccgcgctcgtgcccgcgcgggtgcgttgctgtcctggccgcgcccctgtcccgccgcctcccgctcctcgcctggcggatgtaggttgttggcctgaggggagctacgtagccgaggtttgcgctgccgccgccaggcccggtccggttccagcctctgcccggacgctagccggcctggccatggctgaccgcgggtgcccgctggaggcggcgccgctgcctgccgaggtgcgggagagcctggctgagctggagctggagctgtcggaaggtgacatcactcaaaaaggatatgaaaagaaaagggcaaagctgcttgcacgttatataccgcttattcaaggaatagacccatctctgcaagcagagaatagaattcctgggccctcacaaaccacggccgctgcacccaagcagcagaagtctcggcccaccgcctcgagggatgagcgcttccggtcagatgtccacactgaagccgtgcaagcagctttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacatagcagatctgcattctgcccctcctgatgtcaccacgggcctcgtggagcattcgtactttgagcgtccacaggtggcttctgtgagaagtgttcctcgggggtgcagcgggagcatgctggaaacagcagatggtgtccctgtgaacagcagagtgtcctccaaaatccagcagcttctgaacaccctgaagaggccaaagcgccctccactgaaggagttctttgtggatgattttgaggaattgttggaagttcagcaaccagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggatcgctgtgttctctgtgaccgtgctgcacgacgaccggattgtcctggtggctgagcagcggccggatgcctcggaggaggacagcttccagtggatgagccgtgtgctgcaggccattgatagcatccaccaggtgggcgtgtactgtctggccctggttcctgccaacaccttgcccaaggctcctctcggagggattcacatttctgaaaccaaacagcgctttctggaagggacgctgcacccgtgtaatgtgctgatgtgccctcacacctgtgttaccaacctccccaaacctcgtcagaaacaaccagaggttggaccagcctcaatgatcgtggggaacctggttgctgggaagagaatcgctcaggcttccgggagagagctcgcccacctggaggacagcgaccaggcacggaagttcctgttcctggctgacgtgctgcagtggcgtgcccacaccactcctgaccacccgctgttcttgctgctgaacgccaagggcaccgtcacaagcactgcaacctgtgtccagctgcacaaaagggctgagagagtggccgcggctctgatggagaagggaagactgagtgttggggaccatgtggctctggtctacccaccaggggtggacctcattgccgcgttctatggctgcttgtactgtggctgcgtgcctgtcaccgtgcggcccccgcaccctcagaacctcggcaccacactgcccaccgtcaagatgatcgtggaggtcagcaagtctgcatgcgtcctcaccacgcaggctgtcacacggctgctcaggtccaaggaggctgctgctgccgtggacatcaggacctggcccaccatcctagacacagatgacatcccaaaaaagaagatagcaagcgttttcaggcccccctcccccgatgtcctcgcatacttggacttcagcgtgtcaaccactgggatattagcgggagtgaagatgtcgcacgcggccacaagcgccttatgccgctccataaagctgcagtgtgagctgtacccctcgcggcagatcgccatctgcctcgacccctactgtggccttggttttgccctgtggtgtctgtgcagtgtctactcgggacaccaatcagtgctggtgcccccgctggagctggagagcaacgtgtccctgtggctgtcggccgtcagccagtacaaggcccgcgtcaccttctgctcctactctgtgatggagatgtgcaccaagggcctaggcgcacagacgggtgtcctcaggatgaagggggtgaacctgtcatgtgtgcgcacgtgcatggtggtcgccgaggagcggcccaggattgcgctgacccagtccttctccaagctcttcaaggacctgggcctgccggcccgcgccgtaagcaccacgttcgggtgcagggtcaacgtggccatctgcctccagggcacagctggcccggaccccacaaccgtctacgtggacatgcgggcactgcgccatgacagggttcgtttggtagaacggggttctccgcacagcctgccattgatggagtctggaaagatcctccccggcgtgaaggtcatcatcgcacacaccgagaccaaaggacccttgggagactcacacctgggagagatctgggtaagcagcccccacaatgccaccgggtactacaccgtttacggggaggaggcgcttcatgccgaccacttcagtgcccggctgagttttggagacacacagaccatctgggcaaggaccggctaccttggcttccttcggcgaacagagctcactgatgccagtggagggcggcacgatgcactgtatgtggttgggtctctggatgaaactctggagctcagaggcatgcggtaccaccccatcgacattgagacctctgtcatccgagcacacaggagcatcgctgagtgtgccgtattcacctggaccaacctgctggtggtggtggtggagctggatgggctagagcaggatgccctggacctggtggccctggtgaccaacgtggtgctggaggagcactacctggtcgtgggagtggtggtcatcgtggacccaggggtgatccctatcaactctcggggtgagaagcagcgcatgcacctgcgggacggcttcctggctgaccagctggaccccatctatgtcgcctacaacatgtgagcgcagcacaccggcccaggtgccggagatgaatgagccccagcagtccaaggtgtgatgtgggaagacaccgcagagctcactcaccgggactcgcccttcctgtgctcttacagatccctctcaacaatccccgcatctccttttagaaagcacttcctgaattatttaaagaaatattttgaatctgccaagtacatttacaaaaacacggatgctggtattttaacagatggagagacaaggaaaggaaaggaaaggcctggcatgggcattgtgaggaatcacaggcaccgaggttgttctctgctgtactgcaagtttgcactttctttaggctaaaaatatagttcctgatttttaaaattcagttatttattcccacttcaaatgacaagttcatatatagaatttacgggagaaacttgagaccatttacggggagaaacttgattctgggaagatagcagagtacaaaccagctgcctcacttctgtttcacagggaggctgatggaaaaaggaagcaagctggacccatcctccctgctcacagagggcactgtggtcacacacagtgcctcctctgccagttcctttattgaaagaggtgtgctggctggccacggtggcttacacctgtaatcccagcactttgggaggccgaggcgagcagatcacgaggtcaggagaccgagaccatcctggctaacatggtgaaaccctgtctctactaaaaatacaaaaaattagccgggtgtggtggtgggcgcctgtagtcccagctacttgggaggctgaggcaggagaatggtatgaaccagggaggcggagcttgcagtgagccgagatcacgctactgcactccagcctgggtgacagcacgagatgccgtcttaaaaaaacaaaaaagaggtgtgctgcttgtcagcatgtattgtcacggacactcaataagtgccattttggactgtcaaatttagatgctttgtttcagaaagataagccagcatttagttttaaatcactttcctggtttgtaacttgatgctgtttagttaaattgctagttttcctaacactacaatattaattcttctcgtggaagtgtactgatttattatttttattccaagtcagcagatttggaagcattgtggtaaagtctaaggttttcatatccatagtgctgtttggtgagtaccggcagtacagttgaggggagcagggaacagcattgccccgtattgaaggtggagatggttacattcttcactgctttttgcattttgagttgtgtgcctataaaatttggccaaaccattttattattttgttcaaacttgactaagctgagtgatctaaaattatacagaacctaaatcaaagaagagaatgtaaagtcctttagttacttctaagaatttgaagtcaagcacgaatctaagacatagattatttttatatagctaatgaagagtatgttacgaaattgttgggtttttggggtattgagggtggcaaattttgtgaatcatgcatgcttcacagaaacaaccaggtttttccagaattagtctggatcagtgcctaacaaagctgttattaattctccacacatgagtctggctaactgggccagctctcatgttttactcctgtctggctacaaatagcactgtgcatagtagccctgtttccccatggtgttggactgtggtaaagtatgttgtgacatactggaattctaataatcctgttgtaagtatgtacagaatctatgtaacttattgttgacatacagaggtttgggaagtagtctaatggacattccttacaatagaatggctgggaagggaaagaaaaaaaaaaaaaaactacctaactccaatcttaatgttgtagttttatagcaaacaaaaattgtcagctttttgtattgaaaggtcagtggtggtaagacaaggtgtcttgtaaattaagattttaagaagtgcattaaaatgttttagaattactctgggaattctgtatatcacactaaaatttttatatcattatgttaataaaagttattgactttgtaattctgcattttgaaatgtgtgaaaagggtctttaaattaccccgaataggttgtatcttattttgctttttttctgactataaaagcagttatgcttatagcataaaatctagaaagcacattaaagtataaagaaaattaaaatttcttataattctacctctgagtaaacagcagcattcgtatgtaacataaaccctctcagggatttattttttctttttaaaaattttttacaaaattaggatcaagtgcttttttaaataatttgcttttgtacttaataaattatagactttaaaatc

SEQ ID NO: 569 - DNA, 7161 bp, Homo sapiens
tccgcgctcgtgcccgcgcgggtgcgttgctgtcctggccgcgcccctgtcccgccgcctcccgctcctcgcctggcggatgtaggttgttggcctgaggggagctacgtagccgaggtttgcgctgccgccgccaggcccggtccggttccagcctctgcccggacgctagccggcctggccatggctgaccgcgggtgcccgctggaggcggcgccgctgcctgccgaggtgcgggagagcctggctgagctggagctggagctgtcggaaggtgacatcactcaaaaaggatatgaaaagaaaagggcaaagctgcttgcacgttatataccgcttattcaaggaatagacccatctctgcaagcagagaatagaattcctgggccctcacaaaccacggccgctgcacccaagcagcagaagtctcggcccaccgcctcgagggatgagcgcttccggtcagatgtccacactgaagccgtgcaagcagctttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacataggtgtccctgtgaacagcagagtgtcctccaaaatccagcagcttctgaacaccctgaagaggccaaagcgccctccactgaaggagttctttgtggatgattttgaggaattgttggaagttcagcaaccagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggatcgctgtgttctctgtgaccgtgctgcacgacgaccggattgtcctggtggctgagcagcggccggatgcctcggaggaggacagcttccagtggatgagccgtgtgctgcaggccattgatagcatccaccaggtgggcgtgtactgtctggccctggttcctgccaacaccttgcccaaggctcctctcggagggattcacatttctgaaaccaaacagcgctttctggaagggacgctgcacccgtgtaatgtgctgatgtgccctcacacctgtgttaccaacctccccaaacctcgtcagaaacaaccagaggttggaccagcctcaatgatcgtggggaacctggttgctgggaagagaatcgctcaggcttccgggagagagctcgcccacctggaggacagcgaccaggcacggaagttcctgttcctggctgacgtgctgcagtggcgtgcccacaccactcctgaccacccgctgttcttgctgctgaacgccaagggcaccgtcacaagcactgcaacctgtgtccagctgcacaaaagggctgagagagtggccgcggctctgatggagaagggaagactgagtgttggggaccatgtggctctggtctacccaccaggggtggacctcattgccgcgttctatggctgcttgtactgtggctgcgtgcctgtcaccgtgcggcccccgcaccctcagaacctcggcaccacactgcccaccgtcaagatgatcgtggaggtcagcaagtctgcatgcgtcctcaccacgcaggctgtcacacggctgctcaggtccaaggaggctgctgctgccgtggacatcaggacctggcccaccatcctagacacagatgacatcccaaaaaagaagatagcaagcgttttcaggcccccctcccccgatgtcctcgcatacttggacttcagcgtgtcaaccactgggatattagcgggagtgaagatgtcgcacgcggccacaagcgccttatgccgctccataaagctgcagtgtgagctgtacccctcgcggcagatcgccatctgcctcgacccctactgtggccttggttttgccctgtggtgtctgtgcagtgtctactcgggacaccaatcagtgctggtgcccccgctggagctggagagcaacgtgtccctgtggctgtcggccgtcagccagtacaaggcccgcgtcaccttctgctcctactctgtgatggagatgtgcaccaagggcctaggcgcacagacgggtgtcctcaggatgaagggggtgaacctgtcatgtgtgcgcacgtgcatggtggtcgccgaggagcggcccaggattgcgctgacccagtccttctccaagctcttcaaggacctgggcctgccggcccgcgccgtaagcaccacgttcgggtgcagggtcaacgtggccatctgcctccagggcacagctggcccggaccccacaaccgtctacgtggacatgcgggcactgcgccatgacagggttcgtttggtagaacggggttctccgcacagcctgccattgatggagtctggaaagatcctccccggcgtgaaggtcatcatcgcacacaccgagaccaaaggacccttgggagactcacacctgggagagatctgggtaagcagcccccacaatgccaccgggtactacaccgtttacggggaggaggcgcttcatgccgaccacttcagtgcccggctgagttttggagacacacagaccatctgggcaaggaccggctaccttggcttccttcggcgaacagagctcactgatgccagtggagggcggcacgatgcactgtatgtggttgggtctctggatgaaactctggagctcagaggcatgcggtaccaccccatcgacattgagacctctgtcatccgagcacacaggagcatcgctgagtgtgccgtattcacctggaccaacctgctggtggtggtggtggagctggatgggctagagcaggatgccctggacctggtggccctggtgaccaacgtggtgctggaggagcactacctggtcgtgggagtggtggtcatcgtggacccaggggtgatccctatcaactctcggggtgagaagcagcgcatgcacctgcgggacggcttcctggctgaccagctggaccccatctatgtcgcctacaacatgtgagcgcagcacaccggcccaggtgccggagatgaatgagccccagcagtccaaggtgtgatgtgggaagacaccgcagagctcactcaccgggactcgcccttcctgtgctcttacagatccctctcaacaatccccgcatctccttttagaaagcacttcctgaattatttaaagaaatattttgaatctgccaagtacatttacaaaaacacggatgctggtattttaacagatggagagacaaggaaaggaaaggaaaggcctggcatgggcattgtgaggaatcacaggcaccgaggttgttctctgctgtactgcaagtttgcactttctttaggctaaaaatatagttcctgatttttaaaattcagttatttattcccacttcaaatgacaagttcatatatagaatttacgggagaaacttgagaccatttacggggagaaacttgattctgggaagatagcagagtacaaaccagctgcctcacttctgtttcacagggaggctgatggaaaaaggaagcaagctggacccatcctccctgctcacagagggcactgtggtcacacacagtgcctcctctgccagttcctttattgaaagaggtgtgctggctggccacggtggcttacacctgtaatcccagcactttgggaggccgaggcgagcagatcacgaggtcaggagaccgagaccatcctggctaacatggtgaaaccctgtctctactaaaaatacaaaaaattagccgggtgtggtggtgggcgcctgtagtcccagctacttgggaggctgaggcaggagaatggtatgaaccagggaggcggagcttgcagtgagccgagatcacgctactgcactccagcctgggtgacagcacgagatgccgtcttaaaaaaacaaaaaagaggtgtgctgcttgtcagcatgtattgtcacggacactcaataagtgccattttggactgtcaaatttagatgctttgtttcagaaagataagccagcatttagttttaaatcactttcctggtttgtaacttgatgctgtttagttaaattgctagttttcctaacactacaatattaattcttctcgtggaagtgtactgatttattatttttattccaagtcagcagatttggaagcattgtggtaaagtctaaggttttcatatccatagtgctgtttggtgagtaccggcagtacagttgaggggagcagggaacagcattgccccgtattgaaggtggagatggttacattcttcactgctttttgcattttgagttgtgtgcctataaaatttggccaaaccattttattattttgttcaaacttgactaagctgagtgatctaaaattatacagaacctaaatcaaagaagagaatgtaaagtcctttagttacttctaagaatttgaagtcaagcacgaatctaagacatagattatttttatatagctaatgaagagtatgttacgaaattgttgggtttttggggtattgagggtggcaaattttgtgaatcatgcatgcttcacagaaacaaccaggtttttccagaattagtctggatcagtgcctaacaaagctgttattaattctccacacatgagtctggctaactgggccagctctcatgttttactcctgtctggctacaaatagcactgtgcatagtagccctgtttccccatggtgttggactgtggtaaagtatgttgtgacatactggaattctaataatcctgttgtaagtatgtacagaatctatgtaacttattgttgacatacagaggtttgggaagtagtctaatggacattccttacaatagaatggctgggaagggaaagaaaaaaaaaaaaaaactacctaactccaatcttaatgttgtagttttatagcaaacaaaaattgtcagctttttgtattgaaaggtcagtggtggtaagacaaggtgtcttgtaaattaagattttaagaagtgcattaaaatgttttagaattactctgggaattctgtatatcacactaaaatttttatatcattatgttaataaaagttattgactttgtaattctgcattttgaaatgtgtgaaaagggtctttaaattaccccgaataggttgtatcttattttgctttttttctgactataaaagcagttatgcttatagcataaaatctagaaagcacattaaagtataaagaaaattaaaatttcttataattctacctctgagtaaacagcagcattcgtatgtaacataaaccctctcagggatttattttttctttttaaaaattttttacaaaattaggatcaagtgcttttttaaataatttgcttttgtacttaataaattatagactttaaaatc

SEQ ID NO: 570 - DNA, 7023 bp, Homo sapiens
ccggccgggcgctcaggagcgcgcggggcagcggcggcgcggcggagccatccgcgctcgtgcccgcgcgggtgcgttgctgtcctggccgcgcccctgtcccgccgcctcccgctcctcgcctggcggatgtaggttgttggcctgaggggagctacgtagccgaggtttgcgctgccgccgccaggcccggtccggttccagcctctgcccggacgctagccggcctggccatggctgaccgcgggtgcccgctggaggcggcgccgctgcctgccgaggtgcgggagagcctggctgagctggagctggagctgtcggaaggtgacatcactcaaaaaggatatgaaaagaaaagggcaaagctgcttgcacgttatataccgcttattcaaggaatagacccatctctgcaagcagagaatagaattcctgggccctcacaaaccacggccgctgcacccaagcagcagaagtctcggcccaccgcctcgagggatgagcgcttccggtcagatgtccacactgaagccgtgcaagcagctttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacatagatctgcattctgcccctcctgatgtcaccacgggcctcgtggagcattcgtactttgagcgtccacaggtggcttctgtgagaagtgttcctcgggggtgcagcgggagcatgctggaaacagcagatggtgtccctgtgaacagcagagtgtcctccaaaatccagcagcttctgaacaccctgaagaggccaaagcgccctccactgaaggagttctttgtggatgattttgaggaattgttggaagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggatcgctgtgttctctgtgaccgtgctgcacgacgaccggattgtcctggtggctgagcagcggccggatgcctcggaggaggacagcttccagtggatgagccgtgtgctgcaggccattgatagcatccaccaggtgggcgtgtactgtctggccctggttcctgccaacaccttgcccaaggctcctctcggagggattcacatttctgaaaccaaacagcgctttctggaagggacgctgcacccgtgtaatgtgctgatgtgccctcacacctgtgttaccaacctccccaaacctcgtcagaaacaaccagaggttggaccagcctcaatgatcgtggggaacctggttgctgggaagagaatcgctcaggcttccgggagagagctcgcccacctggaggacagcgaccaggcacggaagttcctgttcctggctgacgtgctgcagtggcgtgcccacaccactcctgaccacccgctgttcttgctgctgaacgccaagggcaccgtcacaagcactgcaacctgtgtccagctgcacaaaagggctgagagagtggccgcggctctgatggagaagggaagactgagtgttggggaccatgtggctctggtctacccaccaggggtggacctcattgccgcgttctatggctgcttgtactgtggctgcgtgcctgtcaccgtgcggcccccgcaccctcagaacctcggcaccacactgcccaccgtcaagatgatcgtggaggtcagcaagtctgcatgcgtcctcaccacgcaggctgtcacacggctgctcaggtccaaggaggctgctgctgccgtggacatcaggacctggcccaccatcctagacacagatgacatcccaaaaaagaagatagcaagcgttttcaggcccccctcccccgatgtcctcgcatacttggacttcagcgtgtcaaccactgggatattagcgggagtgaagatgtcgcacgcggccacaagcgccttatgccgctccataaagctgcagtgtgagctgtacccctcgcggcagatcgccatctgcctcgacccctactgtggccttggttttgccctgtggtgtctgtgcagtgtctactcgggacaccaatcagtgctggtgcccccgctggagctggagagcaacgtgtccctgtggctgtcggccgtcagccagtacaaggcccgcgtcaccttctgctcctactctgtgatggagatgtgcaccaagggcctaggcgcacagacgggtgtcctcaggatgaagggggtgaacctgtcatgtgtgcgcacgtgcatggtggtcgccgaggagcggcccaggattgcgctgacccagtccttctccaagctcttcaaggacctgggcctgccggcccgcgccgtaagcaccacgttcgggtgcagggtcaacgtggccatctgcctccagggcacagctggcccggaccccacaaccgtctacgtggacatgcgggcactgcgccatgacagggttcgtttggtagaacggggttctccgcacagcctgccattgatggagtctggaaagatcctccccggcgtgaaggtcatcatcgcacacaccgagaccaaaggacccttgggagactcacacctgggagagatctgggtaagcagcccccacaatgccaccgggtactacaccgtttacggggaggaggcgcttcatgccgaccacttcagtgcccggctgagttttggagacacacagaccatctgggcaaggaccggctaccttggcttccttcggcgaacagagctcactgatgccagtggagggcggcacgatgcactgtatgtggttgggtctctggatgaaactctggagctcagaggcatgcggtaccaccccatcgacattgagacctctgtcatccgagcacacaggagcatcgctgagtgtgccgtattcacctggaccaacctgctggtggtggtggtggagctggatgggctagagcaggatgccctggacctggtggccctggtgaccaacgtggtgctggaggagcactacctggtcgtgggagtggtggtcatcgtggacccaggggtgatccctatcaactctcggggtgagaagcagcgcatgcacctgcgggacggcttcctggctgaccagctggaccccatctatgtcgcctacaacatgtgagcgcagcacaccggcccaggtgccggagatgaatgagccccagcagtccaaggtgtgatgtgggaagacaccgcagagctcactcaccgggactcgcccttcctgtgctcttacagatccctctcaacaatccccgcatctccttttagaaagcacttcctgaattatttaaagaaatattttgaatctgccaagtacatttacaaaaacacggatgctggtattttaacagatggagagacaaggaaaggaaaggaaaggcctggcatgggcattgtgaggaatcacaggcaccgaggttgttctctgctgtactgcaagtttgcactttctttaggctaaaaatatagttcctgatttttaaaattcagttatttattcccacttcaaatgacaagttcatatatagaatttacgggagaaacttgagaccatttacggggagaaacttgattctgggaagatagcagagtacaaaccagctgcctcacttctgtttcacagggaggctgatggaaaaaggaagcaagctggacccatcctccctgctcacagagggcactgtggtcacacacagtgcctcctctgccagttcctttattgaaagaggtgtgctggctggccacggtggcttacacctgtaatcccagcactttgggaggccgaggcgagcagatcacgaggtcaggagaccgagaccatcctggctaacatggtgaaaccctgtctctactaaaaatacaaaaaattagccgggtgtggtggtgggcgcctgtagtcccagctacttgggaggctgaggcaggagaatggtatgaaccagggaggcggagcttgcagtgagccgagatcacgctactgcactccagcctgggtgacagcacgagatgccgtcttaaaaaaacaaaaaagaggtgtgctgcttgtcagcatgtattgtcacggacactcaataagtgccattttggactgtcaaatttagatgctttgtttcagaaagataagccagcatttagttttaaatcactttcctggtttgtaacttgatgctgtttagttaaattgctagttttcctaacactacaatattaattcttctcgtggaagtgtactgatttattatttttattccaagtcagcagatttggaagcattgtggtaaagtctaaggttttcatatccatagtgctgtttggtgagtaccggcagtacagttgaggggagcagggaacagcattgccccgtattgaaggtggagatggttacattcttcactgctttttgcattttgagttgtgtgcctataaaatttggccaaaccattttattattttgttcaaacttgactaagctgagtgatctaaaattatacagaacctaaatcaaagaagagaatgtaaagtcctttagttacttctaagaatttgaagtcaagcacgaatctaagacatagattatttttatatagctaatgaagagtatgttacgaaattgttgggtttttggggtattgagggtggcaaattttgtgaatcatgcatgcttcacagaaacaaccaggtttttccagaattagtctggatcagtgcctaacaaagctgttattaattctccacacatgagtctggctaactgggccagctctcatgttttactcctgtctggctacaaatagcactgtgcatagtagccctgtttccccatggtgttggactgtggtaaagtatgttgtgacatactggaattctaataatcctgttgtaagtatgtacagaatctatgtaacttattgttgacatacagaggtttgggaagtagtctaatggacattccttacaatagaatggctgggaagggaaagaaaaaaaaaaaaaaactacctaactccaatcttaatgttgtagttttatagcaaacaaaaattgtcagctttttgtattgaaaggtcagtggtggtaagacaaggtgtcttgtaaattaagattttaagaagtgcattaaaatgttttagaattactctgggaattctgtatatcacactaaaatttttatatcattatgttaataaaagttattgactttgtaa

SEQ ID NO: 571 - DNA, 6967 bp, Homo sapiens
cggacgctagccggcctggccatggctgaccgcgggtgcccgctggaggcggcgccgctgcctgccgaggtgcgggagagcctggctgagctggagctggagctgtcggaaggtgacatcactcaaaaaggatatgaaaagaaaagggcaaagctgcttgcacgttatataccgcttattcaaggaatagacccatctctgcaagcagagaatagaattcctgggccctcacaaaccacggccgctgcacccaagcagcagaagtctcggcccaccgcctcgagggatgagcgcttccggtcagatgtccacactgaagccgtgcaagcagctttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacatagatctgcattctgcccctcctgatgtcaccacgggcctcgtggagcattcgtactttgagcgtccacaggtggcttctgtgagaagtgttcctcgggggtgcagcgggagcatgctggaaacagcagatggtgtccctgtgaacagcagagtgtcctccaaaatccagcagcttctgaacaccctgaagaggccaaagcgccctccactgaaggagttctttgtggatgattttgaggaattgttggaagttcagcaaccagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggatcgctgtgttctctgtgaccgtgctgcacgacgaccggattgtcctggtggctgagcagcggccggatgcctcggaggaggacagcttccagtggatgagccgtgtgctgcaggccattgatagcatccaccaggtgggcgtgtactgtctggccctggttcctgccaacaccttgcccaaggctcctctcggagggattcacatttctgaaaccaaacagcgctttctggaagggacgctgcacccgtgtaatgtgctgatgtgccctcacacctgtgttaccaacctccccaaacctcgtcagaaacaaccagaggttggaccagcctcaatgatcgtggggaacctggttgctgggaagagaatcgctcaggcttccgggagagagctcgcccacctggaggacagcgaccaggcacggaagttcctgttcctggctgacgtgctgcagtggcgtgcccacaccactcctgaccacccgctgttcttgctgctgaacgccaagggcaccgtcacaagcactgcaacctgtgtccagctgcacaaaagggctgagagagtggccgcggctctgatggagaagggaagactgagtgttggggaccatgtggctctggtctacccaccaggggtggacctcattgccgcgttctatggctgcttgtactgtggctgcgtgcctgtcaccgtgcggcccccgcaccctcagaacctcggcaccacactgcccaccgtcaagatgatcgtggaggtcagcaagtctgcatgcgtcctcaccacgcaggctgtcacacggctgctcaggtccaaggaggctgctgctgccgtggacatcaggacctggcccaccatcctagacacagatgacatcccaaaaaagaagatagcaagcgttttcaggcccccctcccccgatgtcctcgcatacttggacttcagcgtgtcaaccactgggatattagcgggagtgaagatgtcgcacgcggccacaagcgccttatgccgctccataaagctgcagtgtgagctgtacccctcgcggcagatcgccatctgcctcgacccctactgtggccttggttttgccctgtggtgtctgtgcagtgtctactcgggacaccaatcagtgctggtgcccccgctggagctggagagcaacgtgtccctgtggctgtcggccgtcagccagtacaaggcccgcgtcaccttctgctcctactctgtgatggagatgtgcaccaagggcctaggcgcacagacgggtgtcctcaggatgaagggggtgaacctgtcatgtgtgcgcacgtgcatggtggtcgccgaggagcggcccaggattgcgctgacccagtccttctccaagctcttcaaggacctgggcctgccggcccgcgccgtaagcaccacgttcgggtgcagggtcaacgtggccatctgcctccagggcacagctggcccggaccccacaaccgtctacgtggacatgcgggcactgcgccatgacagggttcgtttggtagaacggggttctccgcacagcctgccattgatggagtctggaaagatcctccccggcgtgaaggtcatcatcgcacacaccgagaccaaaggacccttgggagactcacacctgggagagatctgggtaagcagcccccacaatgccaccgggtactacaccgtttacggggaggaggcgcttcatgccgaccacttcagtgcccggctgagttttggagacacacagaccatctgggcaaggaccggctaccttggcttccttcggcgaacagagctcactgatgccagtggagggcggcacgatgcactgtatgtggttgggtctctggatgaaactctggagctcagaggcatgcggtaccaccccatcgacattgagacctctgtcatccgagcacacaggagcatcgctgagtgtgccgtattcacctggaccaacctgctggtggtggtggtggagctggatgggctagagcaggatgccctggacctggtggccctggtgaccaacgtggtgctggaggagcactacctggtcgtgggagtggtggtcatcgtggacccaggggtgatccctatcaactctcggggtgagaagcagcgcatgcacctgcgggacggcttcctggctgaccagctggaccccatctatgtcgcctacaacatgtgagcgcagcacaccggcccaggtgccggagatgaatgagccccagcagtccaaggtgtgatgtgggaagacaccgcagagctcactcaccgggactcgcccttcctgtgctcttacagatccctctcaacaatccccgcatctccttttagaaagcacttcctgaattatttaaagaaatattttgaatctgccaagtacatttacaaaaacacggatgctggtattttaacagatggagagacaaggaaaggaaaggaaaggcctggcatgggcattgtgaggaatcacaggcaccgaggttgttctctgctgtactgcaagtttgcactttctttaggctaaaaatatagttcctgatttttaaaattcagttatttattcccacttcaaatgacaagttcatatatagaatttacgggagaaacttgagaccatttacggggagaaacttgattctgggaagatagcagagtacaaaccagctgcctcacttctgtttcacagggaggctgatggaaaaaggaagcaagctggacccatcctccctgctcacagagggcactgtggtcacacacagtgcctcctctgccagttcctttattgaaagaggtgtgctggctggccacggtggcttacacctgtaatcccagcactttgggaggccgaggcgagcagatcacgaggtcaggagaccgagaccatcctggctaacatggtgaaaccctgtctctactaaaaatacaaaaaattagccgggtgtggtggtgggcgcctgtagtcccagctacttgggaggctgaggcaggagaatggtatgaaccagggaggcggagcttgcagtgagccgagatcacgctactgcactccagcctgggtgacagcacgagatgccgtcttaaaaaaacaaaaaagaggtgtgctgcttgtcagcatgtattgtcacggacactcaataagtgccattttggactgtcaaatttagatgctttgtttcagaaagataagccagcatttagttttaaatcactttcctggtttgtaacttgatgctgtttagttaaattgctagttttcctaacactacaatattaattcttctcgtggaagtgtactgatttattatttttattccaagtcagcagatttggaagcattgtggtaaagtctaaggttttcatatccatagtgctgtttggtgagtaccggcagtacagttgaggggagcagggaacagcattgccccgtattgaaggtggagatggttacattcttcactgctttttgcattttgagttgtgtgcctataaaatttggccaaaccattttattattttgttcaaacttgactaagctgagtgatctaaaattatacagaacctaaatcaaagaagagaatgtaaagtcctttagttacttctaagaatttgaagtcaagcacgaatctaagacatagattatttttatatagctaatgaagagtatgttacgaaattgttgggtttttggggtattgagggtggcaaattttgtgaatcatgcatgcttcacagaaacaaccaggtttttccagaattagtctggatcagtgcctaacaaagctgttattaattctccacacatgagtctggctaactgggccagctctcatgttttactcctgtctggctacaaatagcactgtgcatagtagccctgtttccccatggtgttggactgtggtaaagtatgttgtgacatactggaattctaataatcctgttgtaagtatgtacagaatctatgtaacttattgttgacatacagaggtttgggaagtagtctaatggacattccttacaatagaatggctgggaagggaaagaaaaaaaaaaaaaaactacctaactccaatcttaatgttgtagttttatagcaaacaaaaattgtcagctttttgtattgaaaggtcagtggtggtaagacaaggtgtcttgtaaattaagattttaagaagtgcattaaaatgttttagaattactctgggaattctgtatatcacactaaaatttttatatcattatgttaataaaagttattgactttgtaattctgcattttgaaatgtgtgaaaagggtctttaaattaccccgaataggttgtatcttattttgctttttttctgactataaaagcagttatgcttatagcataaaatctagaaagcacattaaagtataaagaaaattaaaa

SEQ ID NO: 572 - DNA, 3613 bp, Homo sapiens
ggagccatccgcgctcgtgcccgcgcgggtgcgttgctgtcctggccgcgcccctgtcccgccgcctcccgctcctcgcctggcggatgtaggttgttggcctgaggggagctacgtagccgaggtttgcgctgccgccgccaggcccggtccggttccagcctctgcccggacgctagccggcctggccatggctgaccgcgggtgcccgctggaggcggcgccgctgcctgccgaggtgcgggagagcctggctgagctggagctggagctgtcggaagatgtccacactgaagccgtgcaagcagctttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacatagatctgcattctgcccctcctgatgtcaccacgggcctcgtggagcattcgtactttgagcgtccacaggtggcttctgtgagaagtgttcctcgggggtgcagcgggagcatgctggaaacagcagatggtgtccctgtgaacagcagagtgtcctccaaaatccagcagcttctgaacaccctgaagaggccaaagcgccctccactgaaggagttctttgtggatgattttgaggaattgttggaagttcagcaaccagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggatcgctgtgttctctgtgaccgtgctgcacgacgaccggattgtcctggtggctgagcagcggccggatgcctcggaggaggacagcttccagtggatgagccgtgtgctgcaggccattgatagcatccaccaggtgggcgtgtactgtctggccctggttcctgccaacaccttgcccaaggctcctctcggagggattcacatttctgaaaccaaacagcgctttctggaagggacgctgcacccgtgtaatgtgctgatgtgccctcacacctgtgttaccaacctccccaaacctcgtcagaaacaaccagaggttggaccagcctcaatgatcgtggggaacctggttgctgggaagagaatcgctcaggcttccgggagagagctcgcccacctggaggacagcgaccaggcacggaagttcctgttcctggctgacgtgctgcagtggcgtgcccacaccactcctgaccacccgctgttcttgctgctgaacgccaagggcaccgtcacaagcactgcaacctgtgtccagctgcacaaaagggctgagagagtggccgcggctctgatggagaagggaagactgagtgttggggaccatgtggctctggtctacccaccaggggtggacctcattgccgcgttctatggctgcttgtactgtggctgcgtgcctgtcaccgtgcggcccccgcaccctcagaacctcggcaccacactgcccaccgtcaagatgatcgtggaggtcagcaagtctgcatgcgtcctcaccacgcaggctgtcacacggctgctcaggtccaaggaggctgctgctgccgtggacatcaggacctggcccaccatcctagacacagatgacatcccaaaaaagaagatagcaagcgttttcaggcccccctcccccgatgtcctcgcatacttggacttcagcgtgtcaaccactgggatattagcgggagtgaaggcggggcgtggtggctcacgcctgtaatcccagcacttcgggaggccgaggcgggtggatcacaagatcaagagatggagaccatcctggccaacgtggtgaaaccccgtctctact

SEQ ID NO: 573 - DNA, 2760 bp, Homo sapiens
gtagccgaggtttgcgctgccgccgccaggcccggtccggttccagcctctgcccggacgctagccggcctggccatggctgaccgcgggtgcccgctggaggcggcgccgctgcctgccgaggtgcgggagagcctggctgagctggagctggagctgtcggaaggtgacatcactcaaaaaggatatgaaaagaaaagggcaaagctgcttgcacgttatataccgcttattcaaggaatagacccatctctgcaagcagagaatagaattcctgggccctcacaaaccacggccgctgcacccaagcagcagaagtctcggcccaccgcctcgagggatgagcgcttccggtcagatgtccacactgaagccgtgcaagcagctttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacatagatctgcattctgcccctcctgatgtcaccacgggcctcgtggagcattcgtactttgagcgtccacaggtggcttctgtgagaagtgttcctcgggggtgcagcgggagcatgctggaaacagcagatggtgtccctgtgaacagcagagtgtcctccaaaatccagcagcttctgaacaccctgaagaggccaaagcgccctccactgaaggagttctttgtggatgattttgaggaattgttggaagttcagcaaccagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggtgatgcgctgcggacccccacgccgggagtagattccttcatttgcagctcgggaagtctttgtgcagtagatggaaagcccagcaaacttgaattcacaaagcctaaaaattgttgtacatcagaaaactcctaaagtaaaaggaaaatatttgcagcaat

SEQ ID NO: 574 - DNA, 3044 bp, Homo sapiens
ccgcgctcgtgcccgcgcgggtgcgttgctgtcctggccgcgcccctgtcccgccgcctcccgctcctcgcctggcggatgtaggttgttggcctgaggggagctacgtagccgaggtttgcgctgccgccgccaggcccggtccggttccagcctctgcccggacgctagccggcctggccatggctgaccgcgggtgcccgctggaggcggcgccgctgcctgccgaggtgcgggagagcctggctgagctggagctggagctgtcggaaggtgacatcactcaaaaaggatatgaaaagaaaagggcaaagctgcttgcacgttatataccgcttattcaaggaatagacccatctctgcaagcagagaatagaattcctgggccctcacaaaccacggccgctgcacccaagcagcagaagtctcggcccaccgcctcgagggatgagcgcttccggtcagatgtccacactgaagccgtgcaagcagctttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacatagatctgcattctgcccctcctgatgtcaccacgggcctcgtggagcattcgtactttgagcgtccacaggtggcttctgtgagaagtgttcctcgggggtgcagcgggagcatgctggaaacagcagatggtgtccctgtgaacagcagagtgtcctccaaaatccagcagcttctgaacaccctgaagaggccaaagcgccctccactgaaggagttctttgtggatgattttgaggaattgttggaagttcagcaaccagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggatcgctgtgttctctgtgaccgtgctgcacgacgaccggattgtcctggtggctgagcagcggccggatgcctcggaggaggacagcttccagtggatgagccgtgtgctgcaggtgggcgccccggcacggcctatggttcggtgaatctcccaagctggcacccccactccactccaagtgccaagtggttggcttgtcccgcccggtcctccctggctccagctttgtttatctgtatttttcattgcaaattgacaaattacagctgtatgtatttacgggatacaaagtgatgttataatttatgaatacaatatagaataattaatatatcca

SEQ ID NO: 575 - DNA, 2711 bp, Homo sapiens
gctgtcctggccgcgcccctgtcccgccgcctcccgctcctcgcctggcggatgtaggttgttggcctgaggggagctacgtagccgaggtttgcgctgccgccgccaggcccggtccggttccagcctctgcccggacgctagccggcctggccatggctgaccgcgggtgcccgctggaggcggcgccgctgcctgccgaggtgcgggagagcctggctgagctggagctggagctgtcggaaggtgacatcactcaaaaaggatatgaaaagaaaagggcaaagctgcttgcacgttatataccgcttattcaaggaatagacccatctctgcaagcagagaatagaattcctgggccctcacaaaccacggccgctgcacccaagcagcagaagtctcggcccaccgcctcgagggatgagcgcttccggtcagatgtccacactgaagccgtgcaagcagctttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacataggtgtccctgtgaacagcagagtgtcctccaaaatccagcagcttctgaacaccctgaagaggccaaagcgccctccactgaaggagttctttgtggatgattttgaggaattgttggaagttcagcaaccagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggtgatgcgctgcggacccccacgccgggagtagattccttcatttgcagctcgggaagtctttgtgcagtagatggaaagcccagcaaacttgaattcacaaagcctaaaaattgttgtacatcagaaaactcctaaagtaaaaggaaaatatttgcagcaat

SEQ ID NO: 576 - DNA, 2302 bp, Homo sapiens
ctctgccaggctcacgggacagctgcacctctcagcgtctccagctccaggacgcggtcgtcccaactccttccgagtggaaagagtgtaaaacttttgtccgtgcgcgggtggagctcagtaggaccacggcgcgtcctgccccggcttccccagcctcccagcagggttagctgcggtcagcgcactttccacttgggactcccggccagaaatttctcgggaatggagcggtcacagtgtggcagcagagaccgaggcgttagcggccgacctcacttggcccctgggctagtggtggctgcccctccgcccccgtccccggcgttgccggtaccatcggggatgcaggttcccccagcgttcctgcggccgcccagcctctttctgcgagcagcggccgcggccgccgccgccgctgccgccacctcgggaagcggaggctgcccgccggctcccgggctggagagcggggtaggcgcggtgggctgcggctacccgcggacgcccaagtgcgcccgctgtcgtaaccatggtgtggtgtcagcgctcaagggccacaagcgcttctgccgctggcgggactgcgcgtgtgccaagtgcaccctgatcgccgagcgccagcgcgtcatggccgcccaggtggcgctgcgcaggcagcaggcgcaggaggagagcgaagcccgggggctacagaggctcctgtgctcggggctctcctggccccccggtggtcgggcatccgggggcggcggcagagccgagaatccacagtccacgggcggccctgcggcgggggctgcgctgggactgggtgccttgagacaggccagtggttccgcgacccccgctttcgaagttttccagcaagattatcctgaggaaaaacaagaacaaaaagagagtaaatgtgagtcatgccagaatggacaagaagaactgatctccaaatcccatcagctttacctaggatcatcttctaggtctaatggtgtcattgggaaacaaagtatcgggtcatctatttcagaatactccaacaagcctgatagtatcctgtctcctcatcctggagagcaatcaggaggtgaagagagtcccaggtccttatcatcctctgatctggaatcaggaaatgaaagtgaatgggtcaaagacttgactgcgaccaaggcaagccttccgacagtgtcctcaagaccaagagatcctcttgatatccttactaagattttcccaaattacaggcgcagccggctagaaggcattctacggttctgcaaaggggatgtggtccaagccattgaacaggttttaaatggcaaagaacacaagccagacaacaggaacctagcaaactcagaagaactggaaaacacagcctttcagagagcttcaagttttagtcttgctggaattggttttggaactctaggtaataaatcagctttctctcctcttcaaactacttctgcttcttatggaggtgattcaagtctctacggcgtaaatcctagagtaggtatcagtccattaaggctggcatattcttctgcaggaagagggttatctggttttatgtcaccctacctaacacctgggttagtaccaaccttaccttttcggccagctttggattatgccttttcagggatgattagagattcttcctacctttccagtaaagactcaataacttgtggcagactgtacttcagaccaaatcaggacaatccgtaatgtatatgcccattctctctttctggagtttttccagcatacaatacatgcacgtgcacacacatacacacacatccattaatatacttcagtaagtatgtgagtggattatgaggtcttaaaatgctgggttttttttttttcaagcaatataataggtcttagatctgaaaactcttcattaggatttatcaagtgaaagaagtaaatctgaacattatatgtgccttgaataaagctatttcaggaaatatttaatgaattttctccctaaattatcatttgtaaacatttttattttaaaactagtttttattttattgaaaagtggaatttttagtgataaaatacatttgtaagtgtaaagcaatacagcataatagaatagaatataaaccgaaaggaagaactgaacaattaaggcaattctaaataattaccatttcaaaactgtttcttctattcctggttcataggaaagaaaaaagttattcaaagtatttttaaagcatttgatttgcagatgggtgattcgtaataaataaaacatttgagcattttg

SEQ ID NO: 577 - DNA, 3137 bp, Homo sapiens
tgtccaattctgtctaatggagccctaaggaccaacaatagagcgggcgagcggctcattgagagtctggcagcgccgggcaactgggccccggctgcgcgcagcgtccggcgcgcaccgcgaggggacccggcacggcgagagtcaggtcgcgggttccaaccacgcggcccgcagacgagcctccgacccggatttctgaagggagggttggactgcgctgcgttctgaggggtccggaagttcggacatggtgactgaaggagggtgacgtggtcagataaggggccgggggcaaagggaagcggccaagagctccagcgtcgccagtggagccgggaggcgcgtgcagcgccagcggaggaggaggatcccggagcccaaggtcctgtcatggagctgcgctcggagctgcccagcgtgcccggcgcggcgacggcggcggcggcaacagcgacggggccgcctgtggcgtcggtggcgtcggtggcggcagccgcggcggccgctgcatcgctaccggtgagcgtggcaggcggcttgctgcgggggccgccactgttgctgcgggcagccgagaagtacccgcggacccccaagtgcgcgcgctgtcgcaaccatggcgtggtgtcggccctcaagggccacaaacgctactgtcgctggaaggactgcctgtgcgccaagtgcacgctcatcgcggagcgccagcgtgtcatggcggcgcaggtggcgctgcgcaggcagcaggcgcaggaggagaacgaggcgcgcgagctgcagctgctctacggcactgccgaggggctggcgctggccgccgccaacggcatcatccccccgaggcccgcctacgaggtcttcggttcagtgtgcgccgccgacggcgggggacctggagcgggagcgcccgcggggaccggaggcggagcagctggcgcagggggctcagaggccaagttgcagaagtttgacctgtttcctaagacgctgctgcaggcaggccgcccgggcagcccgctgccgccgccggtgaagcccttatcacccgacggcgcagactcggggcccgggacgtcgtccccagaggtgcggcccggctcaggctcggagaacggcgatggcgagtccttttctggttcgcccctagctcgggcctccaaagaggcaggtggcagctgcccaggcagcgctggccctggcggcggcggcgaggaggacagcccgggctccgctagccctctgggctctgaatccggttcagaggctgacaaagaagagggtgaggccgcgccggcgccagggctgggcggaggctcgggtccacggcagcggacgccgctggatatcttgacacgcgtgttcccaggccaccggcgaggcgtcctggagctggtgttgcagggctgcggcggcgacgtggtgcaggccatcgagcaggtgctgaaccaccaccgtgggggcctggcggccggcctgggccctgcggcgcccccagataaggccgccgtgggtgctgcagcagctgcagacgacgcgtggcccagccgcgtcgacgccgccgccgccgccgccgccgccgccggggggcctgggctgcctgcgccgctgcaggcggggcccgccgcacctccgcaccacagacccttgctggccggcgccatggcgcctggggcgctgggctcgctgagcagccgctcggccttctcgccgctgcagcccaacgccagtcacttcggtgccgacgcgggcgcctacccgctgggcgcgccgctcggcctcagccccctgcgcctggcctactccgcggcggcggcgcacagccgcggtctggccttcatggcgccctactccactgccggcttggtgcccacgctcggcttccgcccacccatggactacgcctttagcgatctcatgcgtgaccgctcggccgccgctgctgcggcggtgcacaaggagccgacctacggcggcggcctgtacgggcctatggtcaacggcgctccggagaagcagtagggcgaggggcctggcagccggccggtccccaaacaggaaccccagccctgttcccgcgggccatcgacccctcttcgcccagcgctctctctgcgccctggctgggcgtcttctcactctaaggtggtttttgggttttgtttaggagggtgggtggggaaggctgagcaaagggggagcagctacagacaggtgcaggtgttctcggagggggtgcgcggcctgggtcctcatctcctacctccggatccctcttccagcctcacccggccccctttccaaaaggctgggaattcatgagaattcagaggctgcgacagcagcgcaggctcctgcggctccttagctgtgctcatccggctctcagtggatggcaggataatccgagagtcttttctgtgtctccccagccctcacttttaaaaaatttaaatattcgctctaacaaatataaatttaggatgtataaatctcttggcactgagtctttgggacacacatatatatcgatacaattgtaaaaaaaaaaaaaggaaacaagttttaaggtgcactttcctcgttgcggtatttgtcgctctctttgttgcttatgccgataagcatgggtttccttggtgcagtgtgtttttatatatgtataaatctatatataatctatacatatatatatacaagccagtgtataatgttataaaatggaattctaagttattaattgtaatctgtaggtgacctcggtattaacgtgaaaaacattcaaaacaagcaaaaaaagggacaaaatggaaaaaaattagactatgcgcgcattgtacttatcaggtttagagattaaatatattggaaactcgggatgaatcctgcccacctgcccctcttgcctgcggctggtctgtccctaaggagccgtcaaggtgcgcactgaagcaggaacagagcgacgtgtgactgagccagaaccgcccgctcgcgggcccatcctcgcctcccgggactcgccaaacgccctgactgaagggcccgcagcggaaaacgctgctgcagagcagcactttgtgctttcctttgcatagatatgagctagaaataaatgttattttctaagaaaacaa

SEQ ID NO: 578 - DNA, 2840 bp, Homo sapiens
gcttgggttcctcaaggcggcgctttggcctagcgcgcggtgtgctcctcaccaggtctctcccctctcccaccttctttcccgtcaggtcctgtcatggagctgcgctcggagctgcccagcgtgcccggcgcggcgacggcggcggcggcaacagcgacggggccgcctgtggcgtcggtggcgtcggtggcggcagccgcggcggccgctgcatcgctaccggtgagcgtggcaggcggcttgctgcgggggccgccactgttgctgcgggcagccgagaagtacccgcggacccccaagtgcgcgcgctgtcgcaaccatggcgtggtgtcggccctcaagggccacaaacgctactgtcgctggaaggactgcctgtgcgccaagtgcacgctcatcgcggagcgccagcgtgtcatggcggcgcaggtggcgctgcgcaggcagcaggcgcaggaggagaacgaggcgcgcgagctgcagctgctctacggcactgccgaggggctggcgctggccgccgccaacggcatcatccccccgaggcccgcctacgaggtcttcggttcagtgtgcgccgccgacggcgggggacctggagcgggagcgcccgcggggaccggaggcggagcagctggcgcagggggctcagaggccaagttgcagaagtttgacctgtttcctaagacgctgctgcaggcaggccgcccgggcagcccgctgccgccgccggtgaagcccttatcacccgacggcgcagactcggggcccgggacgtcgtccccagaggtgcggcccggctcaggctcggagaacggcgatggcgagtccttttctggttcgcccctagctcgggcctccaaagaggcaggtggcagctgcccaggcagcgctggccctggcggcggcggcgaggaggacagcccgggctccgctagccctctgggctctgaatccggttcagaggctgacaaagaagagggtgaggccgcgccggcgccagggctgggcggaggctcgggtccacggcagcggacgccgctggatatcttgacacgcgtgttcccaggccaccggcgaggcgtcctggagctggtgttgcagggctgcggcggcgacgtggtgcaggccatcgagcaggtgctgaaccaccaccgtgggggcctggcggccggcctgggccctgcggcgcccccagataaggccgccgtgggtgctgcagcagctgcagacgacgcgtggcccagccgcgtcgacgccgccgccgccgccgccgccgccgccggggggcctgggctgcctgcgccgctgcaggcggggcccgccgcacctccgcaccacagacccttgctggccggcgccatggcgcctggggcgctgggctcgctgagcagccgctcggccttctcgccgctgcagcccaacgccagtcacttcggtgccgacgcgggcgcctacccgctgggcgcgccgctcggcctcagccccctgcgcctggcctactccgcggcggcggcgcacagccgcggtctggccttcatggcgccctactccactgccggcttggtgcccacgctcggcttccgcccacccatggactacgcctttagcgatctcatgcgtgaccgctcggccgccgctgctgcggcggtgcacaaggagccgacctacggcggcggcctgtacgggcctatggtcaacggcgctccggagaagcagtagggcgaggggcctggcagccggccggtccccaaacaggaaccccagccctgttcccgcgggccatcgacccctcttcgcccagcgctctctctgcgccctggctgggcgtcttctcactctaaggtggtttttgggttttgtttaggagggtgggtggggaaggctgagcaaagggggagcagctacagacaggtgcaggtgttctcggagggggtgcgcggcctgggtcctcatctcctacctccggatccctcttccagcctcacccggccccctttccaaaaggctgggaattcatgagaattcagaggctgcgacagcagcgcaggctcctgcggctccttagctgtgctcatccggctctcagtggatggcaggataatccgagagtcttttctgtgtctccccagccctcacttttaaaaaatttaaatattcgctctaacaaatataaatttaggatgtataaatctcttggcactgagtctttgggacacacatatatatcgatacaattgtaaaaaaaaaaaaaggaaacaagttttaaggtgcactttcctcgttgcggtatttgtcgctctctttgttgcttatgccgataagcatgggtttccttggtgcagtgtgtttttatatatgtataaatctatatataatctatacatatatatatacaagccagtgtataatgttataaaatggaattctaagttattaattgtaatctgtaggtgacctcggtattaacgtgaaaaacattcaaaacaagcaaaaaaagggacaaaatggaaaaaaattagactatgcgcgcattgtacttatcaggtttagagattaaatatattggaaactcgggatgaatcctgcccacctgcccctcttgcctgcggctggtctgtccctaaggagccgtcaaggtgcgcactgaagcaggaacagagcgacgtgtgactgagccagaaccgcccgctcgcgggcccatcctcgcctcccgggactcgccaaacgccctgactgaagggcccgcagcggaaaacgctgctgcagagcagcactttgtgctttcctttgcatagatatgagctagaaataaatgttattttctaagaaaacaa

SEQ ID NO: 579 - DNA, 1910 bp, Homo sapiens
acttgctctgcagctcccagaggtggtggttgtgttacgaaggctgaccctgccaatggccgacaaaatggtgcgcacccccaagtgctcgagatgcaggaaccatggcttcctggtgcccgtcaagggacacgcgggcaaatgccgctggaagcagtgcctctgcgagaagtgctacctgatctccgagcgccagaagatcatggccgcgcagaaggtgctcaagacgcaggccgccgaggaggagcaggaggcggccctgtgtgcgcaggggcccaagcaggcctccggggctgcggccgccgcccccgcccccgtccccgtcccggccgcgagcctccgcccgctgtccccggggactccctccggagacgccgacccgggacccgagggccgcgcggccgcttgcttcttcgagcagcccccgcggggccggaaccccggcccgagagccctccagccggttctgggcggccgcagccacgtggagccgagcgagcgagccgccgtggcgatgcccagccttgcgggacccccttttggggcggaggccgcaggcagtggctaccctggccccctagacctgcgcaggccgatgcggaccgtgcccggcccactgttcaccgactttgtgcgccctctgaacatcaacccggaccgtgcactgggccctgagtaccctggtggctccagcatgcacccctactgcccgttcccgctgggctacctggacgcccctcctggcgtccccctgcagcagggcttccggcatgtgtcccgcagccagtaccaaggcggaggcttggtgtcagaaccaggaggagacttccagccaagctactacctgccgccgccgccgccgccactgccgccccttccaccgcttccaccgcagccccagttcctcccgccaggctacctctctgcgctccacttcctccccccgccaccgccaccaccacctccatcatctttctcactgaccgtcctgtttgatactgacaaggagaacactgatgaccaggatgcagaggtactgtcgggtgagcccagccagccatcgtctcaggagcagtccgactaggccccaggcccgccctcctggccagcagagtggggcactggggggcaacagcaacagttttcttgtcttcattcagtgatatgtagggaggaaggaggttgatagcatagatggcaactgattcccagtttaagataggaggaaggagagcaatttctaagtttcaatcctgcgctgtacagttgaagaagagtgtggaggaagctattaccaggggagggccagggctctgaggagtgggcgctgggagaagctcccatttaggaatgaatttaactgtccttgggttacactaccatttattggaacaagccccagaggcagtatttgatttcctcaggccccactctaggacaggaggcaccatctatttcagccttctgctgcctttgcctggtcctccaggttgctgggggcaccacagacatcaagattccagttcatccaggtggctggagccagcagccaggaccagggtcgttgacagcaggttctgcagcatcctgccttgctgctctgtcccccacatcttcctggccacagccccttgcccctcctctaaggggttttactagcaagcatcctggctgctggggctacttcattccccctccataaagtttcagccattatgggcactggttttaaaaaatttattagtttgactatttgatgtttttatagtgattgccaactttaaaaagtaggctgttcataagcactgatgcagtccctagggaatagaatggtgcttctgatcacctgtgacatgaacagtttcttctgtgaggacagttggctattgaaataaaatgagcaatggaaa

SEQ ID NO: 580 - DNA, 1340 bp, Homo sapiens
cttcgagcagcccccgcggggccggaaccccggcccgagagccctccagccggttctgggcggccgcagccacgtggagccgagcgagcgagccgccgtggcgatgcccagccttgcgggacccccttttggggcggaggccgcaggcagtggctaccctggccccctagacctgcgcaggccgatgcggaccgtgcccggcccactgttcaccgactttgtgcgccctctgaacatcaacccggaccgtgcactgggccctgagtaccctggtggctccagcatgcacccctactgcccgttcccgctgggctacctggacgcccctcctggcgtccccctgcagcagggcttccggcatgtgtcccgcagccagtaccaaggcggaggcttggtgtcagaaccaggaggagacttccagccaagctactacctgccgccgccgccgccgccactgccgccccttccaccgcttcctccccccgccaccgccaccaccacctccatcatctttctcactgaccgtcctgtttgatactgacaaggagaacactgatgaccaggatgcagaggtactgtcgggtgagcccagccagccatcgtctcaggagcagtccgactaggccccaggcccgccctcctggccagcagagtggggcactggggggcaacagcaacagttttcttgtcttcattcagtgatatgtagggaggaaggaggttgatagcatagatggcaactgattcccagtttaagataggaggaaggagagcaatttctaagtttcaatcctgcgctgtacagttgaagaagagtgtggaggaagctattaccaggggagggccagggctctgaggagtgggcgctgggagaagctcccatttaggaatgaatttaactgtccttgggttacactaccatttattggaacaagccccagaggcagtatttgatttcctcaggccccactctaggacaggaggcaccatctatttcagccttctgctgcctttgcctggtcctccaggttgctgggggcaccacagacatcaagattccagttcatccaggtggctggagccagcagccaggaccagggtcgttgacagcaggttctgcagcatcctgccttgctgctctgtcccccacatcttcctggccacagccccttgcccctcctctaaggggttttactagcaagcatcctggctgctggggctacttcattccccctccataaagtttcagccattatgggcactggttttaaaaaatttattagtttgactatttgatgtttttatagtgattgccaactttaaaaagtaggctgttcata

SEQ ID NO: 581 - DNA, 1821 bp, Homo sapiens
cttggcggttcctctggccactttctcacagtgtctttgggcgtcttcttgactgaatctgactccattggaggctgtgatccatggaacccagtgacatgcctgctggctaccactgccccttagactctgccccctgggatgagaccagagacccccagagcacagagctgatccccaggagagccatcagccgctctccaacctgcgcccgctgccgcaaccatggtgtcaccgcccatctcaagggccacaagcgcctctgcctcttccaggcttgcgagtgtcacaaatgtgtcctcatcctggagcgccgcagggtcatggctgcccaggtggccttgcgtaggcagcaggaggcgcagctaaagaagcacctgatgaggagaggggaagcctctcccaaagctcccaaccacttcagaaagggaaccactcagccacaggtcccctctggaaaggagaacatagcaccccagcctcagaccccccatggggcagtcctgctggcaccgacaccccccgggaagaactcctgtgggcctctgctgctcagccatcccccggaagcctcgcccttgtcctggactccggtgcctcctggcccttgggtccctggacactggctgcctccaggcttctccatgccaccaccagtggtgtgccgcctgctgtaccaagaacctgctgtctctctgcctcccttccctggctttgaccctggcacctccctccagctgcccactcatgggcccttcaccacctgcccaggatctcacccagtactgacagctcctctttctggagagccccaagggccccctagccagccccgcacacactcaactctgatactccagccctgtggcaccccagaccctcttcagctacagccacaggcctctggagcctcgtgcctggcccggacatctggtccctcagagtggcagctgcagcaagaggcagctgaagccctcgtggggctgaaagattcatcccaggctcctcgtgtgaccccttctgtgccccccaaccctgcctggatctccctgcttcacccctgtggcccaccagctcctgctggaggaagaggattccagcctgttggcccctgtcttcgacccagcccagccccctctgttgctctgcatattggccgtctggggtccatctccctcctgagctagaaacccagagatggaggctgtcttgctatggcagggaggtgacagcctgctggcactgtatatttagtgtcttacttaaggatttatgcatggaatttaatgtagtacaagcttcgggcttttttgtttgtttgtttgtttgtttgtttaagctttcaggtgcttcattagctttcagttcctttggtagtgtgggcatttccttggctgacagtggatattcttgtacccttcttgggtcctgggatctcttgaaatccccaataaagagagagttgtgctatttaagctgaccagtatctataaacgtgtttgcatgagtttacatcccaggattccatgattctgtaaatgcctatgcattcatgtctgtctccatgcatgtgaaaacaggagagtgttttcattttgtgtctaggtttgtgtgagtaagcaagaaataaacctttgttgttgtaagccactgagatttggagagtgttaccacagcctaacctagtctatcctgactgacagaaaggacttgttcatttcgcttctcaaagtgaaaaatctgttatccaatagctaccatagatgaaaacaaacttggatttttttctttgtccaaataaaaaaaaatgatgtaaagaaa

SEQ ID NO: 582 - DNA, 1552 bp, Homo sapiens
acgggggagtggtagtgggggctgcagctgccggacccaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccggctgttcctgagactgcaggcatcaagtttccagacttcaagtctgcaggtgtcacgctgcggagccaacggatgaagctgccaagctctgtgggacagaagaagatcaaggccctggaacagatgctgctggagcttggtgtggagctgagcccgacacctacggaggagctggtgcacatgttcaatgagctgcgaagcgacctggtgctgctctacgagctcaagcaggcctgtgccaactgcgagtatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgtaaatagagctgctgagttggaccaggctg

SEQ ID NO: 583 - DNA, 1545 bp, Homo sapiens
accgccggaagtttctgccgcggctttgcggggacgggggagtggtagtgggggctgcagctgccggacccaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccggctgttcctgagactgcaggcatcaagtttccagacttcaagtctgcaggtgtcacgctgcggagccaacggatgaagctgccaagctctgtgggacagaagaagatcaaggccctggaacagatgctgctggagcttggtgtggagctgagcccgacacctacggaggagctggtgcacatgttcaatgagctgcgaagcgacctggtgctgctctacgagctcaagcaggcctgtgccaactgcgagtatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgtaaatagagctgctgagttggaccaggctg

SEQ ID NO: 584 - DNA, 1639 bp, Homo sapiens
tgccgcggctttgcggggacgggggagtggtagtgggggctgcagctgccggacccaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaacaagggctcctgcttgcttagcaggatgcaggaggacctgaagtcttttgctccaggacatgactttcttgctataggggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccggctgttcctgagactgcaggcatcaagtttccagacttcaagtctgcaggtgtcacgctgcggagccaacggatgaagctgccaagctctgtgggacagaagaagatcaaggccctggaacagatgctgctggagcttggtgtggagctgagcccgacacctacggaggagctggtgcacatgttcaatgagctgcgaagcgacctggtgctgctctacgagctcaagcaggcctgtgccaactgcgagtatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgtaaatagagctgctgagttgg

SEQ ID NO: 585 - DNA, 1730 bp, Homo sapiens
ggggagtggtagtgggggctgcagctgccggacccaggtgcggaagtgcgagggcccaggtggctgaaggggccgttaggaacatccaagcggtggggcacaggcagatccccgacctgacctggaccacccttctcctcttggcccgccccttcaactcgcctccgcttaggtctggattggccccgccccctgacctgagcctggtccttcttcaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccggctgttcctgagactgcaggcatcaagtttccagacttcaagtctgcaggtgtcacgctgcggagccaacggatgaagctgccaagctctgtgggacagaagaagatcaaggccctggaacagatgctgctggagcttggtgtggagctgagcccgacacctacggaggagctggtgcacatgttcaatgagctgcgaagcgacctggtgctgctctacgagctcaagcaggcctgtgccaactgcgagtatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgtaaatagagctgctgagttggaccaggctg

SEQ ID NO: 586 - DNA, 396 bp, Homo sapiens
attatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataaggagtaccagctttatctccacgatgatgcttggactaaggcagaaactgaccacctctttgacctcagccgccgctttgacctgcgtttt

SEQ ID NO: 587 - DNA, 599 bp, Homo sapiens
cgcggctttgcggggacgggggagtggtagtgggggctgcagctgccggacccaggtctggattggccccgccccctgacctgagcctggtccttcttcaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaacaagggctcctgcttgcttagcaggatgcaggaggacctgaagtcttttgctccaggacatgactttcttgctataggggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccc

SEQ ID NO: 588 - DNA, 957 bp, Homo sapiens
cgcggctttgcggggacgggggagtggtagtgggggctgcagctgccggacccaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaacaagggctcctgcttgcttagcaggatgcaggaggacctgaagtcttttgctccaggacatgactttcttgctataggggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaagga

SEQ ID NO: 589 - DNA, 909 bp, Homo sapiens
gccgcggctttgcggggacgggggagtggtagtgggggctgcagctgccggacccaggtgcggaagtgcgagggcccaggtggctgaaggggccgttaggaacatccaagcggtggggcacaggcagatccccgacctgacctggaccacccttctcctcttggcccgccccttcaactcgcctccgcttaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccc

SEQ ID NO: 590 - DNA, 1066 bp, Homo sapiens
ccggaagtttctgccgcggctttgcggggacgggggagtggtagtgggggctgcagctgccggacccaggtctggattggccccgccccctgacctgagcctggtccttcttcaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccg

SEQ ID NO: 591 - DNA, 1480 bp, Homo sapiens
gggtcacgtggtggctgggccggggaaatggcggcttcaggagagagcgggacttcaggcggcggaggcagcaccgaggaagcatttatgaccttctacagtgaggtgaaacaaatagagaagagagactcggttctaacttcgaaaaatcagattgaaagactgacccgtcctggttcctcttacttcaatttgaacccatttgaggttcttcagatagatcctgaagttacagatgaagaaataaaaaagaggtttcggcagttatccatcttggtgcatcctgacaaaaatcaagatgatgctgacagagcacaaaaggcttttgaagctgtggacaaagcttacaagttgctactggatcaggagcaaaagaagagggccctggatgtaattcaggcaggaaaagaatacgtggaacacactgtgaaagagcgaaaaaaacaattaaagaaggaaggaaaacctacaattgtagaggaggatgatcctgagctgttcaaacaagctgtatataaacagacaatgaaactctttgcagagctggaaattaaaaggaaagagagagaagccaaagagatgcatgaaaggaaacgacaaagggaagaagagattgaagctcaagaaaaagccaaacgggaaagagagtggcagaaaaactttgaggaaagtcgagatggtcgtgtggacagctggcgaaacttccaagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctagaacaaccagtattagaaggtgccaccattggtgctgccttctcttcccacagcctgtaactcagtgttttgtacttcactgaattgtgatggttagaaacttcgtggatagtttgtggaaatcatccaattaaacatactgcttaaaacagtgttgctgtgacttcagagacaagcctggaaggggcaccttaggaagccccttcgcttcagttgctcgcttctgggtgtgctcccttcgaaggcccagataagacagggaacacttgtgagcacacagagcagcatctgatgccctgtggtgtttggcatgtgccccctgtctactgaccaatcagtgtggcatgaggcccacgccacccaaacctttcactttccaaagagctagccgtcctccacccagtaccatgtcctagcctgtctgcatttgttagtggtaatattctttatgtataataaatttttatacccaa

SEQ ID NO: 592 - DNA, 1617 bp, Homo sapiens
ccaccccccccccccaccaccaccaccaccaccaccccgccggccggccccaggcctcgacgccctgggtcccttccggggtggggcgggctgtcccaggggggctcaccgccattcatgaaggggtggagcctgcctgcctgtgggcctttacaagggcggctggctggctggctggctgtccgggcaggcctcctggctgcacctgccgcagtgcacagtccggctgaggtgcacgggagcccgccggcctctctctgcccgcgtccgtccgtgaaattccggccggggctcaccgcgatggccctcccgacaccctcggacagcaccctccccgcggaagcccggggacgaggacggcgacggagactcgtttggaccccgagccaaagcgaggccctgcgagcctgctttgagcggaacccgtacccgggcatcgccaccagagaacggctggcccaggccatcggcattccggagcccagggtccagatttggtttcagaatgagaggtcacgccagctgaggcagcaccggcgggaatctcggccctggcccgggagacgcggcccgccagaaggccggcgaaagcggaccgccgtcaccggatcccagaccgccctgctcctccgagcctttgagaaggatcgctttccaggcatcgccgcccgggaggagctggccagagagacgggcctcccggagtccaggattcagatctggtttcagaatcgaagggccaggcacccgggacagggtggcagggcgcccgcgcaggcaggcggcctgtgcagcgcggcccccggcgggggtcaccctgctccctcgtgggtcgccttcgcccacaccggcgcgtggggaacggggcttcccgcaccccacgtgccctgcgcgcctggggctctcccacagggggctttcgtgagccaggcagcgagggccgcccccgcgctgcagcccagccaggccgcgccggcagagggggtctcccaacctgccccggcgcgcggggatttcgcctacgccgccccggctcctccggacggggcgctctcccaccctcaggctcctcggtggcctccgcacccgggcaaaagccgggaggaccgggacccgcagcgcgacggcctgccgggcccctgcgcggtggcacagcctgggcccgctcaagcggggccgcagggccaaggggtgcttgcgccacccacgtcccaggggagtccgtggtggggctggggccggggtccccaggtcgccggggcggcgtgggaaccccaagccggggcagctccacctccccagcccgcgcccccggacgcctccgcctccgcgcggcaggggcagatgcaaggcatcccggcgccctcccaggcgctccaggagccggcgccctggtctgcactcccctgcggcctgctgctggatgagctcctggcgagcccggagtttctgcagcaggcgcaacctctcctagaaacggaggccccgggggagctggaggcctcggaagaggccgcctcgctggaagcacccctcagcgaggaagaataccgggctctgctggaggagctttaggacgcggggttgggacggggtcgggtggttcggggcagggcg

SEQ ID NO: 593 - DNA, 1375 bp, Homo sapiens
atggccctcccgacaccctcggacagcaccctccccgcggaagcccggggacgaggacggcgacggagactcgtttggaccccgagccaaagcgaggccctgcgagcctgctttgagcggaacccgtacccgggcatcgccaccagagaacggctggcccaggccatcggcattccggagcccagggtccagatttggtttcagaatgagaggtcacgccagctgaggcagcaccggcgggaatctcggccctggcccgggagacgcggcccgccagaaggccggcgaaagcggaccgccgtcaccggatcccagaccgccctgctcctccgagcctttgagaaggatcgctttccaggcatcgccgcccgggaggagctggccagagagacgggcctcccggagtccaggattcagatctggtttcagaatcgaagggccaggcacccgggacagggtggcagggcgcccgcgcaggcaggcggcctgtgcagcgcggcccccggcgggggtcaccctgctccctcgtgggtcgccttcgcccacaccggcgcgtggggaacggggcttcccgcaccccacgtgccctgcgcgcctggggctctcccacagggggctttcgtgagccaggcagcgagggccgcccccgcgctgcagcccagccaggccgcgccggcagagggggtctcccaacctgccccggcgcgcggggatttcgcctacgccgccccggctcctccggacggggcgctctcccaccctcaggctcctcggtggcctccgcacccgggcaaaagccgggaggaccgggacccgcagcgcgacggcctgccgggcccctgcgcggtggcacagcctgggcccgctcaagcggggccgcagggccaaggggtgcttgcgccacccacgtcccaggggagtccgtggtggggctggggccggggtccccaggtcgccggggcggcgtgggaaccccaagccggggcagctccacctccccagcccgcgcccccggacgcctccgcctccgcgcggcaggggcagatgcaaggcatcccggcgccctcccaggcgctccaggagccggcgccctggtctgcactcccctgcggcctgctgctggatgagctcctggcgagcccggagtttctgcagcaggcgcaacctctcctagaaacggaggccccgggggagctggaggcctcggaagaggccgcctcgctggaagcacccctcagcgaggaagaataccgggctctgctggaggagctttaggacgcggggtccaggcccggtgagagactccacaccgcggagaactgccattctttcctgggcatcccggggatcccagagccggcccaggtaccagcag

SEQ ID NO: 594 - DNA, 1617 bp, Homo sapiens
ccaccaccccccccccccaccaccaccaccaccaccccgccggccggccccaggcctcgacgccctgggtcccttccggggtggggcgggctgtcccaggggggctcaccgccattcatgaaggggtggagcctgcctgcctgtgggcctttacaagggcggctggctggctggctggctgtccgggcaggcctcctggctgcacctgccgcagtgcacagtccggctgaggtgcacgggagcccgccggcctctctctgcccgcgtccgtccgtgaaattccggccggggctcaccgcgatggccctcccgacaccctcggacagcaccctccccgcggaagcccggggacgaggacggcgacggagactcgtttggaccccgagccaaagcgaggccctgcgagcctgctttgagcggaacccgtacccgggcatcgccaccagagaacggctggcccaggccatcggcattccggagcccagggtccagatttggtttcagaatgagaggtcacgccagctgaggcagcaccggcgggaatctcggccctggcccgggagacgcggcccgccagaaggccggcgaaagcggaccgccgtcaccggatcccagaccgccctgctcctccgagcctttgagaaggatcgctttccaggcatcgccgcccgggaggagctggccagagagacgggcctcccggagtccaggattcagatctggtttcagaatcgaagggccaggcacccgggacagggtggcagggcgcccgcgcaggcaggcggcctgtgcagcgcggcccccggcgggggtcaccctgctccctcgtgggtcgccttcgcccacaccggcgcgtggggaacggggcttcccgcaccccacgtgccctgcgcgcctggggctctcccacagggggctttcgtgagccaggcagcgagggccgcccccgcgctgcagcccagccaggccgcgccggcagagggggtctcccaacctgccccggcgcgcggggatttcgcctacgccgccccggctcctccggacggggcgctctcccaccctcaggctcctcggtggcctccgcacccgggcaaaagccgggaggaccgggacccgcagcgcgacggcctgccgggcccctgcgcggtggcacagcctgggcccgctcaagcggggccgcagggccaaggggtgcttgcgccacccacgtcccaggggagtccgtggtggggctggggccggggtccccaggtcgccggggcggcgtgggaaccccaagccggggcagctccacctccccagcccgcgcccccggacgcctccgcctccgcgcggcaggggcagatgcaaggcatcccggcgccctcccaggcgctccaggagccggcgccctggtctgcactcccctgcggcctgctgctggatgagctcctggcgagcccggagtttctgcagcaggcgcaacctctcctagaaacggaggccccgggggagctggaggcctcggaagaggccgcctcgctggaagcacccctcagcgaggaagaataccgggctctgctggaggagctttaggacgcggggttgggacggggtcgggtggttcggggcagggcg

SEQ ID NO: 595 - DNA, 1283 bp, Homo sapiens
atggccctcccgacaccctcggacagcaccctccccgcggaagcccggggacgaggacggcgacggagactcgtttggaccccgagccaaagcgaggccctgcgagcctgctttgagcggaacccgtacccgggcatcgccaccagagaacggctggcccaggccatcggcattccggagcccagggtccagatttggtttcagaatgagaggtcacgccagctgaggcagcaccggcgggaatctcggccctggcccgggagacgcggcccgccagaaggccggcgaaagcggaccgccgtcaccggatcccagaccgccctgctcctccgagcctttgagaaggatcgctttccaggcatcgccgcccgggaggagctggccagagagacgggcctcccggagtccaggattcagatctggtttcagaatcgaagggccaggcacccgggacagggtggcagggcgcccgcgcaggcaggcggcctgtgcagcgcggcccccggcgggggtcaccctgctccctcgtgggtcgccttcgcccacaccggcgcgtggggaacggggcttcccgcaccccacgtgccctgcgcgcctggggctctcccacagggggctttcgtgagccaggcagcgagggccgcccccgcgctgcagcccagccaggccgcgccggcagagggggtctcccaacctgccccggcgcgcggggatttcgcctacgccgccccggctcctccggacggggcgctctcccaccctcaggctcctcggtggcctccgcacccgggcaaaagccgggaggaccgggacccgcagcgcgacggcctgccgggcccctgcgcggtggcacagcctgggcccgctcaagcggggccgcagggccaaggggtgcttgcgccacccacgtcccaggggagtccgtggtggggctggggccggggtccccaggtcgccggggcggcgtgggaaccccaagccggggcagctccacctccccagcccgcgcccccggacgcctccgcctccgcgcggcaggggcagatgcaaggcatcccggcgccctcccaggcgctccaggagccggcgccctggtctgcactcccctgcggcctgctgctggatgagctcctggcgagcccggagtttctgcagcaggcgcaacctctcctagaaacggaggccccgggggagctggaggcctcggaagaggccgcctcgctggaagcacccctcagcgaggaagaataccgggctctgctggaggagctttaggacgcggg

SEQ ID NO: 596 - DNA, 1605 bp, Homo sapiens
cccccccccaccaccaccaccaccaccaccccgccggccggccccaggcctcgacgccctgggtcccttccggggtggggcgggctgtcccaggggggctcaccgccattcatgaaggggtggagcctgcctgcctgtgggcctttacaagggcggctggctggctggctggctgtccgggcaggcctcctggctgcacctgccgcagtgcacagtccggctgaggtgcacgggagcccgccggcctctctctgcccgcgtccgtccgtgaaattccggccggggctcaccgcgatggccctcccgacaccttcggacagcaccctccccgcggaagcccggggacgaggacggcgacggagactcgtttggaccccgagccaaagcgaggccctgcgagcctgctttgagcggaacccgtacccgggcatcgccaccagagaacggctggcccaggccatcggcattccggagcccagggtccagatttggtttcagaatgagaggtcacgccagctgaggcagcaccggcgggaatctcggccctggcccgggagacgcggcccgccagaaggccggcgaaagcggaccgccgtcaccggatcccagaccgccctgctcctccgagcctttgagaaggatcgctttccaggcatcgccgcccgggaggagctggccagagagacgggcctcccggagtccaggattcagatctggtttcagaatcgaagggccaggcacccgggacagggtggcagggcgcccgcgcaggcaggcggcctgtgcagcgcggcccccggcgggggtcaccctgctccctcgtgggtcgccttcgcccacaccggcgcgtggggaacggggcttcccgcaccccacgtgccctgcgcgcctggggctctcccacagggggctttcgtgagccaggcagcgagggccgcccccgcgctgcagcccagccaggccgcgccggcagagggggtctcccaacctgccccggcgcgcggggatttcgcctacgccgccccggctcctccggacggggcgctctcccaccctcaggctcctcggtggcctccgcacccgggcaaaagccgggaggaccgggacccgcagcgcgacggcctgccgggcccctgcgcggtggcacagcctgggcccgctcaagcggggccgcagggccaaggggtgcttgcgccacccacgtcccaggggagtccgtggtggggctggggccggggtccccaggtcgctggggcggcgtgggaaccccaagccggggaagctccacctccccagcccgcgcccccggacgcctccgcgcggcaggggcagatgcaaggcatcccggcgccctcccaggcgctccaggagccggcgccctggtctgcactcccctgcggcctgctgctggatgagctcctggcgagcccggagtttctgcagcaggcgcaacctctcctagaaacggaggccccgggggagctggaggcctcggaagaggccgcctcgctggaagcacccctcagcgaggaagaataccgggctctgctggaggagctttaggacgcggggttgggacggggtcgggtggttcggggcagggcg

SEQ ID NO: 597 - DNA, 1277 bp, Homo sapiens
atggccctcccgacaccttcggacagcaccctccccgcggaagcccggggacgaggacggcgacggagactcgtttggaccccgagccaaagcgaggccctgcgagcctgctttgagcggaacccgtacccgggcatcgccaccagagaacggctggcccaggccatcggcattccggagcccagggtccagatttggtttcagaatgagaggtcacgccagctgaggcagcaccggcgggaatctcggccctggcccgggagacgcggcccgccagaaggccggcgaaagcggaccgccgtcaccggatcccagaccgccctgctcctccgagcctttgagaaggatcgctttccaggcatcgccgcccgggaggagctggccagagagacgggcctcccggagtccaggattcagatctggtttcagaatcgaagggccaggcacccgggacagggtggcagggcgcccgcgcaggcaggcggcctgtgcagcgcggcccccggcgggggtcaccctgctccctcgtgggtcgccttcgcccacaccggcgcgtggggaacggggcttcccgcaccccacgtgccctgcgcgcctggggctctcccacagggggctttcgtgagccaggcagcgagggccgcccccgcgctgcagcccagccaggccgcgccggcagagggggtctcccaacctgccccggcgcgcggggatttcgcctacgccgccccggctcctccggacggggcgctctcccaccctcaggctcctcggtggcctccgcacccgggcaaaagccgggaggaccgggacccgcagcgcgacggcctgccgggcccctgcgcggtggcacagcctgggcccgctcaagcggggccgcagggccaaggggtgcttgcgccacccacgtcccaggggagtccgtggtggggctggggccggggtccccaggtcgctggggcggcgtgggaaccccaagccggggaagctccacctccccagcccgcgcccccggacgcctccgcgcggcaggggcagatgcaaggcatcccggcgccctcccaggcgctccaggagccggcgccctggtctgcactcccctgcggcctgctgctggatgagctcctggcgagcccggagtttctgcagcaggcgcaacctctcctagaaacggaggccccgggggagctggaggcctcggaagaggccgcctcgctggaagcacccctcagcgaggaagaataccgggctctgctggaggagctttaggacgcggg

SEQ ID NO: 598 - DNA, 1617 bp, Homo sapiens; identical to SEQ ID NO: 594

SEQ ID NO: 599 - DNA, 1283 bp, Homo sapiens; identical to SEQ ID NO: 595

SEQ ID NO: 600 - DNA, 1501 bp, Homo sapiens
atggccctcccgacaccctcggacagcaccctccccgcggaagcccggggacgaggacggcgacggagactcgtttggaccccgagccaaagcgaggccctgcgagcctgctttgagcggaacccgtacccgggcatcgccaccagagaacggctggcccaggccatcggcattccggagcccagggtccagatttggtttcagaatgagaggtcacgccagctgaggcagcaccggcgggaatctcggccctggcccgggagacgcggcccgccagaaggccggcgaaagcggaccgccgtcaccggatcccagaccgccctgctcctccgagcctttgagaaggatcgctttccaggcatcgccgcccgggaggagctggccagagagacgggcctcccggagtccaggattcagatctggtttcagaatcgaagggccaggcacccgggacagggtggcagggcgcccgcgcaggcaggcggcctgtgcagcgcggcccccggcgggggtcaccctgctccctcgtgggtcgccttcgcccacaccggcgcgtggggaacggggcttcccgcaccccacgtgccctgcgcgcctggggctctcccacagggggctttcgtgagccaggcagcgagggccgcccccgcgctgcagcccagccaggccgcgccggcagagggggtctcccaacctgccccggcgcgcggggatttcgcctacgccgccccggctcctccggacggggcgctctcccaccctcaggctcctcggtggcctccgcacccgggcaaaagccgggaggaccgggacccgcagcgcgacggcctgccgggcccctgcgcggtggcacagcctgggcccgctcaagcggggccgcagggccaaggggtgcttgcgccacccacgtcccaggggagtccgtggtggggctggggccggggtccccaggtcgccggggcggcgtgggaaccccaagccggggcagctccacctccccagcccgcgcccccggacgcctccgcctccgcgcggcaggggcagatgcaaggcatcccggcgccctcccaggcgctccaggagccggcgccctggtctgcactcccctgcggcctgctgctggatgagctcctggcgagcccggagtttctgcagcaggcgcaacctctcctagaaacggaggccccgggggagctggaggcctcggaagaggccgcctcgctggaagcacccctcagcgaggaagaataccgggctctgctggaggagctttaggacgcggggttgggacggggtcgggtggttcggggcagggcggtggcctctctttcgcggggaacacctggctggctacggaggggcgtgtctccgccccgccccctccaccgggctgaccggcctgggattcctgccttctaggtccaggcccggtgagagactccacaccgcggagaactgccattctttcctgggcatcccggggatcccagagccggcccag

SEQ ID NO: 601 - DNA, 1617 bp, Homo sapiens; identical to SEQ ID NO: 594

SEQ ID NO: 602 - DNA, 1617 bp, Homo sapiens
ccaccaccccccccccccaccaccaccaccaccaccccgccggccggccccaggcctcgacgccctgggtcccttccggggtggggcgggctgtcccaggggggctcaccgccattcatgaaggggtggagcctgcctgcctgtgggcctttacaagggcggctggctggctggctggctgtccgggcaggcctcctggctgcacctgccgcagtgcacagtccggctgaggtgcacgggagcccgccggcctctctctgcccgcgtccgtccgtgaaattccggccggggctcaccgcgatggccctcccgacaccttcggacagcaccctccccgcggaagcccggggacgaggacggcgacggagactcgtttggaccccgagccaaagcgaggccctgcgagcctgctttgagcggaacccgtacccgggcatcgccaccagagaacggctggcccaggccatcggcattccggagcccagggtccagatttggtttcagaatgagaggtcacgccagctgaggcagcaccggcgggaatctcggccctggcccgggagacgcggcccgccagaaggccggcgaaagcggaccgccgtcaccggatcccagaccgccctgctcctccgagcctttgagaaggatcgctttccaggcatcgccgcccgggaggagctggccagagagacgggcctcccggagtccaggattcagatctggtttcagaatcgaagggccaggcacccgggacagggtggcagggcgcccgcgcaggcaggcggcctgtgcagcgcggcccccggcgggggtcaccctgctccctcgtgggtcgccttcgcccacaccggcgcgtggggaacggggcttcccgcaccccacgtgccctgcgcgcctggggctctcccacagggggctttcgtgagccaggcagcgagggccgcccccgcgctgcagcccagccaggccgcgccggcagagggggtctcccaacctgccccggcgcgcggggatttcgcctacgccgccccggctcctccggacggggcgctctcccaccctcaggctcctcggtggcctccgcacccgggcaaaagccgggaggaccgggacccgcagcgcgacggcctgccgggcccctgcgcggtggcacagcctgggcccgctcaagcggggccgcagggccaaggggtgcttgcgccacccacgtcccaggggagtccgtggtggggctggggccggggtccccaggtcgccggggcggcgtgggaaccccaagccggggcagctccacctccccagcccgcgcccccggacgcctccgcctccgcgcggcaggggcagatgcaaggcatcccggcgccctcccaggcgctccaggagccggcgccctggtctgcactcccctgcggcctgctgctggatgagctcctggcgagcccggagtttctgcagcaggcgcaacctctcctagaaacggaggccccgggggagctggaggcctcggaagaggccgcctcgctggaagcacccctcagcgaggaagaataccgggctctgctggaggagctttaggacgcggggttgggacggggtcgggtggttcggggcagggcg

SEQ ID NO: 603 - DNA, 1424 bp, Homo sapiens
atggccctcccgacaccttcggacagcaccctccccgcggaagcccggggacgaggacggcgacggagactcgtttggaccccgagccaaagcgaggccctgcgagcctgctttgagcggaacccgtacccgggcatcgccaccagagaacggctggcccaggccatcggcattccggagcccagggtccagatttggtttcagaatgagaggtcacgccagctgaggcagcaccggcgggaatctcggccctggcccgggagacgcggcccgccagaaggccggcgaaagcggaccgccgtcaccggatcccagaccgccctgctcctccgagcctttgagaaggatcgctttccaggcatcgccgcccgggaggagctggccagagagacgggcctcccggagtccaggattcagatctggtttcagaatcgaagggccaggcacccgggacagggtggcagggcgcccgcgcaggcaggcggcctgtgcagcgcggcccccggcgggggtcaccctgctccctcgtgggtcgccttcgcccacaccggcgcgtggggaacggggcttcccgcaccccacgtgccctgcgcgcctggggctctcccacagggggctttcgtgagccaggcagcgagggccgcccccgcgctgcagcccagccaggccgcgccggcagagggggtctcccaacctgccccggcgcgcggggatttcgcctacgccgccccggctcctccggacggggcgctctcccaccctcaggctcctcggtggcctccgcacccgggcaaaagccgggaggaccgggacccgcagcgcgacggcctgccgggcccctgcgcggtggcacagcctgggcccgctcaagcggggccgcagggccaaggggtgcttgcgccacccacgtcccaggggagtccgtggtggggctggggccggggtccccaggtcgccggggcggcgtgggaaccccaagccggggcagctccacctccccagcccgcgcccccggacgcctccgcctccgcgcggcaggggcagatgcaaggcatcccggcgccctcccaggcgctccaggagccggcgccctggtctgcactcccctgcggcctgctgctggatgagctcctggcgagcccggagtttctgcagcaggcgcaacctctcctagaaacggaggccccgggggagctggaggcctcggaagaggccgcctcgctggaagcacccctcagcgaggaagaataccgggctctgctggaggagctttaggacgcggggtccaggcccggtgagagactccacaccgcggagaactgccattctttcctgggcatcccggggatcccagagccggcccaggtaccagcaggtgggccgcctactgcgcacgcgcgggtttgcgggcagccgcctgggct

SEQ ID NO: 604 - DNA, 1516 bp, Homo sapiens
atggccctcccgacaccttcggacagcaccctccccgcggaagcccggggacgaggacggcgacggagactcgtttggaccccgagccaaagcgaggccctgcgagcctgctttgagcggaacccgtacccgggcatcgccaccagagaacggctggcccaggccatcggcattccggagcccagggtccagatttggtttcagaatgagaggtcacgccagctgaggcagcaccggcgggaatctcggccctggcccgggagacgcggcccgccagaaggccggcgaaagcggaccgccgtcaccggatcccagaccgccctgctcctccgagcctttgagaaggatcgctttccaggcatcgccgcccgggaggagctggccagagagacgggcctcccggagtccaggattcagatctggtttcagaatcgaagggccaggcacccgggacagggtggcagggcgcccgcgcaggcaggcggcctgtgcagcgcggcccccggcgggggtcaccctgctccctcgtgggtcgccttcgcccacaccggcgcgtggggaacggggcttcccgcaccccacgtgccctgcgcgcctggggctctcccacagggggctttcgtgagccaggcagcgagggccgcccccgcgctgcagcccagccaggccgcgccggcagagggggtctcccaacctgccccggcgcgcggggatttcgcctacgccgccccggctcctccggacggggcgctctcccaccctcaggctcctcggtggcctccgcacccgggcaaaagccgggaggaccgggacccgcagcgcgacggcctgccgggcccctgcgcggtggcacagcctgggcccgctcaagcggggccgcagggccaaggggtgcttgcgccacccacgtcccaggggagtccgtggtggggctggggccggggtccccaggtcgccggggcggcgtgggaaccccaagccggggcagctccacctccccagcccgcgcccccggacgcctccgcctccgcgcggcaggggcagatgcaaggcatcccggcgccctcccaggcgctccaggagccggcgccctggtctgcactcccctgcggcctgctgctggatgagctcctggcgagcccggagtttctgcagcaggcgcaacctctcctagaaacggaggccccgggggagctggaggcctcggaagaggccgcctcgctggaagcacccctcagcgaggaagaataccgggctctgctggaggagctttaggacgcggggttgggacggggtcgggtggttcggggcagggcggtggcctctctttcgcggggaacacctggctggctacggaggggcgtgtctccgccccgccccctccaccgggctgaccggcctgggattcctgccttctaggtccaggcccggtgagagactccacaccgcggagaactgccattctttcctgggcatcccggggatcccagagccggcccaggtaccagcaggtggg

SEQ ID NO: 605 - DNA, 2183 bp, Homo sapiens
ccgcagccaggctgccaactcattcgggagcccggggcatgaacggctacggctccccctacctgtacatgggcggcccggtgtcgcagccgccacgggcgcccctgcagcgcacgcccaagtgcgcgcgctgccgcaaccatggcgtcctgtcctggctcaagggccacaagcgttactgccgcttcaaggactgcacctgcgagaagtgcatcctcatcatcgagcggcagcgggtcatggctgcgcaggtggcgctgcgccggcagcaggccaacgagagcttggagagcctcatccccgactcgctgcgcgctctgccagggcccccgccgccgggggacgccgtcgccgccccgcagccgccgccagcctctcagccgtcgcagccgcagccgccgcgccctgctgccgagttggccgcggccgccgcgctgcgttggactgccgagccgcagcccggggctctgcaggcgcagctcgccaagccagatttgactgaagaacgacttggagacggcaagtcggcagacaatacagaggtcttcagtgacaaagacactgaccagaggagttccccagatgtggcaaagagtaagggctgcttcacccctgagagccctgagatagtgtccgtggaggaagggggatacgctgtccagaaaaacggaggcaaccccgagagccgccctgacagccccaagtgtcacgcggagcagaatcacctcctgattgagggcccctcggggactgtttctctgcccttcagcttgaaagccaacagaccgccgcttgaagtgttaaaaaagatattccccaaccagaagccaacggtgcttgagctcatcctcaagggctgtggcggggacctggtgagcgccgtggaagtccttctgtccagccgatcctcagtcacgggagcagagcgaacttccgcagaacctgagagtctagcgttgccctccaatgggcacatctttgaacacaccttgagctcctaccccatctcgtcttccaaatggtctgtgggatcagcctttcgagtcccagacacgttgaggttttctgccgactctagcaacgttgtccccagtcccttggctgggcctctgcagccccctttcccccagccaccccggtacccgctgatgctgaggaatactttggcgagaagccagtcgagcccctttttgcccaatgatgtcaccctgtggaacaccatgacgctgcagcagcagtatcagctgaggtcccagtatgtcagtcctttccccagtaactctaccagcgtcttcagaagctcgcccgtccttcctgcccgcgccacggaagaccctcggatttccatccctgatgatgggtgtccatttgtgtcaaagcagtccatttacaccgaggacgactatgacgagaggtctgactcctcagactctagaacactcaacacatcatcttaaagtggtgctggatgggtggtggccaggtgacattttctgtgcgttttgaccctgaggcatctgaggagaggccacatcttgtgtatgccctttccttctgtttgacaaagtgactgtgcttgattctatacattagcaataaaaacataacttatttaacttcttgcacttcactggaaaatgccaaatagctctgttctgtggctttagtgctgaatgtttattgtaaaagagagtctaatgttaagaatagtcttgggaaggctgggtccgtggaagatttatttggggatgtaaagctgaaggtcagccttgcacctaaacccaacctggaatgttaaatgaaataatatacttgaatgcaattttgtaaaagtggattcctcaggatatgtgaaacctaaaggaagtggttctgttgcaaatggactataaacagggacattatattcttacactaaaaatccttgcattttaaagagagatgcacttaagaatagagtgaactgctcatatgcttatttaagcttggacagttttcagagacaaaccccattaagaattactcttttcacatggctgaatcgaaacatgtgtaatgtcaatgtaaaaccaatcacagctgtgaactgcatgaaatgtattgtgaaacgaacacaagattaagctttgtcaggttaatgtagcatgttaaggactctagaaaaaaataaactaaggagacga

SEQ ID NO: 606 - DNA, 497 bp, Homo sapiens
tgatttctagatctttatttacagggtttttgtttcatttgccagtgatatagttcgaatttttttaaaaaggcttgtagtatattatgacccattgagatgcatttgctcttccaaaaagcacgtgtacaggtctcttctgagcacatctgctcctctttatgcacaccaggaaaagattaactcagctgttctgttttccagatttgactgaagaacgacttggagacggcaagtcggcagacaatacagaggtcttcagtgacaaagacactgaccagaggagttccccagatgtggcaaagagtaagggctgcttcacccctgagagccctgagatagtgtccgtggaggaagggggatacgctgtccagaaaaacggaggcaaccccgagagccgccctgacagccccaagtgtcacgcggagcagaatcacctcctgattgagggcccctcggggactgtttctctgcccttcagcttgaaagccaacaga

SEQ ID NO: 607 - DNA, 2170 bp, Homo sapiens
aggggcgggcccggcgcgcgcgggaagtctctgtagggcggccggctaccctcagccgccgcgcgtcatggccctttcggtgcccggctactcaccgggcttccgaaagccgcccgaggtagtgcggctccgacggaaaagggcccggagccgtggagctgccgcctccccgccccgtgagctgacggagccggcggcccgccgagccgccctggtggcggggctgcctcttcgccctttccctgctgcggggggcagaggcggtggcagcggcggcggcccggccgctgctcggaggaaccccttcgcccgcctggacaaccgaccgcgggtcgccgcggagccccccgacgggccggcccgcgagcagccggaggccccggtcccgtttttagattctaatcaagaaaatgatttgctatgggaagagaagtttcctgaaagaacaactgttactgaattacctcagacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggatcccaaactctcctctgagctccgttgtaccttccagcagagccttatctattggctccaccctgctttgtcttggctaccactgttccctcgtattggagctgatagaaaaatggctggaaagacaagtccttggtcaaatgatgcaaccctgcagcatgttttaatgagtgactggtctgtgagctttacttctctatataatttgctgaagacaaaactttgcccctatttctacgtttgtacctatcagtttactgtcctgttccgagcagcaggattagctggaagtgacttaatcacagctctcatatctccaacaactcgaggtttaagagaagctatgagaaatgaaggtattgaattttctctgcctttaataaaagaaagtggccataagaaggagacagcatctggaacaagcttgggatatggggaggagcaagccatcagtgatgaggatgaagaggaaagtttttcctggctggaagagatgggtgtgcaagataaaattaaaaagccagacatactttctatcaagctgcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaaggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccaactgctgtatttaacatctgcctgcaaatggacaaagtacttgatatggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagattcttgaagttgaaggaatatactgaaatgtttataaacataacttttactacagtagcatctaaggttttaaatgtgttttactattttcagattagatttttagatataaagatgaaaaactcagataactcaaatgagatatctatatccctacaacctaattgtatattgagcagaaactgaattaatatgcttccttgcaaatgggaaatcacatagcagttaccccatggcattgtgactaatggcatcagggcaaaaatatgttactttacgatttacctgttagcaggttcttgtttcataaaggtagaaaataaatacagacaacatcta

SEQ ID NO: 608 - DNA, 989 bp, Homo sapiens
gggcgggagcggcggtccagactggggagggacgcgcaccggccaggaggcttcaagaggagggcactagggccctgcgagcggcgtcttaaccggcggcgctaggactccgcgggaaacggcgggggcggagcgggcggcaccaggacccaggggaaccgcgacgggcgggcggcgagcaggcccgggagccgggaggctgcgggcggcggcgctggacccgacgcggcgagagaggccccgagatgccgagcaagaagaagaagtacaacgcgcggttcccgccggcgcggatcaagaagatcatgcagacggacgaagagattgggaaggtggcggcggcggtgcctgtcatcatctcccgggcgctcgagctcttcctagagtcgctgttgaagaaggcctgccaggtgacccagtcgcggaacgcgaagaccatgaccacatcccacctgaagcagtgcatcgagctggagcagcagtttgacttcttgaaggacctggtggcatctgttcccgacatgcagggggacggggaagacaaccacatggatggggacaagggcgcccgcaggggccggaagccaggcagcggcggccggaagaacggtgggatgggaacgaaaagcaaggacaagaagctgtccgggacagactcggagcaggaggatgaatctgaggacacagatactgatggggaagaggagacatcacaacccccaccccaggccagccacccctctgcccactttcagagccccccgacacccttcctgcccttcgcctctactctgcctttgcccccagcgcccccgggcccctcagcacctgatgaagaggacgaagaagattacgactcctagcgccttctgccccccagaccatagccccttttagttggttttagttgctctggggggaggagagaaggtagagctgttcttaaatttattaaaaaaaaaaataaaagggaatctcagtgtctgttc

SEQ ID NO: 609 - DNA, 917 bp, Homo sapiens
atgagtcagcagcggccggcgaggaagttacccagtctcctcctggacccgacggaggagacggttcgccgtcggtgccgagaccccatcaacgtggagggcctgctgttgtttattcaggcaaatctggcttgctgggctaggctcagctgagggctgccttcgccatgaatccttctccatcaaaaataaggattaatttagaagataatgtacaatatgtgtccatgagaaaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactga

SEQ ID NO: 610 - DNA, 1078 bp, Homo sapiens
atgcgggaagatggcgggccgggcgacttgagatccgcgggtctccctcctctttttccgtctgcgtcgggagctcccgggcacgtgaggccgtgccgcgtttactggcgggcgggacggcctagccgggcggcgcctcggaggaagccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggaagttacccagtctcctcctggacccgacggaggagacggttcgccgtcggtgccgagaccccatcaacgtggagggcctgctgccatcaaaaataaggattaatttagaagataatgtacaatatgtgtccatgagaaaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggatgactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactgatggcatttgagaatttatgtatcactgagttttttgggaatatcttcgtggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtg

SEQ ID NO: 611 - DNA, 3218 bp, Homo sapiens
atgcgggaagatggcgggccgggcgacttgagatccgcgggtctccctcctctttttccgtctgcgtcgggagctcccgggcacgtgaggccgtgccgcgtttactggcgggcgggacggcctagccgggcggcgcctcggaggaagccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggaagttacccagtctcctcctggacccgacggaggagacggttcgccgtcggtgccgagaccccatcaacgtggagggcctgctgccatcaaaaataaggattaatttagaagataatgtacaatatgtgtccatgagaaaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactgatggcatttgagaatttatgtatcactgagttttttgggaatatcttcgtggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctgaagtagcttcatcacagagtgtcatgaagacagacagtcaggctgaaatggacagttctttgtggactctacccttcccttcaaggagtatgtcatatatcacaaaagaaattgccttacactggttcatgtttgcagttactgttgtacattgcatagatgtacacacgaatttaaatgtgatgtctttgtatatatctgtataatgttgagattacttacgaaatatgtctgagtgacacttttcacccttgtacagccaaaataatgtatatatggaaagtgacagacaaattctctaatctctttggtacctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagactggtggcatgcccagtggctttgggggcaaggatagaaatgccatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctgtttctacctcattgggtaagtcatttaccactctgtgcctcagtttactctgtagtttaccattagactgtgagctccttgagggactttgtcataatcactgttacatcccagtgcctcacaccatgcctggcccttaagaagtgctcaataaatgtctgaacaaataagtgagtggagtgagtgaattgtaagatcagaataataatatttggtttgtctatcgtacaagattcctgtatcgtttgaatattgcttttaaagaaatatttgaagcgacttcaaattcagactgtgtttaaaaagatttaaaatcggaatccaaaatcaaagtattaaaaaataatgctgagtgtttaggattcacatacctctgagctctggtggcttttgccagtcctgtccctctgctgagcaccagcccttcctgcagcagtcctgccggtgtgtttctgtgcacctggggatgaagtgtgctcctcccccagcggttagcctcaatgcttttcctccctctgttttattatttgaaattagccaaagaaaagctgcagggggcactgctgatcatcactggactggtgggtcgtactgtttgacagaatagggaatacaggaggaggagcaagcctagggtaaaacttaggtttgggacatgcttgatgaaagcaagagttgagcaggttgttgtgtgtatgtaggtcaggtgctcagcggaaaagtctgagctgtgtagtacgtcaggcagatgtcagtttagatgcgatagtttaagccacaagagtaggagaggtcatctaaagagtacagcaggcctaagggcatctatatttaaggagaaatacagaagaagtctcctgagaaggaataatggggcgggtggggagggagaaggcagtgtcccaaaaaccaacaaaggttttaccaaaggtaataccatcatttctgagcagcagttccttaacttgtgaatgtggcaaatgttctcctttacaaattgttctgaaggtaaaatgagatcatgtaaacgaaaatcctttgtaaattacagatgtgtgttataaatgaagtatctctcgagtcactcca

SEQ ID NO: 612 - DNA, 1050 bp, Homo sapiens
atgagtcagcagcggccggcgaggaagttacccagtctcctcctggacccgacggaggagacggttcgccgtcggtgccgagaccccatcaacgtggagggcctgctgttgtttattcaggcaaatctggcttgctgggctaggctcagctgagggctgccttcgccatgaatccttctccatcaaaaataaggattaatttagaagataatgtacaatatgtgtccatgagaatgtaggaatgggctccagagagaagacatttatattatgaaatatgtacctttgttcctgaagtaaccgccagtggtctttaaactaaatgtgacattgtggaggttctgagtaaggacatttctgactgaagaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactga

SEQ ID NO: 613 - DNA, 791 bp, Homo sapiens
atgagtcagcagcggccggcgaggaagttacccagtctcctcctggacccgacggaggagacggttcgccgtcggtgccgagaccccatcaacgtggagggcctgctgaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactga

SEQ ID NO: 614 - DNA, 3566 bp, Homo sapiens
tctacaggagccattttaacagctaaaacttgtcggattgctttttattttcaagctcaaaagacgatagagaaagaatacttgaaggccaagaagcttgagagaagaaaaatttcagaaaaattgtctcaatttgactagaatatcaatgaaccaggaaaactgaagcaccttccctaaagaaaacttgggtatacaattactccacagacagagctgagggttttttacccaaatcagtcactggattttgctgcctgatacgtgaatcttcttggaatttttctcatgtggatctaaggggaatgctttattatggctgctgttgtccaacagaacgacctagtatttgaatttgctagtaacgtcatggaggatgaacgacagcttggtgatccagctatttttcctgccgtaattgtggaacatgttcctggtgctgatattctcaatagttatgccggtctagcctgtgtggaagagcccaatgacatgattactgagagttcactggatgttgctgaagaagaaatcatagacgatgatgatgatgacatcacccttacagttgaagcttcttgtcatgacggggatgaaacaattgaaactattgaggctgctgaggcactcctcaatatggattcccctggccctatgctggatgaaaaacgaataaataataatatatttagttcacctgaagatgacatggttgttgccccagtcacccatgtgtccgtcacattagatgggattcctgaagtgatggaaacacagcaggtgcaagaaaaatatgcagactcaccgggagcctcatcaccagaacagcctaagaggaaaaaaggaagaaaaactaaaccaccacgaccagattccccagccactacgccaaatatatctgtgaagaagaaaaacaaagatggaaagggaaacacaatttatctttgggagtttttactggcactgctccaggacaaggctacttgtcctaaatacatcaagtggacccagcgagagaaaggcatttttaaattggtggattctaaagcagtgtccaggttgtgggggaagcacaaaaacaaacctgatatgaattatgagaccatgggaagagcactcaggtactattaccaaaggggtattctggcaaaagtggaaggtcagcgcttggtgtatcagtttaaagaaatgccaaaagatcttatatatataaatgatgaggatccaagttccagcatagagtcttcagatccatcgctatcttcatcagccacttcaaataggaatcaaaccagccggtcgagagtatcttcaagtccaggggtaaaaggaggagccactacagttctaaaaccagggaattctaaagctgcaaaacccaaagatcctgtggaagttgcacaaccatcagaagttttgaggacagtgcagcccacgcagtctccatatcctacccagctcttccggactgttcatgtagtacagccagtacaggctgtcccagagggagaagcagctagaaccagtaccatgcaggatgaaacattaaattcttccgttcagagtattaggactatacaggctccaacccaagttccagtggttgtgtctcctaggaatcagcagttgcatacagtaacactccaaacagtgccactcacaacagttatagccagcacagatccatcagcaggtactggatctcagaagtttattttacaagccattccatcatcacagcccatgacagtactgaaagaaaatgtcatgctgcagtcacaaaaggcgggctctcctccttcaattgtcttgggccctgcccaggttcagcaggtccttactagcaatgttcagaccatttgcaatggaaccgtcagtgtggcttcctctccatccttcagtgctactgcacctgtggtgaccttttctcctcgcagttcacagctggttgctcacccacctggcactgtaatcacttcagttatcaaaactcaagaaacaaaaactcttacacaggaagtagagaaaaaggaatctgaagatcatttgaaagagaacactgagaaaacggagcagcagccacagccttatgtgatggtagtgtccagttccaatggatttacttctcaggtagctatgaaacaaaacgaactgctggaacccaactctttttagttaatataccaaagcttatgaataattgtttgttaattgaacattttcaattatatgcagactgactgattctaagataaattctaaggaggtttctaattttgtaattgttaaaaatagagttaattttgactttgttagatgagggaggaaaactcaactgtttctctttgttatctaaatgtttcagaattcaatcgtgaaggaacaggcattttacactatgaagacattcttttgagatttttatttcagttgctatatcataagcatttttaaagtttcttttctaattttacattgtattagattttctgattcttttgtaaatacagaacttaaatagaaggcaacaggaaatttatataggaactattttcattccacttgtgtaagttaagtcttgactctttcaaatgcaaaaaacctattttatgctttgttaaaattatggtgtcacttagattgactttagttgactgcactatataatatagaactatgaatatgtagaataacatgaaaaattggaggtgctggtggtatggctgaccctgtttcagaagcaggatagtataaaagcatcagcctaagaatggcactcccactaactagctatgtaatcttgacctctttgggctttagttcctctcataaaaggaagagatgtattggattagactagatgatcaccactttctcttctagttctaatttttttaattctaatacctatattttcaagttatgtcaattaaatcattatcaggttatttcctaatgtaagaatagctaaaatgttgcagagaaataagtgacccaacaaaatttattcatctgttatgggtaagatctgccataaattcttcctaaataatttgtttactaactctttaggccactgtgctttgcggtccattagtaaacttgtgttgctaagtgctaaacagaatactgctattttgagagagtcaagactctttcttaagggccaagaaagcaacttgagccttgggctaatctggctgagtagtcagttataaaagcataattgctttatattttggatcattttttactgggggcggacttggggggggttgcatacaaagataacatatatatccaactttctgaaatgaaatgtttttagattactttttcaactgtaaataatgtacatttaatgtcacaagaaaaaaatgtcttctgcaaattttctagtataacagaaatttttgtagatgaaaaaaatcattatgtttagaggtctaatgctatgttttcatattacagagtgaatttgtatttaaacaaaaatttaaattttggaatcctctaaacatttttgtatctttaattggtttattattaaataaatcatataaaaa

SEQ ID NO: 615 - DNA, 3017 bp, Homo sapiens
gcggcggcggcggcggcggcggcggcagcagcagcttcagtagcgcagaggcggcggtggcgagaggtgcggcgaaggaggcagaggcacttatgcttgtcaggccaagaagcttgagagaagaaaaatttcagaaaaattgtctcaatttgactagaatatcaatgaaccaggaaaactggaagaaaaactaaaccaccacgaccagattccccagccactacgccaaatatatctgtgaagaagaaaaacaaagatggaaagggaaacacaatttatctttgggagtttttactggcactgctccaggacaaggctacttgtcctaaatacatcaagtggacccagcgagagaaaggcatttttaaattggtggattctaaagcagtgtccaggttgtgggggaagcacaaaaacaaacctgatatgaattatgagaccatgggaagagcactcaggtactattaccaaaggggtattctggcaaaagtggaaggtcagcgcttggtgtatcagtttaaagaaatgccaaaagatcttatatatataaatgatgaggatccaagttccagcatagagtcttcagatccatcgctatcttcatcagccacttcaaataggaatcaaaccagccggtcgagagtatcttcaagtccaggggtaaaaggaggagccactacagttctaaaaccagggaattctaaagctgcaaaacccaaagatcctgtggaagttgcacaaccatcagaagttttgaggacagtgcagcccacgcagtctccatatcctacccagctcttccggactgttcatgtagtacagccagtacaggctgtcccagagggagaagcagctagaaccagtaccatgcaggatgaaacattaaattcttccgttcagagtattaggactatacaggctccaacccaagttccagtggttgtgtctcctaggaatcagcagttgcatacagtaacactccaaacagtgccactcacaacagttatagccagcacagatccatcagcaggtactggatctcagaagtttattttacaagccattccatcatcacagcccatgacagtactgaaagaaaatgtcatgctgcagtcacaaaaggcgggctctcctccttcaattgtcttgggccctgcccaggttcagcaggtccttactagcaatgttcagaccatttgcaatggaaccgtcagtgtggcttcctctccatccttcagtgctactgcacctgtggtgaccttttctcctcgcagttcacagctggttgctcacccacctggcactgtaatcacttcagttatcaaaactcaagaaacaaaaactcttacacaggaagtagagaaaaaggaatctgaagatcatttgaaagagaacactgagaaaacggagcagcagccacagccttatgtgatggtagtgtccagttccaatggatttacttctcaggtagctatgaaacaaaacgaactgctggaacccaactctttttagttaatataccaaagcttatgaataattgtttgttaattgaacattttcaattatatgcagactgactgattctaagataaattctaaggaggtttctaattttgtaattgttaaaaatagagttaattttgactttgttagatgagggaggaaaactcaactgtttctctttgttatctaaatgtttcagaattcaatcgtgaaggaacaggcattttacactatgaagacattcttttgagatttttatttcagttgctatatcataagcatttttaaagtttcttttctaattttacattgtattagattttctgattcttttgtaaatacagaacttaaatagaaggcaacaggaaatttatataggaactattttcattccacttgtgtaagttaagtcttgactctttcaaatgcaaaaaacctattttatgctttgttaaaattatggtgtcacttagattgactttagttgactgcactatataatatagaactatgaatatgtagaataacatgaaaaattggaggtgctggtggtatggctgaccctgtttcagaagcaggatagtataaaagcatcagcctaagaatggcactcccactaactagctatgtaatcttgacctctttgggctttagttcctctcataaaaggaagagatgtattggattagactagatgatcaccactttctcttctagttctaatttttttaattctaatacctatattttcaagttatgtcaattaaatcattatcaggttatttcctaatgtaagaatagctaaaatgttgcagagaaataagtgacccaacaaaatttattcatctgttatgggtaagatctgccataaattcttcctaaataatttgtttactaactctttaggccactgtgctttgcggtccattagtaaacttgtgttgctaagtgctaaacagaatactgctattttgagagagtcaagactctttcttaagggccaagaaagcaacttgagccttgggctaatctggctgagtagtcagttataaaagcataattgctttatattttggatcattttttactgggggcggacttggggggggttgcatacaaagataacatatatatccaactttctgaaatgaaatgtttttagattactttttcaactgtaaataatgtacatttaatgtcacaagaaaaaaatgtcttctgcaaattttctagtataacagaaatttttgtagatgaaaaaaatcattatgtttagaggtctaatgctatgttttcatattacagagtgaatttgtatttaaacaaaaatttaaattttggaatcctctaaacatttttgtatctttaattggtttattattaaataaatcatataaaaattctcagtgtctgttttcaggcaaaagtttcttaaagaataagtgtgcagagaatattactagaacatcagcattacttaatgtttataaataaatttcattagtcagaattgc

SEQ ID NO: 616 - DNA, 903 bp, Homo sapiens
cccggctccaaagaggtggggtcggtataaaggggttgaggtcaccgggaaggggtaaaagcgcgacgggacctgagctgaaggacgggatctcaagcctcaagtccctgcgccatcccgccgtctctgtgtcctcccctggggcccaaaacctccatcctccttctaggctcgctggctcaaggccaaggagctcagcgcgccgcctccgcccggaacgcaaacagctgttcccagagacgtctccgctctcaactttgccaactactccgcacgcactttgaccagcggagcaaccgggacctgtgggtcggggtcctctggcggagttaaaaaaaaaagaggtgaaactgcgggaccggcgctgcgagtcgctaggcttcgcctcaaactttgctgttgcagcggagcggccccgcccctcctctcccctacgacgcccacgcgctcggatggggcttgttccctagctcgggagcgtgtgggcagcagcagcggcggcggcggcggcggcggcggcggcggcagcagcagcttcagtagcgcagaggcggcggtggcgagaggtgcggcgaaggaggcagaggcacttatgcttgtcaggccaagaagcttgagagaagaaaaatttcagaaaaattgtctcaatttgactagaatatcaatgaaccaggaaaactgaagcaccttccctaaagaaaacttgggtatacaattactccacagacagagctgagggttttttacccaaatcagtcactggattttgctgcctgatacgtgaatcttcttggaatttttctcatgtggatctaaggggaatgctttattatggctgctgttgtccaacagaacgacctagtatttgaatttgctagtaacgtcatggaggatgaacgacag

SEQ ID NO: 617 - DNA, 3521 bp, Homo sapiens
gccaagaagcttgagagaagaaaaatttcagaaaaattgtctcaatttgactagaatatcaatgaaccaggaaaactgaagcaccttccctaaagaaaacttgggtatacaattactccacagacagagctgagggttttttacccaaatcagtcactggattttgctgcctgatacgtgaatcttcttggaatttttctcatgtggatctaaggggaatgctttattatggctgctgttgtccaacagaacgacctagtatttgaatttgctagtaacgtcatggaggatgaacgacagcttggtgatccagctatttttcctgccgtaattgtggaacatgttcctggtgctgatattctcaatagttatgccggtctagcctgtgtggaagagcccaatgacatgattactgagagttcactggatgttgctgaagaagaaatcatagacgatgatgatgatgacatcacccttacagttgaagcttcttgtcatgacggggatgaaacaattgaaactattgaggctgctgaggcactcctcaatatggattcccctggccctatgctggatgaaaaacgaataaatgggattcctgaagtgatggaaacacagcaggtgcaagaaaaatatgcagactcaccgggagcctcatcaccagaacagcctaagaggaaaaaaggaagaaaaactaaaccaccacgaccagattccccagccactacgccaaatatatctgtgaagaagaaaaacaaagatggaaagggaaacacaatttatctttgggagtttttactggcactgctccaggacaaggctacttgtcctaaatacatcaagtggacccagcgagagaaaggcatttttaaattggtggattctaaagcagtgtccaggttgtgggggaagcacaaaaacaaacctgatatgaattatgagaccatgggaagagcactcaggtactattaccaaaggggtattctggcaaaagtggaaggtcagcgcttggtgtatcagtttaaagaaatgccaaaagatcttatatatataaatgatgaggatccaagttccagcatagagtcttcagatccatcgctatcttcatcagccacttcaaataggaatcaaaccagccggtcgagagtatcttcaagtccaggggtaaaaggaggagccactacagttctaaaaccagggaattctaaagctgcaaaacccaaagatcctgtggaagttgcacaaccatcagaagttttgaggacagtgcagcccacgcagtctccatatcctacccagctcttccggactgttcatgtagtacagccagtacaggctgtcccagagggagaagcagctagaaccagtaccatgcaggatgaaacattaaattcttccgttcagagtattaggactatacaggctccaacccaagttccagtggttgtgtctcctaggaatcagcagttgcatacagtaacactccaaacagtgccactcacaacagttatagccagcacagatccatcagcaggtactggatctcagaagtttattttacaagccattccatcatcacagcccatgacagtactgaaagaaaatgtcatgctgcagtcacaaaaggcgggctctcctccttcaattgtcttgggccctgcccaggttcagcaggtccttactagcaatgttcagaccatttgcaatggaaccgtcagtgtggcttcctctccatccttcagtgctactgcacctgtggtgaccttttctcctcgcagttcacagctggttgctcacccacctggcactgtaatcacttcagttatcaaaactcaagaaacaaaaactcttacacaggaagtagagaaaaaggaatctgaagatcatttgaaagagaacactgagaaaacggagcagcagccacagccttatgtgatggtagtgtccagttccaatggatttacttctcaggtagctatgaaacaaaacgaactgctggaacccaactctttttagttaatataccaaagcttatgaataattgtttgttaattgaacattttcaattatatgcagactgactgattctaagataaattctaaggaggtttctaattttgtaattgttaaaaatagagttaattttgactttgttagatgagggaggaaaactcaactgtttctctttgttatctaaatgtttcagaattcaatcgtgaaggaacaggcattttacactatgaagacattcttttgagatttttatttcagttgctatatcataagcatttttaaagtttcttttctaattttacattgtattagattttctgattcttttgtaaatacagaacttaaatagaaggcaacaggaaatttatataggaactattttcattccacttgtgtaagttaagtcttgactctttcaaatgcaaaaaacctattttatgctttgttaaaattatggtgtcacttagattgactttagttgactgcactatataatatagaactatgaatatgtagaataacatgaaaaattggaggtgctggtggtatggctgaccctgtttcagaagcaggatagtataaaagcatcagcctaagaatggcactcccactaactagctatgtaatcttgacctctttgggctttagttcctctcataaaaggaagagatgtattggattagactagatgatcaccactttctcttctagttctaatttttttaattctaatacctatattttcaagttatgtcaattaaatcattatcaggttatttcctaatgtaagaatagctaaaatgttgcagagaaataagtgacccaacaaaatttattcatctgttatgggtaagatctgccataaattcttcctaaataatttgtttactaactctttaggccactgtgctttgcggtccattagtaaacttgtgttgctaagtgctaaacagaatactgctattttgagagagtcaagactctttcttaagggccaagaaagcaacttgagccttgggctaatctggctgagtagtcagttataaaagcataattgctttatattttggatcattttttactgggggcggacttggggggggttgcatacaaagataacatatatatccaactttctgaaatgaaatgtttttagattactttttcaactgtaaataatgtacatttaatgtcacaagaaaaaaatgtcttctgcaaattttctagtataacagaaatttttgtagatgaaaaaaatcattatgtttagaggtctaatgctatgttttcatattacagagtgaatttgtatttaaacaaaaatttaaattttggaatcctctaaacatttttgtatctttaattggtttattattaaataaatcatataaaaattctcagtgtctgttttcaggcaaaagtttcttaaagaataagtgtgcagagaatattactagaacatcagcattacttaatgtttataaataaatttcattagtcagaattgc

SEQ ID NO: 618 - DNA, 5250 bp, Homo sapiens
gccaagcatacatctctaattttattattttggtcttttcgttggattttccctttcttctttttttcgggttatcgctcagttttgagcagaggtttacattttttaaaaatttgctttccagcccgccttgatcttctaagtgcgagttcatcgtctgagaaaaaaaaaaatctctggttggcgtttttgtttcttttcttttctttcttttctttcctttttttttttttttaatttttttcaagggggaggagattttccacaagaaaaggttgttttcatgtttgggattcaggaaagcatccaacggagtggaagcagcatgaaggaagagccgctgggcagcggcatgaacgcggtgcggacgtggatgcagggcgccggggtgctggacgccaacacggcggcgcagagcggggtgggtctggcccgggctcactttgagaagcagccgccttccaatctgcggaaatccaacttcttccacttcgtcctggccctctacgacagacagggccagcccgtggagatcgagaggacagcgtttgtggggttcgtggagaaggaaaaagaagccaacagcgaaaagaccaataacggaattcactaccggcttcagcttctctacagcaatgggataaggacggagcaggatttctacgtgcgcctcattgactccatgacaaaacaagccatagtgtatgaaggccaagacaagaacccagaaatgtgccgagtcttgctcacacatgagatcatgtgcagccgctgttgtgacaagaaaagctgtggcaaccgaaatgagactccctcagatccagtgataattgacaggttcttcttgaaatttttcctcaaatgtaaccaaaattgcctaaagaatgcgggaaacccacgtgacatgcggagattccaggtcgtggtgtctacgacagtcaatgtggatggccatgtcctggcagtctctgataacatgtttgtccataataattccaagcatgggcggagggctcggaggcttgacccctcggaaggtacgccctcttatctggaacatgctactccctgtatcaaagccatcagcccgagtgaaggatggacgacgggaggtgcgactgtgatcatcataggggacaatttctttgatgggttacaggtcatattcggtaccatgctggtctggagtgagttgatcactcctcatgccatccgtgtgcagacccctcctcggcacatccctggtgttgtggaagtcacactgtcctacaaatctaagcagttctgcaaaggaacaccaggcagattcatttatacagcgctcaacgaacccaccatcgattatggtttccagaggttacagaaggtcattcctcggcaccctggtgaccctgagcgtttgccaaaggaagtaatactcaaaagggctgcggatctggtagaagcactgtatgggatgccacacaacaaccaggaaatcattctgaagagagcggccgacattgccgaggccctgtacagtgttccccgcaaccacaaccaactcccggcccttgctaacacctcggtccacgcagggatgatgggcgtgaattcgttcagtggacaactggccgtgaatgtctccgaggcatcacaagccaccaatcagggtttcacccgcaactcaagcagcgtatcaccacacgggtacgtgccgagcaccactccccagcagaccaactataactccgtcaccacgagcatgaacggatacggctctgccgcaatgtccaatttgggcggctcccccaccttcctcaacggctcagctgccaactccccctatgccatagtgccatccagccccaccatggcctcctccacaagcctcccctccaactgcagcagctcctcgggcatcttctccttctcaccagccaacatggtctcagccgtgaaacagaagagtgctttcgcaccagtcgtcagaccccagacctccccacctcccacctgcaccagcaccaacgggaacagcctgcaagcgatatctggcatgattgttcctcctatgtgaaagaattgccttgaagaattgtattaatgaagaggttggattctgctacagagagtaatctgatacaagtcccagagtggaacttttaactcaggcctttttaagaggaatcacaataactgcagatttttaaacaaacaaaatcaccgaccttgcaaatactgaaattggaagagggatctgcaagtgcagggtgttggttaaagttgtacctcccaagtatttgggggatatatttattctgtattgacaaaagcaaatccactttttctttttcttttttttttttaagcttaattctgcaatcatttgtcttttataaaccgtaaagctctatacaagggacactataaataagactccatgttttaatttatgatgtttttaaagctgtgtaaaggaagaatgaagtggtgatatttacaaaaaagtaaaaaaaaaaaaaaagaaaaaaaggaaaaaaaaaaaagcttgtatgggacagaataggaatgccagttagattttttagaaaaactaagggtcggcttttgcgccttaaagcatatcaaatggtagttagctcagacagtgcattttcaatatctaacttaacatgccaccccttagcagtgcaagcttatttatctcttttgtattgttgtcttaagcaactgtgtaaataaatgcagcctggaaagttaaaacgcgatgtaagtgatcacatttttccctctactcgaaaatccagtgcctctagacagattgttaaaactgcatatttaaatctgatctcattctctccttttacttaagtcagtttcttctgaagccgatggcctctcgagagcttggtggcacacatactgtgtgagaatctcctttgagacttcatggaacagggtccaggcacagaattccacactctgccctccagttaacaagccaaaacctcacgtacgctcccccatttgcaagtttaaagtttactcgtcctaaatgcagacttcatacctatcttccaaaagttgataaaagcaacgtggcaggtattttcgattttcccattccagatactgcctctatcagtcgacccttaccatttgtaacataatagattgaaacaacaggttaagtgctttggaattaagagttaaagggaaccgggggtggagaaaggaaaagaaggttgagacctccaaaacatagttttctgttctatgggaatttttgctctcattatctgggaagtgttcttaaaaataagaattaatagcaaagatgcagcaaagctctgaggatgcatttgcctgatatttttttctttgctcttgtgtttttgtatgtagttataaatactgtagattttttttttgtgattttttgccaaagttgttgttctatttatacattttaatgtcttaagacattttttcaatatcacaaaaagattttactgcgtattttgcaaagaaaaaaagctcactacctttagcttgcacatacttgcaaagttaattaaaaggctttttgttttaaaggggattttgtaaaatatccatataaataatgtatttatctttcgaatttgtacattgcttttcccttcttcctcttccttccacccccaatttattttattgtgtatgtttgctacgtgaaaagtgcgtatttgtttggtcacctacacttgtattagctgtttcaatgtgatttttaaacatttcatttatagttatttttagtattgttataaaccatgcttcagtttttttaatttccacccaaaagtcattgtctatttttgtattatttgtaagttaagaagttttttccaatatatggcaaaaaaaaaaaaatagtagcatattattcttgtagtatttagttcagtagatttaaaaaaaaatgtatcctttgctttggaagcttacaaaacaaccctaatgctgttttactctattaatatgcatggaatctctccctttggagtgacgcattttgtgcattaaattctagggagaaacttcatagaaatcaatgaacatactttctttcttaagtctgcttgtatatttcctctgtctttcacataaatataaaccagcagattggatgccttaacaatgcaaatcatattcatttcacttgtacattgtaactgtgcaccagaactgtcagtcatcactaacattctaagaaaaaagaaaaagaaaaaaagaaaaaaaaaaaaacaaagaaatcgaaaagcacaaaagaactgttttgttaccttaagacaatgtaactttttctagtagagcaagaaatcatttacaacaatgctgcaactgtgcatgcccccatatggattttgcaatggttttcactaggctgtcaagagtgcgatttttatgggttggggtgggtgggggaggggagttgtgggagggtaggggagggaggaaagctgtttttcatggtgagaaataataatgatgactaataataataaaaaaaactggaaaatgtaagcaaggtggacgcattgcttctcggtactcagaaaggttatctgaatttgcgtggtaagcgctggcctgaagatgtacacaagttaaagccatattttatctggtgagccccttaactgtttctgaaggaatgaacggtcagccgggaaggtgtccggcttagaccttgacaacagacactacccatctgtcagccatgtgcagtggttagaactcttcttgaaagtccaaagagcctttaaaatgtgtataatttgtgttttgttgcttctatttctattgattagatgaaaagacattctggccctctgatcctctttcttctccacaaaagttttacaaataaaagatgttcccctaaatacagaatatggctttaagaagaaaatgaaatgaagaattaaattaagatttcagtgttgggggaaaaaatacagcttctggatgactggattgcataacattgccctggcctcacattgtactaggatgcagcttaaatgaagtcatctctaaatctactaacctttcaccttcttatcaaaactttttgaatagacacacactgtacagttcaattgttagagaacctaactactgtagagattgttaaattttttttttttttttgcaaaaattcaagctgtaaaaacttttcaactttcacaatatttaattaaagttacttcctgtctgtga

SEQ ID NO: 619 - DNA, 5273 bp, Homo sapiens
aaccaaacaacccccaacagccaagcatacatctctaattttattattttggtcttttcgttggattttccctttcttctttttttcgggttatcgctcagttttgagcagaggtttacattttttaaaaatttgctttccagcccgccttgatcttctaagtgcgagttcatcgtctgagaaaaaaaaaaatctctggttggcgtttttgtttcttttcttttctttcttttctttcctttttttttttttttaatttttttcaagggggaggagattttccacaagaaaaggttgttttcatgtttgggattcaggaaagcatccaacggagtggaagcagcatgaaggaagagccgctgggcagcggcatgaacgcggtgcggacgtggatgcagggcgccggggtgctggacgccaacacggcggcgcagagcggggtgggtctggcccgggctcactttgagaagcagccgccttccaatctgcggaaatccaacttcttccacttcgtcctggccctctacgacagacagggccagcccgtggagatcgagaggacagcgtttgtggggttcgtggagaaggaaaaagaagccaacagcgaaaagaccaataacggaattcactaccggcttcagcttctctacagcaatgggataaggacggagcaggatttctacgtgcgcctcattgactccatgacaaaacaagccatagtgtatgaaggccaagacaagaacccagaaatgtgccgagtcttgctcacacatgagatcatgtgcagccgctgttgtgacaagaaaagctgtggcaaccgaaatgagactccctcagatccagtgataattgacaggttcttcctcaaatttttcctcaaatgtaaccaaaattgcctaaagaatgcgggaaacccacgtgacatgcggagattccaggtcgtggtgtctacgacagtcaatgtggatggccatgtcctggcagtctctgataacatgtttgtccataataattccaagcatgggcggagggctcggaggcttgacccctcggaaggtacgccctcttatctggaacatgctactccctgtatcaaagccatcagcccgagtgaaggatggacgacgggaggtgcgactgtgatcatcataggggacaatttctttgatgggttacaggtcatattcggtaccatgctggtctggagtgagttgatcactcctcatgccatccgtgtgcagacccctcctcggcacatccctggtgttgtggaagtcacactgtcctacaaatctaagcagttctgcaaaggaacaccaggcagattcatttatacagcgctcaacgaacccaccatcgattatggtttccagaggttacagaaggtcattcctcggcaccctggtgaccctgagcgtttgccaaaggaagtaatactcaaaagggctgcggatctggtagaagcactgtatgggatgccacacaacaaccaggaaatcattctgaagagagcggccgacattgccgaggccctgtacagtgttccccgcaaccacaaccaactcccggcccttgctaacacctcggtccacgcagggatgatgggcgtgaattcgttcagtggacaactggccgtgaatgtctccgaggcatcacaagccaccaatcagggtttcacccgcaactcaagcagcgtatcaccacacgggtacgtgccgagcaccactccccagcagaccaactataactccgtcaccacgagcatgaacggatacggctctgccgcaatgtccaatttgggcggctcccccaccttcctcaacggctcagctgccaactccccctatgccatagtgccatccagccccaccatggcctcctccacaagcctcccctccaactgcagcagctcctcgggcatcttctccttctcaccagccaacatggtctcagccgtgaaacagaagagtgctttcgcaccagtcgtcagaccccagacctccccacctcccacctgcaccagcaccaacgggaacagcctgcaagcgatatctggcatgattgttcctcctatgtgaaagaattgccttgaagaattgtattaatgaagaggttggattctgctacagagagtaatctgatacaagtcccagagtggaacttttaactcaggcctttttaagaggaatcacaataactgcagatttttaaacaaacaaaatcaccgaccttgcaaatactgaaattggaagagggatctgcaagtgcagggtgttggttaaagttgtacctcccaagtatttgggggatatatttattctgtattgacaaaagcaaatccactttttctttttcttttttttttttaagcttaattctgcaatcatttgtcttttataaaccgtaaagctctatacaagggacactataaataagactccatgttttaatttatgatgtttttaaagctgtgtaaaggaagaatgaagtggtgatatttacaaaaaagtaaaaaaaaaaaaaaagaaaaaaaggaaaaaaaaaaaagcttgtatgggacagaataggaatgccagttagattttttagaaaaactaagggtcggcttttgcgccttaaagcatatcaaatggtagttagctcagacagtgcattttcaatatctaacttaacatgccaccccttagcagtgcaagcttatttatctcttttgtattgttgtcttaagcaactgtgtaaataaatgcagcctggaaagttaaaacgcgatgtaagtgatcacatttttccctctactcgaaaatccagtgcctctagacagattgttaaaactgcatatttaaatctgatctcattctctccttttacttaagtcagtttcttctgaagccgatggcctctcgagagcttggtggcacacatactgtgtgagaatctcctttgagacttcatggaacagggtccaggcacagaattccacactctgccctccagttaacaagccaaaacctcacgtacgctcccccatttgcaagtttaaagtttactcgtcctaaatgcagacttcatacctatcttccaaaagttgataaaagcaacgtggcaggtattttcgattttcccattccagatactgcctctatcagtcgacccttaccatttgtaacataatagattgaaacaacaggttaagtgctttggaattaagagttaaagggaaccgggggtggagaaaggaaaagaaggttgagacctccaaaacatagttttctgttctatgggaatttttgctctcattatctgggaagtgttcttaaaaataagaattaatagcaaagatgcagcaaagctctgaggatgcatttgcctgatatttttttctttgctcttgtgtttttgtatgtagttataaatactgtagattttttttttgtgattttttgccaaagttgttgttctatttatacattttaatgtcttaagacattttttcaatatcacaaaaagattttactgcgtattttgcaaagaaaaaaagctcactacctttagcttgcacatacttgcaaagttaattaaaaggctttttgttttaaaggggattttgtaaaatatccatataaataatgtatttatctttcgaatttgtacattgcttttcccttcttcctcttccttccacccccaatttattttattgtgtatgtttgctacgtgaaaagtgcgtatttgtttggtcacctacacttgtattagctgtttcaatgtgatttttaaacatttcatttatagttatttttagtattgttataaaccatgcttcagtttttttaatttccacccaaaagtcattgtctatttttgtattatttgtaagttaagaagttttttccaatatatggcaaaaaaaaaaaaatagtagcatattattcttgtagtatttagttcagtagatttaaaaaaaaatgtatcctttgctttggaagcttacaaaacaaccctaatgctgttttactctattaatatgcatggaatctctccctttggagtgacgcattttgtgcattaaattctagggagaaacttcatagaaatcaatgaacatactttctttcttaagtctgcttgtatatttcctctgtctttcacataaatataaaccagcagattggatgccttaacaatgcaaatcatattcatttcacttgtacattgtaactgtgcaccagaactgtcagtcatcactaacattctaagaaaaaagaaaaagaaaaaaagaaaaaaaaaaaaacaaagaaatcgaaaagcacaaaagaactgttttgttaccttaagacaatgtaactttttctagtagagcaagaaatcatttacaacaatgctgcaactgtgcatgcccccatatggattttgcaatggttttcactaggctgtcaagagtgcgatttttatgggttggggtgggtgggggaggggagttgtgggagggtaggggagggaggaaagctgtttttcatggtgagaaataataatgatgactaataataataaaaaaaactggaaaatgtaagcaaggtggacgcattgcttctcggtactcagaaaggttatctgaatttgcgtggtaagcgctggcctgaagatgtacacaagttaaagccatattttatctggtgagccccttaactgtttctgaaggaatgaacggtcagccgggaaggtgtccggcttagaccttgacaacagacactacccatctgtcagccatgtgcagtggttagaactcttcttgaaagtccaaagagcctttaaaatgtgtataatttgtgttttgttgcttctatttctattgattagatgaaaagacattctggccctctgatcctctttcttctccacaaaagttttacaaataaaagatgttcccctaaatacagaatatggctttaagaagaaaatgaaatgaagaattaaattaagatttcagtgttgggggaaaaaatacagcttctggatgactggattgcataacattgccctggcctcacattgtactaggatgcagcttaaatgaagtcatctctaaatctactaacctttcaccttcttatcaaaactttttgaatagacacacactgtacagttcaattgttagagaacctaactactgtagagattgttaaattttttttttttttttgcaaaaattcaagctgtaaaaacttttcaactttcacaatatttaattaaagttacttcctgtctgtgatggc

SEQ ID NO: 620 - DNA, 2345 bp, Homo sapiens
gggttatcgctcagttttgagcagaggtttacattttttaaaaatttgctttccagcccgccttgatcttctaagtgcgagttcatcgtctgagaaaaaaaaaaatctctggttggcgtttttgtttcttttcttttctttcttttctttcctttttttttttttttaatttttttcaagggggaggagattttccacaagaaaaggttgttttcatgtttgggattcaggaaagcatccaacggagtggaagcagcatgaaggaagagccgctgggcagcggcatgaacgcggtgcggacgtggatgcagggcgccggggtgctggacgccaacacggcggcgcagagcggggtgggtctggcccgggctcactttgagaagcagccgccttccaatctgcggaaatccaacttcttccacttcgtcctggccctctacgacagacagggccagcccgtggagatcgagaggacagcgtttgtggggttcgtggagaaggaaaaagaagccaacagcgaaaagaccaataacggaattcactaccggcttcagcttctctacagcaatgggataaggacggagcaggatttctacgtgcgcctcattgactccatgacaaaacaagccatagtgtatgaaggccaagacaagaacccagaaatgtgccgagtcttgctcacacatgagatcatgtgcaggttcttcttgaaatttttcctcaaatgtaaccaaaattgcctaaagaatgcgggaaacccacgtgacatgcggagattccaggtcgtggtgtctacgacagtcaatgtggatggccatgtcctggcagtctctgataacatgtttgtccataataattccaagcatgggcggagggctcggaggcttgacccctcggaagctactccctgtatcaaagccatcagcccgagtgaaggatggacgacgggaggtgcgactgtgatcatcataggggacaatttctttgatgggttacaggtcatattcggtaccatgctggtctggagtgagttgatcactcctcatgccatccgtgtgcagacccctcctcggcacatccctggtgttgtggaagtcacactgtcctacaaatctaagcagttctgcaaaggaacaccaggcagattcatttatacagcgctcaacgaacccaccatcgattatggtttccagaggttacagaaggtcattcctcggcaccctggtgaccctgagcgtttgccaaaggaagtaatactcaaaagggctgcggatctggtagaagcactgtatgggatgccacacaacaaccaggaaatcattctgaagagagcggccgacattgccgaggccctgtacagtgttccccgcaaccacaaccaactcccggcccttgctaacacctcggtccacgcagggatgatgggcgtgaattcgttcagtggacaactggccgtgaatgtctccgaggcatcacaagccaccaatcagggtttcacccgcaactcaagcagcgtatcaccacacgggtacgtgccgagcaccactccccagcagaccaactataactccgtcaccacgagcatgaacggatacggctctgccgcaatgtccaatttgggcggctcccccaccttcctcaacggctcagctgccaactccccctatgccatagtgccatccagccccaccatggcctcctccacaagcctcccctccaactgcagcagctcctcgggcatcttctccttctcaccagccaacatggtctcagccgtgaaacagaagagtgctttcgcaccagtcgtcagaccccagacctccccacctcccacctgcaccagcaccaacgggaacagcctgcaagcgatatctggcatgattgttcctcctatgtgaaagaattgccttgaagaattgtattaatgaagaggttggattctgctacagagagtaatctgatacaagtcccagagtggaacttttaactcaggcctttttaagaggaatcacaataactgcagatttttaaacaaacaaaatcaccgaccttgcaaatactgaaattggaagagggatctgcaagtgcagggtgttggttaaagttgtacctcccaagtatttgggggatatatttattctgtattgacaaaagcaaatccactttttctttttcttttttttttttaagcttaattctgcaatcatttgtcttttataaaccgtaaagctctatacaagggacactataaataagactccatgttttaatttatgatgtttttaaagctgtgtaaaggaagaatgaagtggtgatatttacaaaaaagtaaaaaaaaaaaaaaa

SEQ ID NO: 621 - DNA, 4869 bp, Homo sapiens
aacagcgtcctagagacgccgaatgggcagcccctctgagaccccgcggcttggggtccgcgcacgcgggtgccggcccagctaggcggagaatcgaggaggggttcccgggctcatcgcagaggattggaagggcctagattactgcccaatgacaaaagtgtgggcttaatgtcctcactcttcagggagagaatgtggactttagcatttgaactgaatatttgagattgaagatttctgaataggatttaatgtgcaaaatggcgattataccagactggcttaggtcgcatcctcacacacgaaaatttacacattcaagaccccattcttcaccgtgtagagtatattcaaggaatggttccccaaataagttcagatcttcttcaaccacagctgttgcaaatccaacactgtcctccttagatgttaaacggattttatttcaaaaaattaccgacagaggggatgagttgcaaaaagcctttcagctgctggatactggtcagaacttgactgtgtcaaaaagtgaactgagaagaatcatcacagacttcctgatgccgctcacacgagaacagtttcaggacgtgttggctcagatcccccttagcacctctggtactgtaccgtaccttgcctttctgtccaggtttggtggaattgacctatatataaatggtataaagaggggaggtgggaatgaaatgaattgctgccgcacattaagagaacttgaaatccaagtgggagaaaaggttttcaaaaacattaagactgttatgaaagcctttgagctcattgatgttaacaagactggactggttcgaccgcaggagctaagaagggttctggagaccttctgtatgaagttaagagacgaggaatacgaaaagttttcgaaacactacaacatccacaaggatactgcagtagattacaacgtgtttttgaagaatctcagcataaataacgacttgaaccttagatattgtatgggaaatcaagaggtctcgttggagaatcaacaagccaaaaattccaaaaaggaacgtttgctaggttctgcatcatctgaagatatctggagaaactactccttggatgaaattgagaggaacttttgtctacaactttcgaagtcttatgaaaaggttgaaaaggccctcagtgcaggggacccctgtaaaggtggctacgtgtcttttaattatctaaagattgtcctcgacacttttgtataccaaataccaagaagaatttttatccagttaatgaaaagatttggacttaaagccaccactaaaatcaattggaagcaatttctaacatcatttcatgagcctcaggggttgcaagttagcagtaaaggtcccctgacaaaaagaaatagcatcaactctagaaatgaatctcacaaggaaaacatcatcacaaagttatttagacacactgaagatcactctgcgtcactgaagaaagcattactgataatcaacactaaacccgatggaccgataacaagagaagaatttcgatatattctaaattgcatggctgtaaaactaagcgattcagaattcaaagaactaatgcaaatgcttgaccctggggacactggagtggtcaacaccagcatgtttattgatctgattgaagagaactgtaggatgagaaagacatctccctgtacagatgctaagacacctttcctcctggcctgggattcagtggaagaaattgttcatgatacaattactaggaacctacaagctttttataacatgctacgctcatatgaccttggagacacagggcgcattggccgaaataatttcaagaaaatcatgcacgtcttctgtccatttttaacgaatgcacatttcataaaactctgcagtaagattcaggacattggttcaggaagaatcctttacaagaaacttttggcatgcataggaattgatggcccacccactgtctctccagttcttgttccaaaggatcagctgttaagtgaacatttacaaaaagatgaacagcagcagccagatctttctgagagaaccaagctcacggaggataaaaccaccctgaccaagaagatgaccacagaagaagtgattgaaaaattcaaaaagtgtatacagcagcaggacccggcattcaaaaaacgatttcttgacttcagcaaggagcctaatggaaaaattaacgtgcatgactttaagaaggtactggaagacactgggatgcccatggacgatgatcagtatgccctgctgaccactaaaataggcttcgagaaggaagggatgagctatcttgattttgcagcaggatttgaagatcctccaatgagagggccggaaaccactccgccgcagcctccaactccttcaaaaagttacgtgaacagccactttatcaccgcagaagaatgcctgaagcttttccctaggaggctgaaggagtcattccgggacccctactctgccttctttaaaacagatgctgacagggatggcataatcaacatgcatgaccttcacagactgctcctgcatctactgcttaatctcaaagacgacgagtttgagcgcttccttggccttcttggcttgagacttagtgtcactttaaattttcgggaatttcaaaatttgtgtgagaagagaccatggagaacagatgaagcgcctcaaagactcattagaccaaaacagaaggttgcggattcagaactagcttgtgagcaggctcatcagtatcttgttaccaaagcaaaaaacagatggtcagacttgtctaagaattttctagaaaccgataatgagggcaatggcattcttcgacgccgggacataaagaacgcactgtacggttttgatattcccctcacaccaagagagtttgaaaagctttgggcaagatacgacaccgagggaaaagggcacattacttaccaggaatttttacagaaattgggtattaactattcgcctgctgtccatcggccctgtgcagaggattatttcaacttcatgggtcattttacaaagccacagcagctacaggaagagatgaaggagctgcagcagagcacagagaaggctgtggcagccagggataagcttatggaccgccatcaagatatcagcaaagcattcaccaaaactgatcaatccaaaaccaactacatatccatatgcaagatgcaggaagtgctggaagaatgtggatgttctcttaccgaaggggagctgacccatctgctaaacagttggggagtcagccggcatgataatgctatcaattacctcgacttcctgagagcagtggagaacagcaagtcaacaggagctcagcccaaggaaaaagaagagagcatgccaatcaattttgcaacgctgaatccacaggaggctgtgaggaagatccaggaagtagttgagtcctcccagctggctttgtccacggcattttctgcattggataaagaggatacaggatttgtaaaggctacagaattcggacaagttcttaaggatttctgttacaaactaacggacaatcagtatcattattttttgaggaaactaagaattcatctaaccccctatataaattggaaatattttctccagaactttagctgtttccttgaggagacagctgatgagtgggctgagaaaatgcccaaaggcccgccgcctacctctcccaaggccacagccgacagagacatcctggctcgcctccacaaagcagtgacttcccattaccatgccatcacccaggagtttgagaattttgacaccatgaaaacgaacaccatctccagagaggagtttagggccatttgtaatcgccgcgtccaaatcctgacggacgaacagtttgacagactctggaacgagatgccagtcaatgccaaggggaggctgaaatacccggacttcctgagcaggttcagttccgagacagcagccacaccaatggccactggtgactcggccgtggcccagagagggagcagtgtccctgacgtctcggaaggcaccagatctgccctctcattgcccactcaggagctgagaccagggtcaaagtcgcagagccacccctgtactccagcgagcaccaccgtgatcccgggcactccacccttgcagaactgtgatcccatagagagcaggctccggaagagaatccagggctgctggcgccagctcctgaaagaatgcaaggagaaggacgtggccagacagggggacatcaacgcctccgatttcctggctcttgtggagaaattcaacctggacataagcaaagaggagtgtcagcagctcattataaaatacgacttaaagagcaacgggaaatttgcatactgtgacttcattcagagctgtgtcctcctgctaaaagcaaaggaaagctcactgatgcacaggatgaagatccagaatgcacacaagatgaaagaagccggcgcggagacgccatctttttactctgctctgctgcgtattcagcccaaaattgtgcactgctggaggccaatgcggcgcacgttcaaaagctatgatgaggctggaacagggctgctaagcgtcgcagatttcaggacggtcctgagacagtacagcatcaacctctctgaggaagagttcttccatattctggagtattacgataagacgctgtcttcaaaaatctcctacaacgacttcctccgggcattcctccagtagacacccctgctgtgtgcccagcgggacgacagccacagggcctgtttcaaggctaataaaatcctataatttgggggtttcatgaattttcaaaaaaaacaaaactcaa

SEQ ID NO: 622 - DNA, 1069 bp, Homo sapiens
accccgcggcttggggtccgcgcacgcgggtgccggcccagctaggcggagaatcgaggaggggttcccgggatttaatgtgcaaaatggcgattataccagactggcttaggtcgcatcctcacacacgaaaatttacacattcaagaccccattcttcaccgtgtagagtatattcaaggaatggttccccaaataagttcagatcttcttcaaatcccccttagcacctctggtactgtaccgtaccttgcctttctgtccaggtttggtggaattgacctatatataaatggtataaagaggggaggtgggaatgaaatgaattgctgccgcacattaagagaacttgaaatccaagtgggagaaaaggttttcaaaaacattaagactgttatgaaagcctttgagctcattgatgttaacaagactggactggttcgaccgcaggagctaagaagggttctggagaccttctgtatgaagttaagagacgaggaatacgaaaagttttcgaaacactacaacatccacaaggatactgcagtagattacaacgtgtttttgaagaatctcagcataaataacgacttgaaccttagatattgtatgggaaatcaagaggtctcgttggagaatcaacaagccaaaaattccaaaaaggaacgtttgctaggttctgcatcatctgaagatatctggagaaactactccttggatgaaattgagaggaacttttgtctacaactttcgaagtcttatgaaaaggttgaaaaggccctcagtgcaggggacccctgtaaaggtggctacgtgtcttttaattatctaaagattgtcctcgacacttttgtataccaaataccaagaagaatttttatccagttaatgaaaagaaacccgatggaccgataacaagagaagaatttcgatatattctaaattgcatggctgtaaaactaagcgattcagaattcaaagaactaatgcaaatgcttgaccctggggacactggagtggtcaacaccagcatgtttattgatctgattgaagagaactgtagggtgag

SEQ ID NO: 623 - DNA, 4424 bp, Homo sapiens
ggagaatcgaggaggggttcccgggctcatcgcagaggattggaagggcctagattactgcccaatgacaaaagtgtgggcttaatgtcctcactcttcagggagagaatgtggactttagcatttgaactgaatatttgagattgaagatttctgaataatcccccttagcacctctggtactgtaccgtaccttgcctttctgtccaggtttggtggaattgacctatatataaatggtataaagaggggaggtgggaatgaaatgaattgctgccgcacattaagagaacttgaaatccaagtgggagaaaaggttttcaaaaacattaagactgttatgaaagcctttgagctcattgatgttaacaagactggactggttcgaccgcaggagctaagaagggttctggagaccttctgtatgaagttaagagacgaggaatacgaaaagttttcgaaacactacaacatccacaaggatactgcagtagattacaacgtgtttttgaagaatctcagcataaataacgacttgaaccttagatattgtatgggaaatcaagaggtctcgttggagaatcaacaagccaaaaattccaaaaaggaacgtttgctaggttctgcatcatctgaagatatctggagaaactactccttggatgaaattgagaggaacttttgtctacaactttcgaagtcttatgaaaaggttgaaaaggccctcagtgcaggggacccctgtaaaggtggctacgtgtcttttaattatctaaagattgtcctcgacacttttgtataccaaataccaagaagaatttttatccagttaatgaaaagatttggacttaaagccaccactaaaatcaattggaagcaatttctaacatcatttcatgagcctcaggggttgcaagttagcagtaaaggtcccctgacaaaaagaaatagcatcaactctagaaatgaatctcacaaggaaaacatcatcacaaagttatttagacacactgaagatcactctgcgtcactgaagaaagcattactgataatcaacactaaacccgatggaccgataacaagagaagaatttcgatatattctaaattgcatggctgtaaaactaagcgattcagaattcaaagaactaatgcaaatgcttgaccctggggacactggagtggtcaacaccagcatgtttattgatctgattgaagagaactgtaggatgagaaagacatctccctgtacagatgctaagacacctttcctcctggcctgggattcagtggaagaaattgttcatgatacaattactaggaacctacaagctttttataacatgctacgctcatatgaccttggagacacagggcgcattggccgaaataatttcaagaaaatcatgcacgtcttctgtccatttttaacgaatgcacatttcataaaactctgcagtaagattcaggacattggttcaggaagaatcctttacaagaaacttttggcatgcataggaattgatggcccacccactgtctctccagttcttgttccaaaggatcagctgttaagtgaacatttacaaaaagatgaacagcagcagccagatctttctgagagaaccaagctcacggaggataaaaccaccctgaccaagaagatgaccacagaagaagtgattgaaaaattcaaaaagtgtatacagcagcaggacccggcattcaaaaaacgatttcttgacttcagcaaggagcctaatggaaaaattaacgtgcatgactttaagaaggtactggaagacactgggatgcccatggacgatgatcagtatgccctgctgaccactaaaataggcttcgagaaggaagggatgagctatcttgattttgcagcaggatttgaagatcctccaatgagagggccggaaaccactccgccgcagcctccaactccttcaaaaagttacgtgaacagccactttatcaccgcagaagaatgcctgaagcttttccctaggaggctgaaggagtcattccgggacccctactctgccttctttaaaacagatgctgacagggatggcataatcaacatgcatgaccttcacagactgctcctgcatctactgcttaatctcaaagacgacgagtttgagcgcttccttggccttcttggcttgagacttagtgtcactttaaattttcgggaatttcaaaatttgtgtgagaagagaccatggagaacagatgaagcgcctcaaagactcattagaccaaaacagaaggttgcggattcagaactagcttgtgagcaggctcatcagtatcttgttaccaaagcaaaaaacagatggtcagacttgtctaagaattttctagaaaccgataatgagggcaatggcattcttcgacgccgggacataaagaacgcactgtacggttttgatattcccctcacaccaagagagtttgaaaagctttgggcaagatacgacaccgagggaaaagggcacattacttaccaggaatttttacagaaattgggtattaactattcgcctgctgtccatcggccctgtgcagaggattatttcaacttcatgggtcattttacaaagccacagcagctacaggaagagatgaaggagctgcagcagagcacagagaaggctgtggcagccagggataagcttatggaccgccatcaagatatcagcaaagcattcaccaaaactgatcaatccaaaaccaactacatatccatatgcaagatgcaggaagtgctggaagaatgtggatgttctcttaccgaaggggagctgacccatctgctaaacagttggggagtcagccggcatgataatgctatcaattacctcgacttcctgagagcagtggagaacagcaagtcaacaggagctcagcccaaggaaaaagaagagagcatgccaatcaattttgcaacgctgaatccacaggaggctgtgaggaagatccaggaagtagttgagtcctcccagctggctttgtccacggcattttctgcattggataaagaggatacaggatttgtaaaggctacagaattcggacaagttcttaaggatttctgttacaaactaacggacaatcagtatcattattttttgaggaaactaagaattcatctaaccccctatataaattggaaatattttctccagaactttagctgtttccttgaggagacagctgatgagtgggctgagaaaatgcccaaaggcccgccgcctacctctcccaaggccacagccgacagagacatcctggctcgcctccacaaagcagtgacttcccattaccatgccatcacccaggagtttgagaattttgacaccatgaaaacgaacaccatctccagagaggagtttagggccatttgtaatcgccgcgtccaaatcctgacggacgaacagtttgacagactctggaacgagatgccagtcaatgccaaggggaggctgaaatacccggacttcctgagcaggttcagttccgagacagcagccacaccaatggccactggtgactcggccgtggcccagagagggagcagtgtccctgacgtctcggaaggcaccagatctgccctctcattgcccactcaggagctgagaccagggtcaaagtcgcagagccacccctgtactccagcgagcaccaccgtgatcccgggcactccacccttgcagaactgtgatcccatagagagcaggctccggaagagaatccagggctgctggcgccagctcctgaaagaatgcaaggagaaggacgtggccagacagggggacatcaacgcctccgatttcctggctcttgtggagaaattcaacctggacataagcaaagaggagtgtcagcagctcattataaaatacgacttaaagagcaacgggaaatttgcatactgtgacttcattcagagctgtgtcctcctgctaaaagcaaaggaaagctcactgatgcacaggatgaagatccagaatgcacacaagatgaaagaagccggcgcggagacgccatctttttactctgctctgctgcgtattcagcccaaaattgtgcactgctggaggccaatgcggcgcacgttcaaaagctatgatgaggctggaacagggctgctaagcgtcgcagatttcaggacggtcctgagacagtacagcatcaacctctctgaggaagagttcttccatattctggagtattacgataagacgctgtcttcaaaaatctcctacaacgacttcctccgggcattcctccagtagacacccctgctgtgtgcccagcgggacgacagccacagggcctgtttcaaggctaataaaatcctataatttgggggtttcatgaattttcaaaaaaaacaaaactcaa

SEQ ID NO: 624 - DNA, 992 bp, Homo sapiens
agctgcttcaggctgaggtggcagatagtgagcgctggtggcggagttaaagtcaaagcaggagagtaattatgaatagcgcagcgggattctcacacctagaccgtcgcgagcgggttctcaagttaggggagagtttcgagaagcagccgcgctgcgccttccacactgtgcgctatgacttcaaacctgcttctattgacacttcttctgaaggataccttgaggttggtgaaggtgaacaggtgaccataactctgccaaatatagaaggttcaactccaccagtaactgttttcaaaggttcaaaaaaaccttacttaaaagaatgcattttgattattaaccatgatactggagaatgtcggctagaaaaactcagcagcaacatcactgtaaaaaaaacaagagttgaaggaagcagtaaaattcagtatcgtaaagaacaacagcaacaacaaatgtggaattcagccaggactcccaatcttgtaaaacattctccatctgaagataagatgtccccagcatctccaatagatgatatcgaaagagaactgaaggcagaagctagtctaatggaccagatgagtagttgtgatagttcatcagattccaaaagttcatcatcttcaagtagtgaggatagttctagtgactcagaagatgaagattgcaaatcctctacttctgatacagggaattgtgtctcaggacatcctaccatgacacagtacaggattcctgatatagatgccagtcataatagatttcgagacaacagtggccttctgatgaatactttaagaaatgatttgcagctgagtgaatcaggaagtgacagtgatgactgaagaaatatttagctataaataaaaatttatacagcatgtataatttattttgtattaacaataaaaattcctaagactgagggaaatatgtcttaacttttgatgataaaagaaattaaatttgattcagaaatttca

SEQ ID NO: 625 - DNA, 960 bp, Homo sapiens
agatagtgagcgctggtggcggagttaaagtcaaagcaggagagtaattatgaatagcgcagcgggattctcacacctagaccgtcgcgagcgggttctcaagttaggggagagtttcgagaagcagccgcgctgcgccttccacactgtgcgctatgacttcaaacctgcttctattgacacttcttctgaaggataccttgaggttggtgaaggtgaacaggtgaccataactctgccaaatatagaaggttcaactccaccagtaactgttttcaaaggttcaaaaaaaccttacttaaaagaatgcattttgattattaaccatgatactggagaatgtcggctagaaaaactcagcagcaacatcactgtaaaaaaaacaagagttgaaggaagcagtaaaattcagtatcgtaaagaacaacagcaacaacaaatgtggaattcagccaggactcccaatcttgtaaaacattctccatctgaagataagatgtccccagcatctccaatagatgatatcgaaagagaactgaaggcagaagctagtctaatggaccagatgagtagttgtgatagttcatcagattccaaaagttcatcatcttcaagtagtgaggatagttctagtgactcagaagatgaagattgcaaatcctctacttctgatacagggaattgtgtctcaggacatcctaccatgacacagtacaggattcctgatatagatgccagtcataatagatttcgagacaacagtggccttctgatgaatactttaaataatctttcctctcactccttttcaagtttatatgatcctctgctcagtcattaaagttggagtttctcaaggcttacttttgggttctttttttcttttcattctacaatttctccctaaataacttcctccatgtttctgttgcagtcaatacttatgtgtaggtaacttgc

SEQ ID NO: 626 - DNA, 1019 bp, Homo sapiens
gaagtcactatctcccgggtgaacggagctttcgcagctggagaaggctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtgtgtgtgtgtgtgtgtgtgtgtgtgtgtgtgtgtgtgtgtgtgtgtagtgggtgtgcgtgtgggtgtgggtgtgagtgagtgtgggtgtgtgtggctgcacgtgtcactggggtggccgtgagtgtgtgctcacaggtacgcggtggtgtcgggttcctgggcctgaggggcctgaactgatctcacttggctccgaaagcctttgctgtgttccctgcagcccctggccccccagccttggggctctggctccccccggcggaattgggggactgtttcctgacatcctggacaagggaagcccactagaggctggaacaggacctctccagcctcctcaccagcaccgtgcccatctcaactggacttcccgctctccttctccaccttctagtgcccgtggccggggattcaaagccgccgttccccaggtccctgggctgggccctgacagggagccgcccccctccccatggtaaccaggaagcccgtttcatgttcagttgcttttgtagaggaagcaagggctgggatggggacagctgtcaatcacaagcccttaaataaagcagccagcgcacatcc

SEQ ID NO: 627 - DNA, 2922 bp, Homo sapiens
ggaaatgcgtgttctagctttctgtgtgcttaggtgcccgagctactgagggtctaagtccgggcagccgaagagtgtggtaggtaacggtcctcagcgcaagggtcatttcgtcgctgggaagggacggccctcgcccgcggtgatggtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatgagtttgaagtttgcttggattttgaaatgaatgggactttgtctttattactaattcaccaaatttgttgagcgcaaaagcaattaatgtagtttaagtatttagtatgtacagttctctgtgttaacagctgagaagtaagcaaccttttctgactgcatatggtgtattcctcttttgagtccccataatattttataaattgtaatgccccatcttgtactacagttgtcttattcgtattgtttataaactttgagggttaggactgggtcttactcatctttatgtgccttccttatgcttcaaagaatttaccatctaatggaagagaacatttgcaagttggctccataccaagctccttccacatactctactcatctgaactttgaatgcagaatctttaaattgcaaccccacatactaaggtcaagaaagaacttaatgggaattaatctccacccattagctttaccctgacatcaggattgccaaatccaatggactcttgtctattcttacgtgacttctgctggaaaatgcgaatgttgaccatcctgccacttggaactctcttcccactcctcacattgcttttgctaccactggaagttccttctgtttcttgtggagtaccttttgctgtctgggacttgtagataatggtgtttcctagggctccctccagggccctctgcctcactaactggatatacttttcctgagcaaatcccaggaaacttgcgtcagaccgtgacttcaaatacaggttgataaatgctaaactgtctccaaaccagacttcatcctagcctccacacccagacacccaactgctatggatcaactttttagaatatcctcacttcaaactgaccttacctaaaataatgactttttcccccaataattgcccctgctatattccttatttctgaatggtacctcctagctatatagattatctgaggagcttactgaaatgctgattctgaagataaggggcatggctttaagattctgtatttctggcgagtacccaactggtgctcatgctgctgattgagaaccacttctgaatatagcaaggctgtaaattatccactacgtgccctcgtaattgtcttagttcaagcccagattattgtagtagacttagtatttctttgccttagttgatctgtgacccctccaatatctattccacactgttgcctaagtggccttagtaaaattcaagtctggttattttattcccctgcttggaatttctcaatgtagaatgaaactcattcagcattaacacataggcccttcttgatctgacatcgtgtttctctagttagactaaagaatccccactatgaagttgtttcatccgtaagtacctttgaacccagaagccccctttctcatatgtttctcattcctgtttgcccttcagagttcagctttagttgctaaaacattcagacatccctctgacttagatcccccactactgtttttctgtgagaagcagctatgcataattcctcttcaacacagtagttcttgaaattttgcaggcctctcctggaaaggaggaaatgacttctctgactttgtatgatgcttatttgtggatgaatgggcaagggaaaaaatgaaggaacaagtgaatgaacagtatgggagtatgagaaaaggtataaattgggtatagttgagaaaaggattcaaattgatctttggttcgagagacaatttcatctttctgatgaatttaaagtgtagtctttgaaccagctgggcttaattatgtaaagttttgagcctgagataagcacacaatcacaaaacctacccaaacaagttttttgtttcacttcatctcttataaaacaatgttctaaagtaagtgatagggatgctcatcattctgctacctattatcacaatgaaaacaatcataaatagtacacaggaaaggtgagaaatagcggatagttcttatttcatagtactgtatatggaaataaaccaaatttgctcatagagatactattttattacctcaaaaatatataaaaatgaaaacgttatgaaaatattttaaaatgggatttaaaaataattgagaacatcacagcaatttagaatactaaagagcatagctttaaaatgatagtgctgagaactccccacctctaccccaccacctgtaggcttctttgacaacttacaaatgttctctagtttgtatctagaatcacttatatctttcaaataaaccaactttgtgaa

SEQ ID NO: 628 - DNA, 562 bp, Homo sapiens
ggaaatgcgtgttctagctttctgtgtgcttaggtgcccgagctactgagggtctaagtccgggcagccgaagagtgtggttagcaagatgaacaaagatgcgcagatgagagcagcgattaaccaaaagttgatagaaactggagaaagagaacgcctcaaagagttgctgagagctaaattaattgaatgtggctggaaggatcagttgaaggcacactgtaaagaggtaattaaagaaaaaggactagaacacgttactgttgatgacttggtggctgaaatcactccaaaaggcagagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatga

SEQ ID NO: 629 - DNA, 1865 bp, Homo sapiens
gcatacagcagtgcagtgccgttattccagtctccgtagaaacgctgggactatggcggagccgactgggctgttggagatgtccgagctccccggagatagcagtgtcccacaggtgggcaccgcgagtggcgtcagcgacgtactgcggggggcagtcggcggcggggttcgggtgcaggaggctcgggaaggcccagtggccgaagctgcgcggtccatggcgcggatgccgggccctgtgcccgggcccatccccagcagcgtcccgggcctggcctccgcgccagacccccatcagcagctcgctttcttagaaattaaccggcagctgttgttccgcgagtatctggatggtagctccatgattccggtcagattactacgggatttcgaggaacgccgcaggctgtttgtggaaggctgcaaggcgagggaagcagcctttgacgcggatcccccgcagatggacttcgctgctgtcgcgtttacggtagcgctgactgcctccgaggccctcagtcctctggccgactgagtcggctgtgatgatgacattggtggcaaggaatagccaagtgacccttttgggatcaaaagaacaggcaggctgtgccagtttagttaactcagtcattagggggaatgcaaactggaagggaatacggcaatgtgcaattgaaggaggaagcacactccgaaatggaaacagacaagactgttgaatcttgttttctttcttcttttttagtattatttaaatagagaagggagtctcgcatccctaggctggtcccgaacgcttggacccgagcgatcctcccgcttcggcctcccaaagtgctgggattactttacaggcgtgagccaccgcgcccggccgaatcttgttttcaaacaggtcccaagacacttctgacttagcactttgttagcaatgcattttcctgcatttgtgaagaatccttcatgactttcaccataaaggatggttttgcaaagatatgagaaaaaaaaaatgccaataacagaacccatagaaatgaacctaagtgatgaaagaaaacaaagaaatagagttgtcaggaatccaggtgtacctgagttactaggattggaaggctattgagaggactttgaaatttcacaatttgtggtcatgtcaacaaatcctagtgtaagattcatatttgtgttttctgaggtactttagatgaacagtaaatattcaatagaaaaaaccacgtattatatgatcagtgttttcaagtctatgtgaaattgggtaggtgtggaataaacttgttttttgttaattttaagctttttattttattctagaatatgtattctattcacaagactcaacaaaaaaaagtatcggccgggcgcactggcttacgcctgtaatcccagcactttgggaggccacggcgggtggatcacctgaggtcaggaattcaagaccaccctggccaacatggtgaaaccccatctctacgaaaaataaaaaattaactgggtgtggtggcacgcgcttgtagtcccagctactcgggaggctgaggcaggagaatcacttgaacctgggaggcggaggttgcagtaagccgagatcacgccactgcactccagcctggtcaacagagtgggactccgtctcaaaaaaaagaaaaaaagtatcaaaagatgctgtgagaaatctctcttgttgctgtcctttgccaaactcagaactattccatgcaggtgccattgcttgtggcttggagttttgttgttgttttcttggttttgcttgttttttgctttttcactgtacgcctttcaggttttctaatgcatatgcaaataaacatcaatct

SEQ ID NO: 630 - DNA, 3216 bp, Homo sapiens
gcggacggtgagtggggatggactggagttgaagagctcgagatgaagggcttgagggcgtgtgttatttgttttcttcaagcatttggtcgagattaagaattaaaaatgtcatccaaacaagaaataatgagtgaccagcggtttagacgggttgcaaaggacccgagattttgggaaatgccagaaaaggatcgaaaagtcaaaattgacaagagatttcgagccatgtttcatgacaagaagttcaagttgaactatgccgtggataaaagagggcgccccattagccatagcactacagaggatttgaagcgtttttacgacctttcagattctgattccaatctctctggtgaagatagcaaagcattgagtcaaaagaaaataaagaagaaaaaaacccagactaaaaaagaaatcgattcaaaaaatctagttgagaaaaagaaagaaaccaagaaggctaatcacaagggttctgaaaataaaactgatttagataattctataggaattaaaaaaatgaaaacctcatgtaaatttaagatagattcaaacataagtccgaagaaggatagcaaagaatttacacaaaaaaataagaaagagaaaaaaaacattgttcaacatactacagactcttctctcgaagaaaaacaaaggacattagactcaggcacctctgaaattgtgaaatctcccagaatcgagtgttctaagacaagaagagaaatgcaatcagtggttcaactcataatgacaagagacagtgatggttatgaaaactcaacagatggtgaaatgtgtgacaaagatgctctggaggaagattcagaaagcgttagtgaaataggaagtgatgaggaatctgaaaatgaaattacaagtgttggtagagcttcaggtgatgacgatggaagtgaagatgatgaagaggaggatgaagatgaagaggaggatgaagatgaggatagtgaggatgatgataaaagtgacagtggccctgatcttgcaaggggtaaaggaaatatagaaactagttctgaagatgaagatgatacggcagatttgtttccagaagaatctggttttgagcatgcttggagagaattagataaagatgctcctcgtgctgatgagattacacgtcgattagcagtttgtaacatggactgggatagattaaaggcaaaagatttgctggctctgttcaattcatttaaacccaaaggaggtgtaatattttccgtcaagatatatccttcagaatttggaaaggagaggatgaaggaagagcaagttcaaggaccagtagagctattaagtattcctgaagatgccccagaaaaagactggacgtctagagaaaaattgagagattatcaattcaaacgactgaagtactattatgcagtagtagactgtgattctccggaaacagctagtaaaatttatgaggattgtgatggcctggaatttgaaagtagttgttctttcatagatctaaggtttataccagatgatattacttttgatgatgagcctaaggatgtagcctcagaagtgaatttaacagcatataaaccaaaatatttcacttctgctgcaatgggaacatcaacggtggaaatcacttgggatgagactgatcatgaaagaattacaatgctcaacaggaagtttaaaaaggaagagcttttggacatggattttcaagcctacttagcttcctctagtgaagatgaagaggagatagaagaggagctacaaggtgatgatggagtcaatgtagaagaagatgggaaaacaaagaaaagtcagaaggatgatgaagaacaaattgctaaatacaggcagctcttgcaggttattcaagaaaaagaaaagaaaggcaaagaaaatgatatggaaatggaaattaaatgggttccaggtcttaaagaaagtgcagaagagatggtcaaaaacaaattggaaggaaaggataaactgaccccttgggaacaatttttagagaagaagaaagagaaaaaaagactgaaaaggaaacagaaggctcttgctgaagaggccagtgaagaggaacttccctctgatgttgatttgaatgacccatactttgctgaagaagttaaacaaataggtataaataaaaaatcggtaaaatctgcaaaagatggcacatctccagaagaagaaattgaaatagaaagacaaaaggctgaaatggctttgcttatgatggatgaggacgaggacagtaagaaacacttcaattacaacaagattgtggagcaccagaatctgagcaaaaagaagaaaaagcagctcatgaaaaagaaggaattaatagaggatgactttgaggtaaatgttaacgatgcacggtttcaggcaatgtacacttcccacttgttcaatttggacccctcagatcccaatttcaagaaaacaaaagctatggaaaaaatccttgaggagaaggcccggcaaagagaacggaaagaacaagaacttactcaggcaataaagaaaaaagagagtgagattgaaaaggaatcacaaaggaagtccattgatcctgctttgtcaatgttgattaaatctataaaaaccaaaacagagcagtttcaagcaagaaaaaagcaaaaagtcaaataactggatgttacttatttttgaactgaatacatcttttcctaaaatgtacaaaaataataggagggaatatttattgggaacaaagctatctttcaagaacatgaataaaatctttttctggacatagtaaaatttttctccataaataattgtacttaattgtggatgactgacaaatttttattgtatattcctacagatcagtcataattaaattacctgcattatagggtttataaaatttttatattttacaatgttcagttctaactagtggaaagttactctagctttttaaaaggctgtttacaattctgtgtaaaaatagagcagtatctactcaagtttgtgtaaatgttagggataatttgaaaaatatatatatttaatacattaatttctctggaagcaggaggcatgtttaaataactattaaaataatttatttttctagccataaaggatggaagtcaagaactttttgttgtttagtcatgttaagtatagtttatgaaattaacttgtaaataaaagtgtaaaatattttcatta

SEQ ID NO: 631 - DNA, 330 bp, Homo sapiens
atgtcatccaaacaagaaataatgagtgaccagcggtttagacgggttgcaaaggacccgagattttgggaaatgccagaaaaggatcgaaaagtcaaaattgacaagagatttcgagccatgtttcatgacaagaagttcaagttgaactatgccgtggataaaagagggcgccccattagccatagcactacagaggatttgaagcgtttttacgacctttcagattctgattccaatctctctggtgaagatagcaaagcattgagtcaaaagaaaataaagaagaaaaaaacccagactaaaaaaaaaaaaaaaaaaaaaaaaaaa

SEQ ID NO: 632 - DNA, 1976 bp, Homo sapiens
gtccgagtcagccctgggcagcggggaggtccccagagggggctgggccctgtctgggtatggggaagcttgctgcctctggttcccttttctccccttcactggcaacctcttgtcccttcccttttctctctttctttcctgaccctctcccttccttccttctttccctccatttttccttcctctttcactgtcctcccctctgcctccttccttcccttcctcttaagtggtgaccatttccccaaggcccagacacagcccatctcgccggagtggaccatgcactgcagctgcttggctgagggcatcccagccaaccccggcaactggatctcagggttggccttccctgattgggcctacaaagccgagtcgtccccaggctcccggcagatccagctgtggcacttcatcctggagctgctgcagaaggaagagttccgccatgtcatcgcctggcagcagggagagtacggggaatttgtcatcaaggatccagatgaggtggcccgcctctggggccgcaggaaatgcaaaccacagatgaattatgacaagctgagccgggccctcagatattactacaataagaggatcctgcataagaccaaaggcaaaaggttcacatacaagttcaacttcagcaagctcatcgtagtcaactatcctttgtgggaagtgcgggcgccgccatccccccacttgctgctgggggcccctgccctgtgtcggccagcgctggtgcccgtgggtgtgcagagtgagctcctgcacagcatgctatttgcccatcaggccatggtggagcagctgacaggacagcagaccccccgagggccaccagagacctctggggataagaaggggagcagcagcagcgtctaccgacttggctctgccccaggcccctgccggctgggcctttgctgccatttggggagcgtccaaggcgagctgcctggtgttgcctccttcactcctcccctcccgccccctctgccctccaactggacctgtctctcggggcccttcttgcctcctctcccgtcagagcagcagctcccaggggcttttaagccagacatcctgctcccaggacctaggagcctcccaggggcctggcattttccagggcttcctctcttggcagggctgggacagggtgcgggtgagaggctttggctcttgtccctcaggcccgaggggctggaagtaaagcctgctcccatgatggaggcaaagggaggcctggatcccagggaggtcttctgcccagagacccgcagactcaaaactggggaggaaagccttacttcccccaatctggagaacctcaaagcagtgtggcccttggatcctccttaactagagaggaaggtgggaagttggggaggagtcctccaaagtccatctctcctcttgcccaccgcctctgggttagccccttcccctggctggacatgggctgaaattgcaggatttgaaggggtggagttggacccaaggtggggagcattgcagggaaggtgtgaatgtggaaatgggaaaaaccaagacagggtgcccctcctctttcaccatattgctaagcagactaaggggacattcctaatctcaacttttcttcagggagacgagaataaagtttctataatttccatcctgcccacataagggggaaaattaagggtctagcctggggagaggacaggggtggttgtgttccctgagtcttgtctggggcccatctccccattccaggctaaggtctccagtccctttctcacccctccatgcaacttctctcccatccctctgatttctgagaccctggaaacccctgtcccatgcaggcacttcctcctctctccatttccccaggacccaggcaagtggggtggggagacactggccttctctgctctgtaatactccactgtgaccatgaataaaatgcccttgcaaactgt

SEQ ID NO: 633 - DNA, 2887 bp, Homo sapiens
agtacggttttcggagggatcagactcagactcacgtcgcactcctcgcagttggactggtgggaactgggaacactggagacctgatttctaactgacgctaccgtcgcggccgccggcaagttcctttactgtgttttcttggttcagccttgaagtgagtcgtggacgatcctctctcagcgtccagcctagacggcggtgttgctccggcagcgttcctgggagccgagggccagagactaagttcctgggttctgagcctgccatccaaggaactcaggaggaggagttgacagtctcttcgttcctaaccagtgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacacaacaacaggaacagacaaactcaaccagaactcccagctgagccacagttatcaggagaggagtccagctcagaagatgattctgacctgtttgttaacacaaaccgcagacagtatcatgagagtgaggaggagagtgaagaggaggaggcagcctgagactccaggacccaattctccacttgctcagggactggcccctggctcttctgggcttggacattcccagggtgctctgcacatcttcacccctgcatgaggacaaagcagggctcctctctgaactgatcttttgattcagagaattaaacccctggtgggttggtgacttgttctggtgtctgagtggctctctcgggggagggagattgtgatgaagtgaaaaactgctccctatttattagagaccttgtgggtgggtgggctgaatggggaggaaatgggaaatggctggagtctttcccaggtggtttgttctttcttattgggcacttagaaagtgccaggccgtgctctgggccttcttgcatgtgtttaacagctgggagcactcctgcttccttgcctgcttgcagttcataccaatttaagcattcaggatgacagccctaggacctaacacccacctgcctctaagagacgctcaggagcccatggtgcctcgtgctgttctccccgcctttctagtcaccctgtgtacgggagtgctcacctccagctactgtgtccatccccacatacgacctcatctctcccactctgcaccatctatcacttccagaaggtggctggcaaatctctctatccttaactttgttttgaatggtccatccatctcctgactttatttgaaacctgattattccctgaggacattgattgtcttataaccttttaaatagaggctgcttttccaccctcacccttcattcttctaaccagccctgacattctcatgagtaaccttctgccttcacttccctcttgtgtagcatcaattccgtagtccaccctacacccctctgtctccctccattctgttccgctagtaaaaccctaaccctgggtaaacccaatcattcacctctgtgcccaaacccaagtcaccatcattaggtgagaaaacagccagcctggccaccagttgtaccttacgtttatcattacaaacctcagatggacactaagcactgcccagcagatctactctgggatgtctgtttcaaaacttctgtcttatctatcaattcccccttgtggtagttaccacaacacatgcctcattaagaaacagcaaccatcagagggaatgcctgcctccctgttaccagctctgcagatgtgcacatatcttcctgtcgtaagccaatgggacttaaaccttacctcttgtgttttggagactatctttttttttttttttttttttttgagagagtgtctccctgtgttgctcaggctggagtgcagtggtgtgatctcggctcactgtaaccttcacctactgggttcaagtaactctcctgcctcagcctcccgagtagcttggactacaggcgtgcaccaccacacctggctaactttttgtatttttagtagagacggggttttgccatgttgcccgggctggtctcgaactcctgaccttaaatgagcctcctgcctcagcctcccaaactgctgggattacaggcgtgtgccaccatgcctggctaatttttatattttcagtagagacgaggttttgccatgttggccaggctggtctcgaactcctgacctcaagtggtccacccaccttggcctcctagagtgctgggattacaggtgtgagccactgtgcccggcctcttttgctttcttaaagactttggtcgggtatttgtgttgttgagtattgtgtctgggtgtgggtatttgattctttttttgttttgtgtttttggctgtcctgtctattggatgtgatatgttatggatgtgatgtgttagtgtcgagcgtgctgtagaatctcccatttctgaaacaggcgtgaaaacctgtactgattcccacgtcctccagctaccacttcatttgtctgtttctcatttactttctcttatagcgtggctttaaacatatatacatttgtatatatgtatatatgaatataatgtataaaatgtatgtagatgtatatacaaaaaataaacgagatgggttaaagata

SEQ ID NO: 634 - DNA, 2761 bp, Homo sapiens
gtacggttttcggagggatcagactcagactcacgtcgcactcctcgcagttggactggtgggaactgggaacactggagacctgatttctaactgacgctaccgtcgcggccgccgaacagtcctgggttctgagcctgccatccaaggaactcaggaggaggagttgacagtctcttcgttcctaaccagtgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacacaacaacaggaacagacaaactcaaccagaactcccagctgagccacagttatcaggagaggagtccagctcagaagatgattctgacctgtttgttaacacaaaccgcagacagtatcatgagagtgaggaggagagtgaagaggaggaggcagcctgagactccaggacccaattctccacttgctcagggactggcccctggctcttctgggcttggacattcccagggtgctctgcacatcttcacccctgcatgaggacaaagcagggctcctctctgaactgatcttttgattcagagaattaaacccctggtgggttggtgacttgttctggtgtctgagtggctctctcgggggagggagattgtgatgaagtgaaaaactgctccctatttattagagaccttgtgggtgggtgggctgaatggggaggaaatgggaaatggctggagtctttcccaggtggtttgttctttcttattgggcacttagaaagtgccaggccgtgctctgggccttcttgcatgtgtttaacagctgggagcactcctgcttccttgcctgcttgcagttcataccaatttaagcattcaggatgacagccctaggacctaacacccacctgcctctaagagacgctcaggagcccatggtgcctcgtgctgttctccccgcctttctagtcaccctgtgtacgggagtgctcacctccagctactgtgtccatccccacatacgacctcatctctcccactctgcaccatctatcacttccagaaggtggctggcaaatctctctatccttaactttgttttgaatggtccatccatctcctgactttatttgaaacctgattattccctgaggacattgattgtcttataaccttttaaatagaggctgcttttccaccctcacccttcattcttctaaccagccctgacattctcatgagtaaccttctgccttcacttccctcttgtgtagcatcaattccgtagtccaccctacacccctctgtctccctccattctgttccgctagtaaaaccctaaccctgggtaaacccaatcattcacctctgtgcccaaacccaagtcaccatcattaggtgagaaaacagccagcctggccaccagttgtaccttacgtttatcattacaaacctcagatggacactaagcactgcccagcagatctactctgggatgtctgtttcaaaacttctgtcttatctatcaattcccccttgtggtagttaccacaacacatgcctcattaagaaacagcaaccatcagagggaatgcctgcctccctgttaccagctctgcagatgtgcacatatcttcctgtcgtaagccaatgggacttaaaccttacctcttgtgttttggagactatctttttttttttttttttttttttgagagagtgtctccctgtgttgctcaggctggagtgcagtggtgtgatctcggctcactgtaaccttcacctactgggttcaagtaactctcctgcctcagcctcccgagtagcttggactacaggcgtgcaccaccacacctggctaactttttgtatttttagtagagacggggttttgccatgttgcccgggctggtctcgaactcctgaccttaaatgagcctcctgcctcagcctcccaaactgctgggattacaggcgtgtgccaccatgcctggctaatttttatattttcagtagagacgaggttttgccatgttggccaggctggtctcgaactcctgacctcaagtggtccacccaccttggcctcctagagtgctgggattacaggtgtgagccactgtgcccggcctcttttgctttcttaaagactttggtcgggtatttgtgttgttgagtattgtgtctgggtgtgggtatttgattctttttttgttttgtgtttttggctgtcctgtctattggatgtgatatgttatggatgtgatgtgttagtgtcgagcgtgctgtagaatctcccatttctgaaacaggcgtgaaaacctgtactgattcccacgtcctccagctaccacttcatttgtctgtttctcatttactttctcttatagcgtggctttaaacatatatacatttgtatatatgtatatatgaatataatgtataaaatgtatgtagatgtatatacaaaaaataaacgagatgggttaaagata

SEQ ID NO: 635 - DNA, 588 bp, Homo sapiens
ttctcccttttctcctgtcttataaactagggaaaaggggaggttggagagaaactaagaaggccaacaggagaagtggtggcctcataccatactgtaacagtgctgagttagctgttatttttctgggacctagagaagttgaatagttaggaaataaaccaaggtaggatttgaatccaggcagttagacttcagaacccatgttcttaaccaagacaccgtgtcacccctcagtaaaaggcccctccccatcttcagaacagtcctgggttctgagcctgccatccaaggaactcaggaggaggagttgacagtctcttcgttcctaaccagtgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaa

SEQ ID NO: 636 - DNA, 889 bp, Homo sapiens
cctccgagacagcgccggaagtacggttttcggagggatcagactcagactcacgtcgcactcctcgcagttggactggtgggaactgggaacactggagacctgatttctaactgacgctaccgtcgcggccgccggcaagttcctttactgtgttttcttggttcagccttgaagtgagtcgtggacgatcctctctcagcgtccagcctagacggcggtgttgctccggcagcgttcctgggagccgagggccagagactaagtaacagtcctgggttctgagcctgccatccaaggaactcaggaggaggagttgacagtctcttcgttcctaaccagtgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacacaacaacaggaacagacaaactcaaccagaactcccagctgagccacagttatcaggagaggagtccagctcagaagatgattctgacctgtttgttaacacaaaccgcagacagtatcatgagagtgaggaggagagtgaagaggaggaggcagcctgagactccaggacccaattctccacttgctcagg

SEQ ID NO: 637 - DNA, 808 bp, Homo sapiens
agcgccggaagtacggttttcggagggatcagactcagactcacgtcgcactcctcgcagttggactggtgggaactgggaacactggagacctgatttctaactgacgctaccgtcgcggccgccgtgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacacaacaacaggaacagacaaactcaaccagaactcccagctgagccacagttatcaggagaggagtccagctcagaagatgattctgacctgtttgttaacacaaaccgcagacagtatcatgagagtgaggaggagagtgaagaggaggaggcagcctgagactccaggacccaattctccacttgctcagggactggcccctggctcttctgggcttggacattcccagggtgctctgcacatcttcacccctgcatgaggacaaagcagggctcctctctgaactgatcttttgattcagagaattaaacccctggtgggttgg

SEQ ID NO: 638 - DNA, 580 bp, Homo sapiens
ggaagtacggttttcggagggatcagactcagactcacgtcgcactcctcgcagttggactggtgggaactgggaacactggagacctgatttctaactgacgctaccgtcgcggccgccgtaaaaggcccctccccatcttcagaacagtcctgggttctgagcctgccatccaaggaactcaggaggaggagttgacagtctcttcgttcctaaccagtgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacacaaca

SEQ ID NO: 639 - DNA, 584 bp, Homo sapiens
agactcagactcacgtcgcactcctcgcagttggactggtgggaactgggaacactggagacctgatttctaactgacgctaccgtcgcggccgccggcaagttcctttactgtgttttcttggttcagccttgaagtgagtcgtggacgatcctctctcagcgtccagcctagacggcggtgttgctccggcagcgttcctgggagccgagggccagagactaagttgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacaca

SEQ ID NO: 640 - DNA, 965 bp, Homo sapiens
acggttttcggagggatcagactcagactcacgtcgcactcctcgcagttggactggtgggaactgggaacactggagacctgatttctaactgacgctaccgtcgcggccgccggcaagttcctttactgtgttttcttggttcagccttgaagtgagtcgtggacgatcctctctcagcgtccagcctagacggcggtgttgctccggcagcgttcctgggagccgagggccagagactaagttaaaaggcccctccccatcttcagaacagtcctgggttctgagcctgccatccaaggaactcaggaggaggagttgacagtctcttcgttcctaaccagtgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacacaacaacaggaacagacaaactcaaccagaactcccagctgagccacagttatcaggagaggagtccagctcagaagatgattctgacctgtttgttaacacaaaccgcagacagtatcatgagagtgaggaggagagtgaagaggaggaggcagcctgagactccaggacccaattctccacttgctcagggactggcccctggctcttctgggcttggacattcccagggtgctctgcacatcttcacccctgcatgaggacaa

SEQ ID NO: 641 - DNA, 2869 bp, Homo sapiens
gccggcgcaggccccgcctcctcgctgggccccgcctcgctgccaccacagggtcttgcctccgcgcgccccgccctcgtcctcttgtgtagcctgaggcggcggtagcatggagggggagagtacgtcggcggtgctctcgggctttgtgctcggcgcactcgctttccagcacctcaacacggactcggacacggaaggttttcttcttggggaagtaaaaggtgaagccaagaacagcattactgattcccaaatggatgatgttgaagttgtttatacaattgacattcagaaatatattccatgctatcagctttttagcttttataattcttcaggcgaagtaaatgagcaagcactgaagaaaatattatcaaatgtcaaaaagaatgtggtaggttggtacaaattccgtcgtcattcagatcagatcatgacgtttagagagaggctgcttcacaaaaacttgcaggagcatttttcaaaccaagaccttgtttttctgctattaacaccaagtataataacagaaagctgctctactcatcgactggaacattccttatataaacctcaaaaaggactttttcacagggtacctttagtggttgccaatctgggcatgtctgaacaactgggttataaaactgtatcaggttcctgtatgtccactggttttagccgagcagtacaaacacacagctctaaattttttgaagaagatggatccttaaaggaggtacataagataaatgaaatgtatgcttcattacaagaggaattaaagagtatatgcaaaaaagtggaagacagtgaacaagcagtagataaactagtaaaggatgtaaacagattaaaacgagaaattgagaaaaggagaggagcacagattcaggcagcaagagagaagaacatccaaaaagaccctcaggagaacatttttctttgtcaggcattacggaccttttttccaaattctgaatttcttcattcatgtgttatgtctttaaaaaatagacatgtttctaaaagtagctgtaactacaaccaccatctcgatgtagtagacaatctgaccttaatggtagaacacactgacattcctgaagctagtccagctagtacaccacaaatcattaagcataaagccttagacttagatgacagatggcaattcaagagatctcggttgttagatacacaagacaaacgatctaaagcagatactggtagtagtaaccaagataaagcatccaaaatgagcagcccagaaacagatgaagaaattgaaaagatgaagggttttggtgaatattcacggtctcctacattttgatccttttaaccttacaaggagatttttttatttggctgatgggtaaagccaaacatttctattgtttttactatgttgagctacttgcagtaagttcatttgtttttactatgttcacctgtttgcagtaatacacagataactcttagtgcatttacttcacaaagtactttttcaaacatcagatgcttttatttccaaacctttttttcacctttcactaagttgttgaggggaaggcttacacagacacattctttagaattggaaaagtgagaccaggcacagtggctcacacctgtaatcccagcacttagggaagacaagtcaggaggattgattgaagttaggagttagagaccagcctgggcaacgtattgagaccatgtctattaaaaaataaaatggaaaagcaagaatagccttattttcaaaatatggaaagaaatttatatgaaaatttatctgagtcattaaaattctccttaagtgatacttttttagaagtacattatggctagagttgccagataaaatgctggatatcatgcaataaatttgcaaaacatcatctaaaatttaaatttgtcctacatttgtacttgctaaatctggcagccttaattattacacaactataacacaacacaaacagtaatctctcccctagtttagagtcctttgcatgaaatttagcaaatctatcattttgaatacagtacaagcctggtaatccagtgtatttgggataggccagtggaactcagaactgatacatatatacatgtatgtctatcatattcaatgtctattaggtgtaaatcatctcttcatgtaaaagacactactggtttgagggtagactcgtctaggaatattttgtccttctgtgacagcaccactatccatcccaatgtaacatttctacaaagggaagatatcttaaccaggcatacttatatttgctagttggaaaatcattctgaacagttttaattccattctattgaatggattattgtatgagctatttggggatcagatataaatgacaatcacacagaaccacttttattcaacatagataaaatgtgatgagtgttaacattttaaataagcaatctgcttaatggacattggtatgaaggggaagtgtcattctttacctcactcctcaaacacttttctatccaaaggttggtttgagtcagtattggcatcatacaaccacttactgtaaaataagtttattagtggtaacgtgatagaatttattcccgatatctgatgttacaaactttagggtccttgagatatgcaggatccttgtatgtaactggcataaaccctgtaaagagataattaaagttcttgacaaaacataatgagcaaaatttcagctagctcaattcagttgttgaggtattctttcttacccattatttgagctctcttaattgcttttgtgatttctttctgtttcttcccacaaagacctgtaaaataaaaagctttcttattcataaaaaa

SEQ ID NO: 642 - DNA, 1869 bp, Homo sapiens
attagtattctgtaagtttcagtgagtgaagggtgctaaaatgcagcttgaaaaccaaaaccgtggcatatccactgtggcatcgtaatgttgctactcaactcttttattcttgtaatcattgcttgtcttaaaatgaccctgtcaaccgtgttcattttgatagctttgcatgtttgtgacaggtcgctcagcaggcgcaggccaccaaaagcaattcgcagccctctgcagtggtaccgacatgcagcggccttccgggagaggaaggttttcttcttggggaagtaaaaggtgaagccaagaacagcattactgattcccaaatggatgatgttgaagttgtttatacaattgacattcagaaatatattccatgctatcagctttttagcttttataattcttcaggcgaagtaaatgagcaagcactgaagaaaatattatcaaatgtcaaaaagaatgtggtaggttggtacaaattccgtcgtcattcagatcagatcatgacgtttagagagaggctgcttcacaaaaacttgcaggagcatttttcaaaccaagaccttgtttttctgctattaacaccaagtataataacagaaagctgctctactcatcgactggaacattccttatataaacctcaaaaaggactttttcacagggtacctttagtggttgccaatctgggcatgtctgaacaactgggttataaaactgtatcaggttcctgtatgtccactggttttagccgagcagtacaaacacacagctctaaattttttgaagaagatggatccttaaaggaggtacataagataaatgaaatgtatgcttcattacaagaggaattaaagagtatatgcaaaaaagtggaagacagtgaacaagcagtagataaactagtaaaggatgtaaacagattaaaacgagaaattgagaaaaggagaggagcacagattcaggcagcaagagagaagaacatccaaaaagaccctcaggagaacatttttctttgtcaggcattacggaccttttttccaaattctgaatttcttcattcatgtgttatgtctttaaaaaatagacatgtttctaaaagtagctgtaactacaaccaccatctcgatgtagtagacaatctgaccttaatggtagaacacactgacattcctgaagctagtccagctagtacaccacaaatcattaagcataaagccttagacttagatgacagatggcaattcaagagatctcggttgttagatacacaagacaaacgatctaaagcagatactggtagtagtaaccaagataaagcatccaaaatgagcagcccagaaacagatgaagaaattgaaaagatgaagggttttggtgaatattcacggtctcctacattttgatccttttaaccttacaaggagatttttttatttggctgatgggtaaagccaaacatttctattgtttttactatgttgagctacttgcagtaagttcatttgtttttactatgttcacctgtttgcagtaatacacagataactcttagtgcatttacttcacaaagtactttttcaaacatcagatgcttttatttccaaacctttttttcacctttcactaagttgttgaggggaaggcttacacagacacattctttagaattggaaaagtgagaccaggcacagtggctcacacctgtaatcccagcacttagggaagacaagtcaggaggattgattgaagttaggagttagagaccagcctgggcaacgtattgagaccatgtctattaaaaaataaaatggaaaagcaagaatagccttattttcaaaatatggaaagaaatttatatgaaaa

SEQ ID NO: 643 - DNA, 682 bp, Homo sapiens
gtcctcttgtgtagcctgaggcggcggtagcatggagggggagagtacgtcggcggtgctctcgggctttgtgctcggcgcactcgctttccagcacctcaacacggactcggacacggtcgggcgcggtggctcacgcctgtaattccagccctttgggaagccgaggcgggtgaatcacctgagcccacgagttcgagaccatcggggacaacgtagtgagacccggtctctacaaaatctaaacattacaaaattgctctttggcacaatcctaataaaggttggaattggaaggttttcttcttggggaagtaaaaggtgaagccaagaacagcattactgattcccaaatggatgatgttgaagttgtttatacaattgacattcagaaatatattccatgctatcagctttttagcttttataattcttcaggcgaagtaaatgagcaagcactgaagaaaatattatcaaatgtcaaaaagaatgtggtaggttggtacaaattccgtcgtcattcagatcagatcatgacgtttagagagaggctgcttcacaaaaacttgcaggagcatttttcaaaccaagaccttgtttttctgctattaacaccaagtataataacagaaagctgctctactcatcgactggaacattccttatataaacctcaaaaagg

SEQ ID NO: 644 - DNA, 2381 bp, Homo sapiens
aagtggcaccagcacttccggtacggaaaactcgctgctgccccaacctggcttgacaggcttggtctctgcaagtggctctcagccccttcttctttcctgcctcaccttccaattcgtttgccgccgccgtcccgcagctgctgtttccggagttgccccttccccatgttccggggcaggagtccgcaaagcgaagatccgcccgccggttcctcatcatgtccgaactgactaaagagctgatggagctggtgtggggcaccaagagcagccccggtctctcggacaccattttctgccgctggacgcaagggtttgtgtttagtgaatcagagggatctgcattagaacagtttgaaggtggcccctgtgctgttattgcacctgttcaggcatttcttttgaagaagctcctgttttcttcggagaagtcttcttggcgggattgttcagaggaagagcagaaggaactcctttgtcataccttgtgtgatattttagaaagtgcttgttgtgaccactctggatcatactgcttggtttcatggttaagaggaaagacaactgaggaaactgctagtatttctgggagtcctgcagagtctagttgccaagtggaacattcttctgccttggctgtcgaagagcttggctttgagcgatttcatgcattaattcaaaaaagatcgttcagaagtttaccagaattaaaagatgctgtcttggaccagtattcaatgtggggaaataaatttggagtattgctttttctgtattctgtattactgacaaagggcattgaaaacataaaaaacgaaattgaagatgcaagtgaacccttgatagatcctgtatatggacatggcagccaaagtttaattaatctcctgctgacgggacatgctgtttctaatgtatgggatggtgatagagagtgctcaggaatgaaacttcttggtatacatgaacaagcagcagtaggatttttaacactaatggaagctttaagatactgtaaggttggttcttacttgaaatctccaaaattccctatttggattgttggcagtgagactcacctcaccgtattttttgccaaggatatggctttagttgcccctgaagctccttcagaacaagccagaagagtttttcaaacctacgacccagaagataatggattcatacccgattcacttctggaagatgtgatgaaagcattggaccttgtttcagatcctgaatatataaatctcatgaagaataaattagatccagaaggattaggaatcatattattgggcccatttcttcaagaattttttcctgatcagggctccagtggtccagaatcttttactgtctaccactacaatggattgaagcagtcaaattataatgaaaaggtcatgtacgtagaagggactgcagttgtgatgggttttgaagatcccatgctacagacagatgacactcctattaaacgctgtctgcaaaccaaatggccatacattgagttactctggaccacagatcgctctccttcactaaattaatttgtctaagtatttataaggaagatcttaataacagatgttgaaagaaggagtcaagactggcaattggctggattaagctaaacactggtatcactgattaactgtaaataacaattaaaaacacattttcagtgtttatgatatgtttaaattatttgtcctaaagctttatgttaaagattatcctattttaccccttcgtgtgaaatttactagcaaaattaagctttcatcaaagttcatcacttttgcattcagatacttggtcatttacttaccaaattacaaacgcaatactacagcatttgtatattaagtatcacagttactattgataaactacttttgggttttatttcattgaggcactttttttattgtttgaatgattccggcttgtaatatatcagcctctacaatgaaatgcagaagagttcatttttctaagatctgtttttcattagaaatattgacaaataacacattgtcaacctggatcctttgacaatttacttaactctggcatgttcacaaaaagtagaaactctaagagaccattaccatttattcacagatgtataggggatgtattctaaaaactgacagaaaagagaatctgatagtcaacactgttaacttttactgtgtaattgccaaatacacttttccaaatttgtcccaacagccctgtaagccagctttcttctatatttataaacacgataaatgcatgagaagatctgttattacattagtatattacgttatttattatgatcctagttgatggcctaaataaacacctttttctttaactgt

SEQ ID NO: 645 - DNA, 1679 bp, Homo sapiens
gagatgttacctttaagaggagttcccagtgaagagttgttttttccccttgaaataaaagtaaaacaaagctggaagttcacctaaatggtaaataagaacaataatacttgatcacatttattgagtcctgttttagatttgttaaatataaactgatgttcatatagtcttcaccacataaaaaatactggaaatttcgctcttcttaaaattataacaagaatcattattcggccattccttctttaacatttctgcatttgagcaagcagttttggctgtgggtttttcttttttctttttcttttttttttttttttgagttttggtgagtttgctttattatacattcagtggcctgaaacaacattgttttaatttttccccagcagttccttgatatggctttagttgcccctgaagctccttcagaacaagccagaagagtttttcaaacctacgacccagaagataatggattcatacccgattcacttctggaagatgtgatgaaagcattggaccttgtttcagatcctgaatatataaatctcatgaagaataaattagatccagaaggattaggaatcatattattgggcccatttcttcaagaattttttcctgatcagggctccagtggtccagaatcttttactgtctaccactacaatggattgaagcagtcaaattataatgaaaaggtcatgtacgtagaagggactgcagttgtgatgggttttgaagatcccatgctacagacagatgacactcctattaaacgctgtctgcaaaccaaatggccatacattgagttactctggaccacagatcgctctccttcactaaattaatttgtctaagtatttataaggaagatcttaataacagatgttgaaagaaggagtcaagactggcaattggctggattaagctaaacactggtatcactgattaactgtaaataacaattaaaaacacattttcagtgtttatgatatgtttaaattatttgtcctaaagctttatgttaaagattatcctattttaccccttcgtgtgaaatttactagcaaaattaagctttcatcaaagttcatcacttttgcattcagatacttggtcatttacttaccaaattacaaacgcaatactacagcatttgtatattaagtatcacagttactattgataaactacttttgggttttatttcattgaggcactttttttattgtttgaatgattccggcttgtaatatatcagcctctacaatgaaatgcagaagagttcatttttctaagatctgtttttcattagaaatattgacaaataacacattgtcaacctggatcctttgacaatttacttaactctggcatgttcacaaaaagtagaaactctaagagaccattaccatttattcacagatgtataggggatgtattctaaaaactgacagaaaagagaatctgatagtcaacactgttaacttttactgtgtaattgccaaatacacttttccaaatttgtcccaacagccctgtaagccagctttcttctatatttataaacacgataaatgcatgagaagatctgttattacattagtatattacgttatttattatgatcctagttgatggcctaaataaacacctttttctttaactgt

SEQ ID NO: 646 - DNA, 2452 bp, Homo sapiens
ctctgctgttcccaaaccatccttcctactttactggctcaacattgccacattagcacatctaactcatccctcccatcataggacaaaaatactagtttctctgtccatggatacaaaagagtacctattttccacttccctcctagtgataagaataaattccacagggccagggtggtggttgaagcaggggctgctggctgattaggaaagaatttttggcctgactgccacaaacagccacttggaattccccaattataggcagtctgtaagaaaaaggaaaatgcagcaaattgtattgctaagattcgtcatttttaagttaaagtttctgtcttcatatgagagtggaattgagtggtgtgaacgtgttgggtttcataagtctattctgtttgtttagtattaaactttttttttctcagtcacacacacacaatcgtgttctcaagtttttggtatagtaatgttcacagattatgtaaccttgagagcagagtacaaatacagctttttatacattttaaagagactgttcatactgtgaaactttgaacctaccttctatcatgaagagtcaaataacaggacacttacatacttaaatggtttaaattgtaatttttcttgattatttgggagcaaagatgttctttccctttgattattcataaatctactcatttgataaactataattattttccttataaagttattatcgtcaagtttatagttttagggtttgaggtttcatgctgaaattctaagaagtggtcattttatctaggaactttagcaaaacctgagaatgactcttagggctaaatagttatctccagctgtgttaaatctatattgttgttgttttaatgtcaaagcacaatataagctcagtactgacagtcttctaacactcatttttacattcagcatttgatctctatgggtgaagtgctcgggcacaatacattatttcagttaaatacaaattggacactttatgcttcagatatttatgggcaaataagaggcagtataaatttttaatttgtttatttgttttattttgctacatttgttctaggttggttcttacttgaaatctccaaaattccctatttggattgttggcagtgagactcacctcaccgtattttttgccaaggatatggctttagttgcccctgaagctccttcagaacaagccagaagagtttttcaaacctacgacccagaagataatggattcatacccgattcacttctggaagatgtgatgaaagcattggaccttgtttcagatcctgaatatataaatctcatgaagaataaattagatccagaaggattaggaatcatattattgggcccatttcttcaagaattttttcctgatcagggctccagtggtccagaatcttttactgtctaccactacaatggattgaagcagtcaaattataatgaaaaggtcatgtacgtagaagggactgcagttgtgatgggttttgaagatcccatgctacagacagatgacactcctattaaacgctgtctgcaaaccaaatggccatacattgagttactctggaccacagatcgctctccttcactaaattaatttgtctaagtatttataaggaagatcttaataacagatgttgaaagaaggagtcaagactggcaattggctggattaagctaaacactggtatcactgattaactgtaaataacaattaaaaacacattttcagtgtttatgatatgtttaaattatttgtcctaaagctttatgttaaagattatcctattttaccccttcgtgtgaaatttactagcaaaattaagctttcatcaaagttcatcacttttgcattcagatacttggtcatttacttaccaaattacaaacgcaatactacagcatttgtatattaagtatcacagttactattgataaactacttttgggttttatttcattgaggcactttttttattgtttgaatgattccggcttgtaatatatcagcctctacaatgaaatgcagaagagttcatttttctaagatctgtttttcattagaaatattgacaaataacacattgtcaacctggatcctttgacaatttacttaactctggcatgttcacaaaaagtagaaactctaagagaccattaccatttattcacagatgtataggggatgtattctaaaaactgacagaaaagagaatctgatagtcaacactgttaacttttactgtgtaattgccaaatacacttttccaaatttgtcccaacagccctgtaagccagctttcttctatatttataaacacgataaatgcatgagaagatctgttattacattagtatattacgttatttattatgatcctagttgatggcctaaataaacacctttttctttaactgt

SEQ ID NO: 647 - DNA, 967 bp, Homo sapiens
ttaccagaattaaaagatgctgtcttggaccagtattcaatgtggggaaataaatttggagtattgctttttctgtattctgtattactgacaaagggcattgaaaacataaaaaacgaaattgaagatgcaagtgaacccttgatagatcctgtatatggacatggcagccaaagtttaattaatctcctgctgacgggacatgctgtttctaatgtatgggatggtgatagagagtgctcaggaatgaaacttcttggtatacatgaacaagcagcagtaggatttttaacactaatggaagctttaagatactgtaaggttggttcttacttgaaatctccaaaattccctatttggattgttggcagtgagactcacctcaccgtattttttgccaaggatatggctttagttgcccctgaagctccttcagaacaagccagaagagtttttcaaacctacgacccagaagataatggattcatacccgattcacttctggaagatgtgatgaaagcattggaccttgtttcagatcctgaatagtaagctaaataggaagtgttatttagccaactcaaaaagattcgattaagtttaagacatattgtacattttttgcctttttaaaaatctatatctgcatatatgaagcatagcaatctatgtaaggcaaagattaagaaatcgaactaatccaatattatagcagacttgacatacttaaattgagtttcctttcccacccagcaattactgtcctgctttttaaaaaatgctaaaagtgtctttctataaactttaaaaagtttctctgcaaacacttccccacgtcttaaaattttatgtgacattagtatcttcagtaaagtaatgacggttctgtgtagatggtgctagttgccctgcttaaataaccagcaggcctctgactttccctcttaaataaagatgatcaaagata

SEQ ID NO: 648 - DNA, 618 bp, Homo sapiens
ctgccttggctgtcgaagagcttggctttgagcgatttcatgcattaattcaaaggccactctattctttaaataactgtatattattgaagaatttactgatgccagacagttcacctaagagatgaagaggttccctgccaaaaaaagatcgttcagaagtttaccagaattaaaagatgctgtcttggaccagtattcaatgtggggaaataaatttggagtattgctttttctgtattctgtattactgacaaagggcattgaaaacataaaaaacgaaattgaagatgcaagtgaacccttgatagatcctgtatatggacatggcagccaaagtttaattaatctcctgctgacgggacatgctgtttctaatgtatgggatggtgatagagagtgctcaggaatgaaacttcttggtatacatgaacaagcagcagtaggatttttaacactaatggaagctttaagatactgtaaggttggttcttacttgaaatctccaaaattccctatttggattgttggcagtgagactcacctcaccgtattttttgccaaggatatggctttagttgcccctgaagctccttcagaacaagccagaagagtttt

SEQ ID NO: 649 - DNA, 2839 bp, Homo sapiens
gtcgccggaagtggggcgggactctattgtggcggtgaggaacaggaagccctgaagggtcaaaagaaatacaaaagcaaaggctattttctttttttttttctttctttcattcattccttcctctgtttctttctttcttcctttcatttttttttcttttttaagagcgagcggctctgcggtggcggtttggggtgggcgccgccgaggtgaggtcgtctcgcctcccgcgcgccggtagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtagtgaaatggagcccttccctggaactaaccagtccttgatgttgtgtgactaagtaaagatgataaaccccatctgctgggggtgtcacttcacactcggcatgcattgtgaaagctttccatacccttggccattccctctctcctctctctccaaccccatttatgcaggaagggactgctaacaagaacgcttccatctcaaaccttttctctgcctgggaaattattttatgtttgtttttgaaataaaggatttagtttaagattctaaattttagagaaacaaacgtaggccttgtttactaatagccagacatcagaactgcaggtaggtatgttaatgagatgacttatttctggcagctcctggaatcctaatattgtaaatgagtgggacacacttgcatattgtgaccattctattgaggcccttctctgtttaatgcatattatacttgtgcttttaactgtggaatctatttctaacctaaaggtgctgccctagtacttttctttgctgcctctgctgctctttttcctttccaaacagcaactctgaggccatgagcagccaaaaactagaggtactgctccacctcgtctcataaagggaaacgggctcatcccttggattctggaggagggagagggagatggtgtggaggcctcgaggacagagatagacatgagctttgacaacaatctgtaggctctcctgctttagaataagcatgtaccattctttatccattccccttattcctacatcaattgtttttactttcttgggtgtgagactgagtgagacacacacaaaatgtgttgacactgtgatgccggcaggcagagcagctactgactttgaacatgggcagagaggcccctggatctcatccagcccactccttttccccttccagtacagtgacactctggtgcccattggcagatggcgacttccctgcacccataactgatgctttgtgaattcttcctccttttcagaactactctgtgctaattgttctgccagtatgggcgcatcagctccatcctgacaaacaagacatttaggtaaaactttgtaggcaccttctgcttctctgcttcattgttcctgtgatagtcctgttgttattacagcatgtacccaaaacagcctcacattgttacaggaggcaggccaggacatcaaagtcatcatctttatgtggcatgactcttaagaggccattactgtatctcatggcctcttgatgtggaaagaagttgacagagggttgcagggtttaaaaacatccattaacatgaaagctaataaacctgtcag

SEQ ID NO: 650 - DNA, 1017 bp, Homo sapiens
tttgttttgtagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatgaaatggagcccttccctggaactaaccagtccttgatgttgtgtgactaagtaaagatgataaacccc

SEQ ID NO: 651 - DNA, 1395 bp, Homo sapiens
ggttctcagctctaccattcaccacctgtatcaccttagacaaataatctaactcctctggacctcaacttcatctgtaaacagataatatttctcatagggtcaatgatcatgtaaattagataatatccataaaaggaatataatacatgattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcagtaagcagtttgacccttaactggtaactcacaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtagtgaaatggagcccttccctggaactaaccagtccttgatgttgtgtgactaagtaaagatgataaacccc

SEQ ID NO: 652 - DNA, 3028 bp, Homo sapiens
ggtttgcaggcggaggctacagctagggctgctcagtaactgccccaaccactaccacgtccccaagtgcaacgggacccacggaactacagggtcctgctgagctcaggagctgcacggaatggtggcagtcaccttgccagtgcagcaggcatggatcagactgcaagctaggggcacgaggcatcagttgggaagaggggacgcacagctaggcttgaggcctcttcatcgggatgtccccaggccccccagcccaggcccagcataaaggccgtgttggggggcccccctgacccaaggggggcttcatgcgccacgtgcaggcggagccgtctccatcctcagagccggaggctggcccttcacagcctccagtcaggcagggggccctccagggtggcctgctcatgggctacagcccagcagggggggcgacatcccccggggtctaccaggtatccatcttttcccctccggctggtacctctgagcctcatagggccctgaaacgacaagccccatccactgagggtccccgggagctgaagagaggccctgggctgggggccagagagggactaccccctgaagaaccatctactgtggggctcttaggcccagagggaccggggctgggactaggtgtggccagccagcatttctcccaccgtggcctctgtgttgtggaacagagaagtagtgtcacctcatcttggacttcgggggcctggagtcccccctgccccccatcaaatgcttcctgcaatactttgcacaccagagactgggcctccccagatccagggggacaggggtccctgggggagtccccagggccagcccctccaggccagctgcacacacttgacactgatttgcacagtcttgcacaaatagggggtaagagcccagtggctggggtgggcaatgggggtagcctctggcctagggagtcccctggcactgccaatgggcacagtcccgagcacacaccccctggccctggacccccaggcccctgccccaccaagcgaaggctgcttcctgctggagaagccccagatgtcagctctgaggaagaggggccagcccctcggaggcgccggggatccctgggccaccctactgctgccaacagttctgatgccaaagccacacccttctggagccacctgctgcctgggcccaaagagcctgttttggacccaacagactgcggtcccatggggcggaggctgaaaggagcccgtcgcctgaagctgagcccccttcgaagcctccggaaggggccaggcctgctgagcccccccagtgcctcccctgttcctacccctgctgtcagccgtaccctgctgggcaactttgaggaatcattgctgcgaggacgttttgcaccatctggccacattgagggcttcacagcagaaattggagctagtgggtcatactgcccccagcacgtcacgctgcctgtcactgtcacattctttgatgtttctgagcaaaatgccccggctcccttcctgggcatcgtggatctgaaccccttggggaggaagggttacagcgtgcccaaggtgggcaccgtccaagtgaccttatttaaccccaaccagactgtggtaaagatgttccttgtgacctttgacttctcggacatgcctgctgcccacatgaccttcctgcgccatcgcctctttttggtgcctgtgggtgaggagggaaatgctaaccccacccaccgcctcctctgctacttgctgcacctcaggttccggagctcccgctcaggccgcttaagcctgcatggagatatccgcctgcttttttcccgccggagcctggagctggacacagggctcccctacgaactgcaggctgtgaccgaggcccctcataatccacgttattcacctttgccctgattgccagcactctgaacccatgcgggctaatgacctgcccatcctgctccatcttagagaacatatatggagagacagcaagagacccttcaggcttgaattaaagccctcaccatgctcacgcccaaatggattatttgggtgtttaaagcttctgattcttactacaccctgccctacttcgggtactccatgtgcctgtcccctcccttgggtttcccaggccagcttaggtagtagggaggaactggagctaccctgagattttctcaagttcccaggcaagttatgccagcgttgcctccctgtcctgggcaggggccacttgttattttatttatttttaatttataatttattcaaattggattgccttggtaacctcccacacctgataattggcatcactcctccccgcttcccactctcagatattgctccaacctcaggagttgaagaggcttatgcggtgggggcaggaggagaactgctttccctcagctgagggaagaggggctattccagagggactgagtcagtagccaaagactcagcttcccctgtccttccccagtcccttcacttcccctaccctctgacctatctctgaaagccaagttatgcgtatgtgtgtgtgcacaagcttgtctttgtgtggtatgtgtgtgtgagtgtgcatgtatgcacacacacaggggttaaccacccctcacctagggctccagactccagttgtccctctcctcctacctgtgtctccttgttttggggtcctgactgaagaaggtgtccagggggcagagtcagggccaagcactggggtgcctcctctcacctggccagactctgacccacctacctcagctggggtgaggggcacccctcaaactcagtcatgtggttccaaactaccccattccccactccagactctgacccagcctcagtcctaactcctggggctgggctgaggggaacaagcatttgctgaaacttgaaaaaacaaagcaaatcaaaaacaggaaaaaattgtacctggtacttttttttagaaaaaaagattaaaaaagaaagaataaattcttgtttggaaacttgaa

SEQ ID NO: 653 - DNA, 2065 bp, Homo sapiens
acagctagggctgctcagtaactgccccaaccactaccacgtccccaagtgcaacgggacccacggaactacaggtgtggggcagggtgagcgtggaagaagggacgcggatgggggtgcgctttgcagacgatctggagactgctgtgtgttgagggaagatacgaagtcgcgggagcagttggggactcaatgtgtgggcaacaagatgtccccaggccccccagcccaggcccagcataaaggccgtgttggggggcccccctgacccaaggggggcttcatgcgccacgtgcaggcggagccgtctccatcctcagagccggaggctggcccttcacagcctccagtcaggcagggggccctccagggtggcctgctcatgggctacagcccagcagggggggcgacatcccccggggtctaccaggtatccatcttttcccctccggctggtacctctgagcctcatagggccctgaaacgacaagccccatccactgagggtccccgggagctgaagagaggccctgggctgggggccagagagggactaccccctgaagaaccatctactgtggggctcttaggcccagagggaccggggctgggactaggtgtggccagccagcatttctcccaccgtggcctctgtgttgtggaacagagaagtagtgtcacctcatcttggacttcgggggcctggagtcccccctgccccccatcaaatgcttcctgcaatactttgcacaccagagactgggcctccccagatccagggggacaggggtccctgggggagtccccagggccagcccctccaggccagctgcacacacttgacactgatttgcacagtcttgcacaaatagggggtaagagcccagtggctggggtgggcaatgggggtagcctctggcctagggagtcccctggcactgccaatgggcacagtcccgagcacacaccccctggccctggacccccaggcccctgccccaccaagcgaaggctgcttcctgctggagaagccccagatgtcagctctgaggaagaggggccagcccctcggaggcgccggggatccctgggccaccctactgctgccaacagttctgatgccaaagccacacccttctggagccacctgctgcctgggcccaaagagcctgttttggacccaacagactgcggtcccatggggcggaggctgaaaggagcccgtcgcctgaagctgagcccccttcgaagcctccggaaggggccaggcctgctgagcccccccagtgcctcccctgttcctacccctgctgtcagccgtaccctgctgggcaactttgaggaatcattgctgcgaggacgttttgcaccatctggccacattgagggcttcacagcagaaattggagctagtgggtcatactgcccccagcacgtcacgctgcctgtcactgtcacattctttgatgtttctgagcaaaatgccccggctcccttcctgggcatcgtggatctgaaccccttggggaggaagggttacagcgtgcccaaggtgggcaccgtccaagtgaccttatttaaccccaatcccttcacttcccctaccctctgacctatctctgaaagccaagttatgcgtatgtgtgtgtgcacaagcttgtctttgtgtggtatgtgtgtgtgagtgtgcatgtatgcacacacacaggggttaaccacccctcacctagggctccagactccagttgtccctctcctcctacctgtgtctccttgttttggggtcctgactgaagaaggtgtccagggggcagagtcagggccaagcactggggtgcctcctctcacctggccagactctgacccacctacctcagctggggtgaggggcacccctcaaactcagtcatgtggttccaaactaccccattccccactccagactctgacccagcctcagtcctaactcctggggctgggctgaggggaacaagcatttgctgaaacttgaaaaaacaaagcaaatcaaaaacaggaaaaaattgtacctggtacttttttttag

SEQ ID NO: 654 - DNA, 3070 bp, Homo sapiens
agcctagcagagcagggctcagcctgagccaccctttgtctgggttgggggcccgtggcagggaggaccggggaaccaaggggagggaccgggacgggacgggacggaagggcccggagcagcggccacctccgcggagccaatttgggagcgggggtcctgctgagctcaggagctgcacggaatggtggcagtcaccttgccagtgcagcaggcatggatcagactgcaagctaggggcacgaggcatcagttgggaagaggggacgcacagctaggcttgaggcctcttcatcgggatgtccccaggccccccagcccaggcccagcataaaggccgtgttggggggcccccctgacccaaggggggcttcatgcgccacgtgcaggcggagccgtctccatcctcagagccggaggctggcccttcacagcctccagtcaggcagggggccctccagggtggcctgctcatgggctacagcccagcagggggggcgacatcccccggggtctaccaggtatccatcttttcccctccggctggtacctctgagcctcatagggccctgaaacgacaagccccatccactgagggtccccgggagctgaagagaggccctgggctgggggccagagagggactaccccctgaagaaccatctactgtggggctcttaggcccagagggaccggggctgggactaggtgtggccagccagcatttctcccaccgtggcctctgtgttgtggaacagagaagtagtgtcacctcatcttggacttcgggggcctggagtcccccctgccccccatcaaatgcttcctgcaatactttgcacaccagagactgggcctccccagatccagggggacaggggtccctgggggagtccccagggccagcccctccaggccagctgcacacacttgacactgatttgcacagtcttgcacaaatagggggtaagagcccagtggctggggtgggcaatgggggtagcctctggcctagggagtcccctggcactgccaatgggcacagtcccgagcacacaccccctggccctggacccccaggcccctgccccaccaagcgaaggctgcttcctgctggagaagccccagatgtcagctctgaggaagaggggccagcccctcggaggcgccggggatccctgggccaccctactgctgccaacagttctgatgccaaagccacacccttctggagccacctgctgcctgggcccaaagagcctgttttggacccaacagactgcggtcccatggggcggaggctgaaaggagcccgtcgcctgaagctgagcccccttcgaagcctccggaaggggccaggcctgctgagcccccccagtgcctcccctgttcctacccctgctgtcagccgtaccctgctgggcaactttgaggaatcattgctgcgaggacgttttgcaccatctggccacattgagggcttcacagcagaaattggagctagtgggtcatactgcccccagcacgtcacgctgcctgtcactgtcacattctttgatgtttctgagcaaaatgccccggctcccttcctgggcatcgtggatctgaaccccttggggaggaagggttacagcgtgcccaaggtgggcaccgtccaagtgaccttatttaaccccaaccagactgtggtaaagatgttccttgtgacctttgacttctcggacatgcctgctgcccacatgaccttcctgcgccatcgcctctttttggtgcctgtgggtgaggagggaaatgctaaccccacccaccgcctcctctgctacttgctgcacctcaggttccggagctcccgctcaggccgcttaagcctgcatggagatatccgcctgcttttttcccgccggagcctggagctggacacagggctcccctacgaactgcaggctgtgaccgaggcccctcataatccacgttattcacctttgccctgattgccagcactctgaacccatgcgggctaatgacctgcccatcctgctccatcttagagaacatatatggagagacagcaagagacccttcaggcttgaattaaagccctcaccatgctcacgcccaaatggattatttgggtgtttaaagcttctgattcttactacaccctgccctacttcgggtactccatgtgcctgtcccctcccttgggtttcccaggccagcttaggtagtagggaggaactggagctaccctgagattttctcaagttcccaggcaagttatgccagcgttgcctccctgtcctgggcaggggccacttgttattttatttatttttaatttataatttattcaaattggattgccttggtaacctcccacacctgataattggcatcactcctccccgcttcccactctcagatattgctccaacctcaggagttgaagaggcttatgcggtgggggcaggaggagaactgctttccctcagctgagggaagaggggctattccagagggactgagtcagtagccaaagactcagcttcccctgtccttccccagtcccttcacttcccctaccctctgacctatctctgaaagccaagttatgcgtatgtgtgtgtgcacaagcttgtctttgtgtggtatgtgtgtgtgagtgtgcatgtatgcacacacacaggggttaaccacccctcacctagggctccagactccagttgtccctctcctcctacctgtgtctccttgttttggggtcctgactgaagaaggtgtccagggggcagagtcagggccaagcactggggtgcctcctctcacctggccagactctgacccacctacctcagctggggtgaggggcacccctcaaactcagtcatgtggttccaaactaccccattccccactccagactctgacccagcctcagtcctaactcctggggctgggctgaggggaacaagcatttgctgaaacttgaaaaaacaaagcaaatcaaaaacaggaaaaaattgtacctggtacttttttttagaaaaaaagattaaaaaagaaagaataa

SEQ ID NO: 655 - DNA, 5771 bp, Homo sapiens
aatggcctgtgagtcagaggggcagtggagtcggcggcgcggagccggggcggccccggggagggaccgtcgcagggaggggcgcggcagcggctggggggctgcgggcgccagggcccgctagtgttgcacacgaagctgaacagcgaagagcctagcagagcagggctcagcctgagccaccctttgtctgggttgggggcccgtggcagggaggaccggggaaccaaggggagggaccgggacgggacgggacggaagggcccggagcagcggccacctccgcggagccaatttgggagcggggtgagtgtgctagagggaaagagcaaatctccgaagctccagtatagtatggggcctgtcccaggctgtggggaggagaggagtgagaagggacctgggaggctgggcagggggtaagggatcgtccagaagaaggagtccaggagtcaggtgagtctgcctggcttagtttagagagtctgctaaggtctgctctctcccctctgaagatagagggctctaggctgggggccgaggggttggtaagagagaagaagtcgaccttcctacccacagtggtggtccgtgggaacagcccccctagcttgtgtggatgtatgtagggacaaaatagagagcagctggcagcagttctctttgcataggatgagggtggaaagcacatggataggaattcatcctgtcactctccttgatcatggtagaaatggaaatctttaatactgaagggaaggggagaatgagccttgaagctgatacctataccaatacccacctcacccacctcccaggcctcaaaagtgtctaaaggtacagacgtattctgggacttgttgtttttgctggccttgctccctcagcatgttgggagctgtagtccttgccagccacagcctggcacagctgtttgatgccagctgctgcccaccccctgaacgaagagtgaggcttggcctactctgccctgcccccctcccctgcagtcctgccccatgagtcagcttgaagccatggtctagagccagactggctgggtggcaggggagtgaatatagagcgtcttgttgacagggtgggaactgagagggctctggggttaataagcagatgccaggtatgctggggtcaagtagggcatcatgtcatcccctggcttccccagggcaaggggtcaagagggcaactgggatgacctggaagtggtggtgctagggaaaaggcccctcctgaatctgtatggcttgggtggaggaaagaagggtagaaattagtgcaggttgtaccttctgacaaggttggttgcaggtaggatagtgcaggttgcgattggtgttctgccctttccagccatcccgcccaccacagggaaccaggattttcttagggatcccaattcttaggagaatttggtgaaatgggatagtggggtacaatgatgggaacttggtgtaggagagcttttcagtccctgggtacaaatctctcctttctgcctgctccccacccccacctctgttcctgattttcccttgtacaattaatctctctgcttctctcatctgggaaatttttctctccactctcaggactgctgctcagatgtctgggacttgcattctactttttttgagccctgctgtgtgcttacccctgtacttggggttggatggaggggtgggacacagatctgtcctcaggaactctatggtcggtctagaagatgccttacccacaggagtgagcagaactgttagtgagcttacaggaagtagtaacactgccataggtgaggtctcagagaagggagagatgcttatggtctggggtggacagagcagactttctggaggagatggcatttgacctatccaaggaggaaaagtcttgggtaggcattcaaagggcacttcttgaaggggaaagagcaccgtgaatgtcagacagcaaaagagaaggctgaccctgggggcagctggctttcaacttgacattcccctcaccctagtatgggctggaatagttagtgaagaccatcttatgcacccgtggtttggggttttggtgttgggtgtgtgagcactgggggaggggcgtggagaggtactccctagttgcttccagctgactgactgctgcggccttatctctagtttgcagggccttgcgggagggccctggaaagtgccttctggcagtgaccccttccccttccccttcttgtttttggtcggatttgttgcctcttgttaaagagacaggctgctggaggcaatttggagttcagggctgaaaggccagctctgagctgacttgaaatttgtacctctgaggaccgctgatggggtataactgtgtgggagacctctgcccttagtgccctaggatggcacttgtccctttggagatagacatataagaaggagttgtgcaatttggtggctttgagtaagaaagctgaattcttcccctggccgcctctcagctgacacggtctcttggatcttgggggtctctcatcccttcctccatgtagggcaggagtcctcaaatggtggccctgacaagtagttattctacctcaactcacttgtcacatccttattatactgagccaagacctgcctctttgactccttaggtagcccaactctgccatctgtgccctggaccccaagcctaccctttctgttcctgaagagcctctcacatgggagaaggatgtcctggagtgtactattagcctataattggtgacaggccttaccgctggctccagtgatcctggcttacgtctgttcttctctcctcagggtcctgctgagctcaggagctgcacggaatggtggcagtcaccttgccagtgcagcaggcatggatcagactgcaagctaggggcacgaggcatcagttgggaagaggggacgcacagctaggcttgaggcctcttcatcgggatgtccccaggccccccagcccaggcccagcataaaggccgtgttggggggcccccctgacccaaggggggcttcatgcgccacgtgcaggcggagccgtctccatcctcagagccggaggctggcccttcacagcctccagtcaggcagggggccctccagggtggcctgctcatgggctacagcccagcagggggggcgacatcccccggggtctaccaggtatccatcttttcccctccggctggtacctctgagcctcatagggccctgaaacgacaagccccatccactgagggtccccgggagctgaagagaggccctgggctgggggccagagagggactaccccctgaagaaccatctactgtggggctcttaggcccagagggaccggggctgggactaggtgtggccagccagcatttctcccaccgtggcctctgtgttgtggaacagagaagtagtgtcacctcatcttggacttcgggggcctggagtcccccctgccccccatcaaatgcttcctgcaatactttgcacaccagagactgggcctccccagatccagggggacaggggtccctgggggagtccccagggccagcccctccaggccagctgcacacacttgacactgatttgcacagtcttgcacaaatagggggtaagagcccagtggctggggtgggcaatgggggtagcctctggcctagggagtcccctggcactgccaatgggcacagtcccgagcacacaccccctggccctggacccccaggcccctgccccaccaagcgaaggctgcttcctgctggagaagccccagatgtcagctctgaggaagaggggccagcccctcggaggcgccggggatccctgggccaccctactgctgccaacagttctgatgccaaagccacacccttctggagccacctgctgcctgggcccaaagagcctgttttggacccaacagactgcggtcccatggggcggaggctgaaaggagcccgtcgcctgaagctgagcccccttcgaagcctccggaaggggccaggcctgctgagcccccccagtgcctcccctgttcctacccctgctgtcagccgtaccctgctgggcaactttgaggaatcattgctgcgaggacgttttgcaccatctggccacattgagggcttcacagcagaaattggagctagtgggtcatactgcccccagcacgtcacgctgcctgtcactgtcacattctttgatgtttctgagcaaaatgccccggctcccttcctgggcatcgtggatctgaaccccttggggaggaagggttacagcgtgcccaaggtgggcaccgtccaagtgaccttatttaaccccaaccagactgtggtaaagatgttccttgtgacctttgacttctcggacatgcctgctgcccacatgaccttcctgcgccatcgcctctttttggtgcctgtgggtgaggagggaaatgctaaccccacccaccgcctcctctgctacttgctgcacctcaggttccggagctcccgctcaggccgcttaagcctgcatggagatatccgcctgcttttttcccgccggagcctggagctggacacagggctcccctacgaactgcaggctgtgaccgaggcccctcataatccacgttattcacctttgccctgattgccagcactctgaacccatgcgggctaatgacctgcccatcctgctccatcttagagaacatatatggagagacagcaagagacccttcaggcttgaattaaagccctcaccatgctcacgcccaaatggattatttgggtgtttaaagcttctgattcttactacaccctgccctacttcgggtactccatgtgcctgtcccctcccttgggtttcccaggccagcttaggtagtagggaggaactggagctaccctgagattttctcaagttcccaggcaagttatgccagcgttgcctccctgtcctgggcaggggccacttgttattttatttatttttaatttataatttattcaaattggattgccttggtaacctcccacacctgataattggcatcactcctccccgcttcccactctcagatattgctccaacctcaggagttgaagaggcttatgcggtgggggcaggaggagaactgctttccctcagctgagggaagaggggctattccagagggactgagtcagtagccaaagactcagcttcccctgtccttccccagtcccttcacttcccctaccctctgacctatctctgaaagccaagttatgcgtatgtgtgtgtgcacaagcttgtctttgtgtggtatgtgtgtgtgagtgtgcatgtatgcacacacacaggggttaaccacccctcacctagggctccagactccagttgtccctctcctcctacctgtgtctccttgttttggggtcctgactgaagaaggtgtccagggggcagagtcagggccaagcactggggtgcctcctctcacctggccagactctgacccacctacctcagctggggtgaggggcacccctcaaactcagtcatgtggttccaaactaccccattccccactccagactctgacccagcctcagtcctaactcctggggctgggctgaggggaacaagcatttgctgaaacttgaaaaaacaaagcaaatcaaaaacaggaaaaaattgtacctggtacttttttttagaaaaaaagattaaaaaagaaagaataaattcttgtttggaaacttg

SEQ ID NO: 656 - DNA, 2566 bp, Homo sapiens
aaccactaccacgtccccaagtgcaacgggacccacggaactacaggtgtggggcagggtgagcgtggaagaagggacgcggatgggggtgcgctttgcagacgatctggagactgctgtgtgttgagggaagatacgaagtcgcgggagcagttggggactcaatgtgtgggcaacaagggtcctgctgagctcaggagctgcacggaatggtggcagtcaccttgccagtgcagcaggcatggatcagactgcaagctaggggcacgaggcatcagttgggaagaggggacgcacagctaggcttgaggcctcttcatcgggatgtccccaggccccccagcccaggcccagcataaaggccgtgttggggggcccccctgacccaaggggggcttcatgcgccacgtgcaggcggagccgtctccatcctcagagccggaggctggcccttcacagcctccagtcaggcagggggccctccagggtggcctgctcatgggctacagcccagcagggggggcgacatcccccggggtctaccaggcccctgccccaccaagcgaaggctgcttcctgctggagaagccccagatgtcagctctgaggaagaggggccagcccctcggaggcgccggggatccctgggccaccctactgctgccaacagttctgatgccaaagccacacccttctggagccacctgctgcctgggcccaaagagcctgttttggacccaacagactgcggtcccatggggcggaggctgaaaggagcccgtcgcctgaagctgagcccccttcgaagcctccggaaggggccaggcctgctgagcccccccagtgcctcccctgttcctacccctgctgtcagccgtaccctgctgggcaactttgaggaatcattgctgcgaggacgttttgcaccatctggccacattgagggcttcacagcagaaattggagctagtgggtcatactgcccccagcacgtcacgctgcctgtcactgtcacattctttgatgtttctgagcaaaatgccccggctcccttcctgggcatcgtggatctgaaccccttggggaggaagggttacagcgtgcccaaggtgggcaccgtccaagtgaccttatttaaccccaaccagactgtggtaaagatgttccttgtgacctttgacttctcggacatgcctgctgcccacatgaccttcctgcgccatcgcctctttttggtgcctgtgggtgaggagggaaatgctaaccccacccaccgcctcctctgctacttgctgcacctcaggttccggagctcccgctcaggccgcttaagcctgcatggagatatccgcctgcttttttcccgccggagcctggagctggacacagggctcccctacgaactgcaggctgtgaccgaggcccctcataatccacgttattcacctttgccctgattgccagcactctgaacccatgcgggctaatgacctgcccatcctgctccatcttagagaacatatatggagagacagcaagagacccttcaggcttgaattaaagccctcaccatgctcacgcccaaatggattatttgggtgtttaaagcttctgattcttactacaccctgccctacttcgggtactccatgtgcctgtcccctcccttgggtttcccaggccagcttaggtagtagggaggaactggagctaccctgagattttctcaagttcccaggcaagttatgccagcgttgcctccctgtcctgggcaggggccacttgttattttatttatttttaatttataatttattcaaattggattgccttggtaacctcccacacctgataattggcatcactcctccccgcttcccactctcagatattgctccaacctcaggagttgaagaggcttatgcggtgggggcaggaggagaactgctttccctcagctgagggaagaggggctattccagagggactgagtcagtagccaaagactcagcttcccctgtccttccccagtcccttcacttcccctaccctctgacctatctctgaaagccaagttatgcgtatgtgtgtgtgcacaagcttgtctttgtgtggtatgtgtgtgtgagtgtgcatgtatgcacacacacaggggttaaccacccctcacctagggctccagactccagttgtccctctcctcctacctgtgtctccttgttttggggtcctgactgaagaaggtgtccagggggcagagtcagggccaagcactggggtgcctcctctcacctggccagactctgacccacctacctcagctggggtgaggggcacccctcaaactcagtcatgtggttccaaactaccccattccccactccagactctgacccagcctcagtcctaactcctggggctgggctgaggggaacaagcatttgctgaaacttgaaaaaacaaagcaaatcaaaaacaggaaaaaattgtacctggtacttttttttagaaaaaaagattaaaaaagaaagaataaattcttgtttggaaacttgaactaagctct

SEQ ID NO: 657 - DNA, 1447 bp, Homo sapiens
cgaagcactggagagtgtcatggaggcctacgagcaggtccaaaagggacccctgaagctgaaaggcgtcgcagagctgggagtgaccaagcggaagaagaaaaagaaggacaaagacaaagcgaaactcctggaagcaatgggaacgagcaaaaagaacgaggaggagaagcggcgcggcctggacaagcggaccccggcccaggcggccttcgagaaaatgcaggagaagcggcaaatggaaaggatcctaaagaaggcatccaaaacccacaagcagagagtggaggacttcaacagacacctggacacactcacggagcattacgacattcccaaagtcagctggacgaagtagccgcctgcccccagtatggagcagcatcgagggttcgcaaaaggccacactggggttgtgtgtgtttcctttggtatattctggaaacatggctacacacacccttgcatcttctgctacagactgcttttcgaagctgtgtaccctcattctggaacttgattaaagtaagatcgtccttgtactcagtttaggcttcttggcaacatacagaagatacacccttttcgtttggatggaaagtttctaagtttatccagaggtaaagcccattgtgtgtctgtgtcatgtaaaaatgttttcacccgagttgcatgtaacgctctgaggccagccagctgtcttctcctggatgagacagactccagagggtaaggagctagcgccatggtggcctgcagtatgcagagccccgcaggacccagcgtgggcgcccttccaagcttcctctagctttgggcctatgctgtcccctgcaggccctagggaagccacttgcaactatgcggccttcagacttcctcctcagccacctggccactgagacagcatagcctgggtaacggaacagccacctaaggcaagaatggaacggacacaccttgctcctttctgagcccgtttcccaaaaccccccttccaggtgcttctaatgggtgttgccatagcagacgctgctaatgcatcacagcattctttgaaatggaaccagacacagcctgcctctcaatcctcagctgggggctcctagcagcctcttgtatttactcagagttgacacatcacacagatcctgtttggcattcctaccttacggacgtctcaggggtgacaggaccagggcagagccccggtacaaacagacaaggctgcagtcaaatgggagggtccaggtgtccgtgttggagggctgggatcttgtagggcctgtgcgtcctggctgaggatcaaaccacatatgttattgggagaaacgatttctgttgacgtagatattgaaagaataatgaaggcagaagagaaaaacgaagtgtggaatttggggttgtcctgtgtaaattacacaataaagcaaaagtcagttattgt

SEQ ID NO: 658 - DNA, 658 bp, Homo sapiens
ggggtgtggagcagccaagatggagccggcagtcggcggtccgggcccactgatcgtgaacaacaaacagccccagcccccgccacctccgccgccggcagccgcacagccaccacccggggcaccgcgggccgccgcgggcctcctgcctgggggcaaagcccgcgagttcaaccgcaaccagcgcaaagactcagagggctattcggagtcaccagacctggagtttgagtatgctgacacagacaagtgggctgcagagctctcggagctttacagctacacggaagggccagaattcctgatgaatcgaaaatgctttgaggaggacttccggatccatgtgacagacaagaagtggactgagctggataccaaccagcaccggacccatgccatgaggctcctggatggcttggaagtcactgccagggagaagagactcaaggtggctcgagcaattctctatgttgctcaaggcacgtttggggagtgcagctcggaggcagaggtgcagtcctggatgcgctacaacatctttctcctcctggaggtgggcacgttcaatgctttggtggagcttctgaacatggaaatagaacactgctgtgttcgccctgcagtttccgccttggcaggaggccaggcacaagactga

SEQ ID NO: 659 - DNA, 3265 bp, Homo sapiens
ctgggggtgtggagcagccaagatggagccggcagtcggcggtccgggcccactgatcgtgaacaacaaacagccccagcccccgccacctccgccgccggcagccgcacagccaccacccggggcaccgcgggccgccgcgggcctcctgcctgggggcaaagcccgcgagttcaaccgcaaccagcgcaaagactcagagggctattcggagtcaccagacctggagtttgagtatgctgacacagacaagtgggctgcagagctctcggagctttacagctacacggaagggccagaattcctgatgaatcgaaaatgctttgaggaggacttccggatccatgtgacagacaagaagtggactgagctggataccaaccagcaccggacccatgccatgaggctcctggatggcttggaagtcactgccagggagaagagactcaaggtggctcgagcaattctctatgttgctcaaggcacgtttggggagtgcagctcggaggcagaggtgcagtcctggatgcgctacaacatctttctcctcctggaggtgggcacgttcaatgctttggtggagcttctgaacatggaaatagacaacagtgccgcctgcagcagtgctgtgaggaagcctgccatctccctggctgacagcacagacctcagggtcctgctcaacatcatgtacctgatagtggagaccgttcatcaggagtgtgagggtgacaaggctgagtggaggaccatgcggcagaccttcagagccgagctgggctccccgctgtacaacaatgagccatttgccatcatgctgtttgggatggtgaccaaattttgcagtggtcacgcccctcactttcccatgaagaaagttctcttgctgctctggaagacagtattgtgcacgctaggcggctttgaggagctgcagagcatgaaggctgagaagcgcagcatcctgggcctccccccgcttcctgaggacagcatcaaagtgattcgcaacatgagagcagcctctccaccagcatctgcttcagacttgattgagcagcagcagaaacggggccgccgagagcacaaggctctgataaagcaggacaacctagatgccttcaacgagcgggatccctacaaggctgatgactctcgagaagaggaagaggagaatgatgatgacaacagtctggagggggagacgtttcccctggaacgggatgaagtgatgcctcccccgctacagcacccacagactgacaggctgacttgccccaaagggctcccgtgggctcccaaggtcagagagaaagacattgagatgttccttgagtccagccgcagcaaatttataggttacactctaggcagtgacacgaacacagtggtggggctgcccaggccaatccacgaaagcatcaagactctgaaacagcacaagtacacgtcgattgcagaggtccaggcacagatggaggaggaatacctccgctcccctctctcagggggagaagaagaagttgagcaagtccctgcagaaaccctctaccaaggcttgctccccagcctgcctcagtatatgattgccctcctgaagatcctgttggctgcagcacccacctcaaaagccaaaacagactcaatcaacatcctagcggacgtcttgcctgaggagatgcccaccacagtgttgcagagcatgaagctgggggtggatgtaaaccgccacaaagaggtcattgttaaggccatttctgctgtcctgctgctgctgctcaagcactttaagttgaaccatgtctaccagtttgaatacatggcccagcacctggtgtttgccaactgcattcctttgatcctaaagttcttcaatcaaaacatcatgtcctacatcactgccaagaacagcatttctgtcctggattaccctcactgcgtggtgcatgagctgccagagctgacggcggagagtttggaagcaggtgacagtaaccaattttgctggaggaacctcttttcttgtatcaatctgcttcggatcttgaacaagctgacaaagtggaagcattcaaggacaatgatgctggtggtgttcaagtcagcccccatcttgaagcgggccctaaaggtgaaacaagccatgatgcagctctatgtgctgaagctgctcaaggtacagaccaaatacttggggcggcagtggcgaaagagcaacatgaagaccatgtctgccatctaccagaaggtgcggcatcggctgaacgacgactgggcatacggcaatgatcttgatgcccggccttgggacttccaggcagaggagtgtgcccttcgtgccaacattgaacgcttcaacgcccggcgctatgaccgggcccacagcaaccctgacttcctgccagtggacaactgcctgcagagtgtcctgggccaacgggtggacctccctgaggactttcagatgaactatgacctctggttagaaagggaggtcttctccaagcccatttcctgggaagagctgctgcagtgaggctgttggttaggggactgaaatggagagaaaagatgatctgaaggtacctgtgggactgtcctagttcattgctgcagtgctcccatcccccaccaggtggcagcacagccccactgtgtcttccgcagtctgtcctgggcttgggtgagcccagcttgacctccccttggttcccagggtcctgctccgaagcagtcatctctgcctgagatccattcttcctttacttcccccaccctcctctcttggatatggttggttttggctcatttcacaatcagcccaaggctgggaaagctggaatgggatgggaacccctccgccgtgcatctgaatttcaggggtcatgctgatgcctctcgagacatacaaatccttgctttgtcagcttgcaaaggaggagagtttaggattagggccagggccagaaagtcggtatcttggttgtgctctggggtgggggtggggtgtttctgatgttattccagcctcctgctacattatatccagaagtaattgcggaggctccttcagctgcctcagcactttgattttggacagggacaaggtaggaagagaagcttcccttaaccagaggggccatttttccttttggctttcgagggcctgtaaatatctatatataattctgtgtgtattctgtgtcatgttggggtttttaatgtgattgtgtattctgtttacattaaaaagaagcaaaaataa

SEQ ID NO: 660 - DNA, 3125 bp, Homo sapiens
attttacccagcccctgttcaagatggagttgctgtggttcacacatctctgacaaaaatacagggctattcggagtcaccagacctggagtttgagtatgctgacacagacaagtgggctgcagagctctcggagctttacagctacacggaagggccagaattcctgatgaatcgaaaatgctttgaggaggacttccggatccatgtgacagacaagaagtggactgagctggataccaaccagcaccggacccatgccatgaggctcctggatggcttggaagtcactgccagggagaagagactcaaggtggctcgagcaattctctatgttgctcaaggcacgtttggggagtgcagctcggaggcagaggtgcagtcctggatgcgctacaacatctttctcctcctggaggtgggcacgttcaatgctttggtggagcttctgaacatggaaatagacaacagtgccgcctgcagcagtgctgtgaggaagcctgccatctccctggctgacagcacagacctcagggtcctgctcaacatcatgtacctgatagtggagaccgttcatcaggagtgtgagggtgacaaggctgagtggaggaccatgcggcagaccttcagagccgagctgggctccccgctgtacaacaatgagccatttgccatcatgctgtttgggatggtgaccaaattttgcagtggtcacgcccctcactttcccatgaagaaagttctcttgctgctctggaagacagtattgtgcacgctaggcggctttgaggagctgcagagcatgaaggctgagaagcgcagcatcctgggcctccccccgcttcctgaggacagcatcaaagtgattcgcaacatgagagcagcctctccaccagcatctgcttcagacttgattgagcagcagcagaaacggggccgccgagagcacaaggctctgataaagcaggacaacctagatgccttcaacgagcgggatccctacaaggctgatgactctcgagaagaggaagaggagaatgatgatgacaacagtctggagggggagacgtttcccctggaacgggatgaagtgatgcctcccccgctacagcacccacagactgacaggctgacttgccccaaagggctcccgtgggctcccaaggtcagagagaaagacattgagatgttccttgagtccagccgcagcaaatttataggttacactctaggcagtgacacgaacacagtggtggggctgcccaggccaatccacgaaagcatcaagactctgaaacagcacaagtacacgtcgattgcagaggtccaggcacagatggaggaggaatacctccgctcccctctctcagggggagaagaagaagttgagcaagtccctgcagaaaccctctaccaaggcttgctccccagcctgcctcagtatatgattgccctcctgaagatcctgttggctgcagcacccacctcaaaagccaaaacagactcaatcaacatcctagcggacgtcttgcctgaggagatgcccaccacagtgttgcagagcatgaagctgggggtggatgtaaaccgccacaaagaggtcattgttaaggccatttctgctgtcctgctgctgctgctcaagcactttaagttgaaccatgtctaccagtttgaatacatggcccagcacctggtgtttgccaactgcattcctttgatcctaaagttcttcaatcaaaacatcatgtcctacatcactgccaagaacagcatttctgtcctggattaccctcactgcgtggtgcatgagctgccagagctgacggcggagagtttggaagcaggtgacagtaaccaattttgctggaggaacctcttttcttgtatcaatctgcttcggatcttgaacaagctgacaaagtggaagcattcaaggacaatgatgctggtggtgttcaagtcagcccccatcttgaagcgggccctaaaggtgaaacaagccatgatgcagctctatgtgctgaagctgctcaaggtacagaccaaatacttggggcggcagtggcgaaagagcaacatgaagaccatgtctgccatctaccagaaggtgcggcatcggctgaacgacgactgggcatacggcaatgatcttgatgcccggccttgggacttccaggcagaggagtgtgcccttcgtgccaacattgaacgcttcaacgcccggcgctatgaccgggcccacagcaaccctgacttcctgccagtggacaactgcctgcagagtgtcctgggccaacgggtggacctccctgaggactttcagatgaactatgacctctggttagaaagggaggtcttctccaagcccatttcctgggaagagctgctgcagtgaggctgttggttaggggactgaaatggagagaaaagatgatctgaaggtacctgtgggactgtcctagttcattgctgcagtgctcccatcccccaccaggtggcagcacagccccactgtgtcttccgcagtctgtcctgggcttgggtgagcccagcttgacctccccttggttcccagggtcctgctccgaagcagtcatctctgcctgagatccattcttcctttacttcccccaccctcctctcttggatatggttggttttggctcatttcacaatcagcccaaggctgggaaagctggaatgggatgggaacccctccgccgtgcatctgaatttcaggggtcatgctgatgcctctcgagacatacaaatccttgctttgtcagcttgcaaaggaggagagtttaggattagggccagggccagaaagtcggtatcttggttgtgctctggggtgggggtggggtgtttctgatgttattccagcctcctgctacattatatccagaagtaattgcggaggctccttcagctgcctcagcactttgattttggacagggacaaggtaggaagagaagcttcccttaaccagaggggccatttttccttttggctttcgagggcctgtaaatatctatatataattctgtgtgtattctgtgtcatgttggggtttttaatgtgattgtgtattctgtttacattaaaaagaagcaaaaat

SEQ ID NO: 661 - DNA, 1240 bp, Homo sapiens
ccggggcaggcccctggctcgctgacttccagcagggcacacagaagcaagccagcgacagtctcatctgtgaaatgggcctggagccgggcgttctccgaggctgaggccactagctgatgaccggcctccggcaggagggagccgagccagtgtttctgttgggaggcacggcggggacgggcctctcgtcgcctcgcctgggcacccagcgtcctggctctggcccctcggccctcagagccaggcctctgccccctcggccctcagagccaggcctctgccctggtcctatggacaccgggcagggcggttcgtctccccctggagaggcggggaggcctgagccagacctggcaagtccactggccaggaggctccttccagaaccccttgcacctgtgaggcaggcacgaccctcccgggtgccagcggttcacccactgcttccgagaacatcatgaaatccaacattgacaagaagttctctgcgcactacgacgcggtggaggcagagctcaagtccagcaccgtgggtctcgtgaccctgaatgacatgaaggccaagcaggaggctctggtgaaggagcgggagaagcagctggccaagaaggagcagtccaaggagctgcagatgaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaagagatcaccacgaagaagagaaaactggggaagaacccagacgttgacacaagcttcttgcctgatcgagaccgtgaggaggaggagaatcggcttcgggaagagctgcggcaggagtgggaagccaagcaggagaagatcaagagtgaggagatcgagatcaccttcagctactgggatggctctgggcaccggcggacagtcaagatgagaaagggcaacaccatgcagcagttcctgcagaaggcgctcgagatccttcggaaagacttcagtgagctgaggtccgcaggggtggagcagctcatgtacatcaaggaggacttgatcatccctcaccatcacagcttctacgacttcatcgtcaccaaggcacgggggaagagtggaccactcttcaactttgatgttcatgacgatgtgcggttgctcagtgacgccactgtggagaaggatgag

SEQ ID NO: 662 - DNA, 1352 bp, Homo sapiens
cacggcgcgggcgtcagctgactgttcggccgccaccgccgctgccgctgccgctgtcgctgtcgccgccgccgccgcccgccgccgccgccgccgccgccgccgctgccatggctcaatacaagggcgccgcgagcgaggccggccgcgccatgcacctgatgaagaagcgggagaagcagcgcgagcagatggagcagatgaagcagcgcatcgcggaggagaacatcatgaaatccaacattgacaagaagttctctgcgcactacgacgcggtggaggcagagctcaagtccagcaccgtgggtctcgtgaccctgaatgacatgaaggccaagcaggaggctctggtgaaggagcgggagaagcagctggccaagaaggagcagtccaaggagctgcagatgaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaagagatcaccacgaagaagagaaaactggggaagaacccagacgttgacacaagcttcttgcctgatcgagaccgtgaggaggaggagaatcggcttcgggaagagctgcggcaggagtgggaagccaagcaggagaagatcaagagtgaggagatcgagatcaccttcagctactgggatggctctgggcaccggcggacagtcaagatgagaaagggcaacaccatgcagcagttcctgcagaaggcgctcgagatccttcggaaagacttcagtgagctgaggtccgcaggggtggagcagctcatgtacatcaaggaggacttgatcatccctcaccatcacagcttctacgacttcatcgtcaccaaggcacgggggaagagtggaccactcttcaactttgatgttcatgacgatgtgcggttgctcagtgacgccactgtggagaaggatgagtcccatgcaggcaaggtggtgctgaggagctggtacgagaagaacaagcacatctttcccgccagccgctgggaaccctacgaccctgaaaagaagtgggacaagtacacgatccgctgagcatccaggaggctgcgcggccccggctcctcagctccctcagtgtgccccgtggtgtcaccgggactccaggcacccgctcccctgcgaccatgccaggcacgctgggaggaggacggcagctgctcgtgtcctgcccctgccacatcagtgactgctttattcttttccaataaagaagtgcacgtgtcagagctggagcgcctgcattgtgagaaacca

SEQ ID NO: 663 - DNA, 2802 bp, Homo sapiens
tcgctccgcacccccgcggccgcgctcaggcacaaatcctgaagagcccgtgggcgtggactgctcatctgtaaagaaagtggagacatgaccttgagatttggctgacccagcaatgctggggccttcgcaagtctgatgttccaggactccagtgcctgttggtgtggacggaggacacggggccccgaccatggtcacactcatcactgagaagctgcagagccagagcctggacgacctcacctgcaaggcggaggctggcccgttgcagtattctgcggaaaccctgaacaagagcggtcgtctgttccctttggagctcaacgaccagagtccctggaaggtcttcagtggaggaccgcccgtcagaagccaggcagccacgggccctgatttctccttcctgccgggcctgtctgctgccgctcacaccatgggtcttcagtggcagccacagtccccgcgcccaggcgcaggcctgggtgcagccagcaccgtggaccccagtgaaagcacaggctcgtccacggccccaccgaccaagcggcattgccggtccttgtcagaacccgaggagcttgtgcgctgccggtccccctggcgccccggcagctccaaggtctggactccagtctccaagaggcggtgcgacagcggcgggagtgccacgcggcagggaagccccggcgccgtcctgccgaggagtgctgtgtggtcgaccggtcccacctcgcccgccacgccccggccgtcctccgccagcggcggcttcgtggacagcagcgagggcagtgcgggctcaggcccgctctggtgttccgcggagtcctgcttgccctccacgaggcgccgcccgtccctctcacaggagcgactcgcgggtgcgggcactcccctgccctgggccagcagcagccccacgtccacgcctgcgctgggcgggcgccgtgggctgctccggtgccgctcacagccttgcgtgctcagtgggaagaggagccggcgcaaacggaggcgtgaggaggacgccaggtggacacgcccatccttggacttcctgaaaatgacccagactttaaaaaattcaaaaagcctttgctccctcaattacgaagatgacgatgaggatgacaccccagtgaagacggttctgtcctccccatgtgactcccggggcctccctggcatcaccatgcctggctgcagccagaggggcctcaggaccagccctgtccaccccaacctgtgggcctctagggagtcggtgaccagtgatggctcccgcaggagcagcggggacccccgtgatggggacagtgtcggggaggagggcgtcttcccccgggcccgctgggagctggacctggagcagatcgagaacaactgaggctggtgggggctggtcggggccatggctgccgcctgcacctgccctggggcacagagtaggtttcctgtgagctggtcggggccacggcccggcacctgccctggggcacagagtaggtttcctgtgagctggtcggggccacggctgccgccggcacctgccctggggcacagagtaggtttcctgtgagctggtcggggccacggctgccgccggcacctgccctggggcacagagtaggtttcctgtgagctggtcggggccacggctgccaccggcacctgccctggggcacagagtaggtttcctgtgagctggtcggggccacggctgccgcctgcactgccctggggcacagactaggtttcctgtgagctggtcggggccatggctgctgcctgcacctgccccagggcacagagtaggtttcctgtgagctggtcggggccatggctgccgcctgcacctgccccggggcacagagtaggtttcctgtgagctggtcggggccatggctgccaccggcacctgccctggggcacagagtaggtttcctgtgagttggtcggggccacggctgccgcctgcactgccctggggcacagactaggtttcatgtgagctggtcggggccatggctgctgccggcacctgccctggggcacagagtaggtttcgtgttgcttggaacattaaggcgtaattttgattcagtttttcctaaagaagcattttgcatttttatggcttttgcagttcgggagaaagcttctctattttggatgcatttcagaagggcgttctattaaacatgaatctgcaaacagattaacatgcgtctgtgttccccacgaaaggcctgctgtgcagggcgccttgtgtgctttagttgctaggaaaccccgggcgttggtggtcagagtcccactggccccgtgtgtccccccctcccgacgggtcacggtgcttggggcttgcgcatgggcatctgtgcccatgaaccttgtcacccacgtgccagtgaaccgccagcttgtggccgcctggttttccaccggtggcagtgatggcctttggggcagaccaaggtgccatgagtccctgcttcccgtggcctgggagggcccttgcaccttcaggtggggtgtagtgccagacctctgggaaggctgtcctgccggcagcacccgtcagcacccactctgtgaatttaatacaaggcctttgctttgtgcatacgacttctgattaattttcgtttccaccatctgaagtgggcctggctgcgcctcaggcctctggtctctggctcagaaccagacaaggcaagggatttcctgtttttcattcttgcacttttaataaaatcgtaggggtttcgagtttgcgatagcaaaagaaaacattaa

SEQ ID NO: 664 - DNA, 2159 bp, Homo sapiens
gcacaaatcctgaagagcccgtgggcgtggactgctcatctgtaaagaaagtggagacatgaccttgagatttggctgacccagcaatgctggggccttcgcaagtctgatgttccaggactccagtgcctgttggtgtggacggaggacacggggccccgaccatggtcacactcatcactgagaagctgcagagccagagcctggacgacctcacctgcaaggcggaggctggcccgttgcagtattctgcggaaaccctgaacaagagcggtcgtctgttccctttggagctcaacgaccagagtccctggaaggtcttcagtggaggaccgcccgtcagaagccaggcagccacgggccctgatttctccttcctgccgggcctgtctgctgccgctcacaccatgggtcttcagtggcagccacagtccccgcgcccaggcgcaggcctgggtgcagccagcaccgtggaccccagtgaaagcacaggctcgtccacggccccaccgaccaagcggcattgccggtccttgtcagaacccgaggagcttgtgcgctgccggtccccctggcgccccggcagctccaaggtctggactccagtctccaagaggcggtgcgacagcggcgggagtgccacgcggcagggaagccccggcgccgtcctgccgaggagtgctgtgtggtcgaccggtcccacctcgcccgccacgccccggccgtcctccgccagcggcggcttcgtggacagcagcgagggcagtgcgggctcaggcccgctctggtgttccgcggagtcctgcttgccctccacgaggcgccgcccgtccctctcacaggagcgactcgcgggtgcgggcactcccctgccctgggccagcagcagccccacgtccacgcctgcgctgggcgggcgccgtgggctgctccggtgccgctcacagccttgcgtgctcagtgggaagaggagccggcgcaaacggaggcgtgaggaggacgccaggtggacacgcccatccttggacttcctgaaaatgacccagactttaaaaaattcaaaaagcctttgctccctcaattacgaagatgacgatgaggatgacaccccagtgaagacggttctgtcctccccatgtgactcccggggcctccctggcatcaccatgcctggctgcagccagaggggcctcaggaccagccctgtccaccccaacctgtgggcctctagggagtcggtgaccagtgatggctcccgcaggagcagcggggacccccgtgatggggacagtgtcggggaggagggcgtcttcccccgggcccgctgggagctggacctggagcagatcgagaacaactgaggctggtgggggctggtcggggccatggctgccgcctgcacctgccctggggcacagagtaggtttcctgtgagctggtcggggccacggcccggcacctgccctggggcacagagtaggtttcctgtgagctggtcggggccacggctgccgccggcacctgccctggggcacagagtaggtttcctgtgagctggtcggggccacggctgccgccggcacctgccctggggcacagagtaggtttcctgtgagctggtcggggccacggctgccaccggcacctgccctggggcacagagtaggtttcctgtgagctggtcggggccacggctgccgcctgcactgccctggggcacagactaggtttcctgtgagctggtcggggccatggctgctgcctgcacctgccccagggcacagagtaggtttcctgtgagctggtcggggccatggctgccgcctgcacctgccccggggcacagagtaggtttcctgtgagctggtcggggccatggctgccaccggcacctgccctggggcacagagtaggtttcctgtgagttggtcggggccacggctgccgcctgcactgccctggggcacagactaggtttcatgtgagctggtcggggccatggctgctgccggcacctgccctggggcacagagtaggtttcgtgttgcttggaacattaaggcgtaattttgattcagtttttcctaaagaagcattttgcatttttatggcttttgcagttcgggagaaagcttctctattttggatgcatttcagaa

SEQ ID NO: 665 - DNA, 558 bp, Homo sapiens
gtcgccctgagcgagcggggcctgggcggccggcagtcttctcgctccgcacccccgcggccgcgctcaggcacaaatcctgaagagcccgtgggcgtggactgctcatctgtaaagaaagtggagacatgaccttgagatttggctgacccagcaatgctggggccttcgcaagtctgatgttccaggactccagtgcctgttggtgtggacggaggacacggggccccgaccatggtcacactcatcactgagaagctgcagagccagagcctggacgacctcacctgcaaggcggaggctggcccgttgcagtattctgcggaaaccctgaacaagagcggtcgtctgttccctttggagctcaacgaccagagtccctggaaggtcttcagtggaggaccgcccgtcagaagccaggcagccacgggccctgatttctccttcctgccgggcctgtctgctgccgctcacaccatgggtcttcagtggcagccacagtccccgcgcccaggcgcaggcctgggtgcagccagcaccgtggaccccagtgaaagc

SEQ ID NO: 666 - DNA, 2086 bp, Homo sapiens
ggttcggtggcgcgagaggcggggagtcgccgtggcacaaatcctgaagagcccgtgggcgtggactgctcatctgtaaagaaagtggagacatgaccttgagatttggctgacccagcaatgctggggccttcgcaagtctgatgttccaggactccagtgcctgttggtgtggacggaggacacggggccccgaccatggtcacactcatcactgagaagctgcagagccagagcctggacgacctcacctgcaaggcggaggctggcccgttgcagtattctgcggaaaccctgaacaagagcggtcgtctgttccctttggagctcaacgaccagagtccctggaaggtcttcagtggaggaccgcccgtcagaagccaggcagccacgggccctgatttctccttcctgccgggcctgtctgctgccgctcacaccatgggtcttcagtggcagccacagtccccgcgcccaggcgcaggcctgggtgcagccagcaccgtggaccccagtgaaagcacaggctcgtccacggccccaccgaccaagcggcattgccggtccttgtcagaacccgaggagcttgtgcgctgccggtccccctggcgccccggcagctccaaggtctggactccagtctccaagaggcggtgcgacagcggcgggagtgccacgcggcagggaagccccggcgccgtcctgccgaggagtgctgtgtggtcgaccggtcccacctcgcccgccacgccccggccgtcctccgccagcggcggcttcgtggacagcagcgagggcagtgcgggctcaggcccgctctggtgttccgcggagtcctgcttgccctccacgaggcgccgcccgtccctctcacaggagcgactcgcgggtgcgggcactcccctgccctgggccagcagcagccccacgtccacgcctgcgctgggcgggcgccgtgggctgctccggtgccgctcacagccttgcgtgctcagtgggaagaggagccggcgcaaacggaggcgtgaggaggacgccaggtggacacgcccatccttggacttcctgaaaatgacccagactttaaaaaattcaaaaagcctttgctccctcaattacgaagatgacgatgaggatgacaccccagtgaagacggttctgtcctccccatgtgactcccggggcctccctggcatcaccatgcctggctgcagccagaggggcctcaggaccagccctgtccaccccaacctgtgggcctctagggagtcggtgaccagtgatggctcccgcaggagcagcggggacccccgtgatggggacagtgtcggggaggagggcgtcttcccccgggcccgctgggagctggacctggagcagatcgagaacaactgaggctggtgggggctggtcggggccatggctgccgcctgcacctgccctggggcacagagtaggtttcctgtgagctggtcggggccacggcccggcacctgccctggggcacagagtaggtttcctgtgagctggtcggggccacggctgccgccggcacctgccctggggcacagagtaggtttcctgtgagctggtcggggccacggctgccgccggcacctgccctggggcacagagtaggtttcctgtgagctggtcggggccacggctgccaccggcacctgccctggggcacagagtaggtttcctgtgagctggtcggggccacggctgccgcctgcactgccctggggcacagactaggtttcctgtgagctggtcggggccatggctgctgcctgcacctgccccagggcacagagtaggtttcctgtgagctggtcggggccatggctgccgcctgcacctgccccggggcacagagtaggtttcctgtgagctggtcggggccatggctgccaccggcacctgccctggggcacagagtaggtttcctgtgagttggtcggggccacggctgccgcctgcactgccctggggcacagactaggtttcatgtgagctggtcggggccatggctgctgccggcacctgccctggggcacagagtaggtttcgtgttgcttgg

SEQ ID NO: 667 - DNA, 1948 bp, Homo sapiens
cgcagagtttcaaatcggctgcggtgggcgaggagcagctgtgctgcggctgtgctcggccttagtggtgtcggggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagagccgtcaacctcaacctccgcgcagggccctcctggaaacgcctggaaaccccagagccaggtcagcagggcctccaggctgcagctcgctcagctaagagtgctttgggtgccgtgtcccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagagtggtgacatcgtctctctcattcatgactgaggaagtgcctgcaggaaacaagccctgtctgaccgccaaggcttcatactcaaggatgtctatgcttccccgtgagcttcctggaaaaaacccccgggagtcgtcagtacccctgggccactgctaacaagcacctaacaaggggcccagagccccctgctccagccacatctggacccatcagtgactgcctgccatagcctgagagtgtcttggggagaccttgcagagggggagaattgttccttctgctttcctaggggactcttgagcttagaaactcatcgtacacttgaccttgagccttctatttgcctcatctataacatgaagtgctagcatcagatatttgagagctcttagctctgtacccgggtgcctggtttttggggagtcatccgcagagtcactcacccactgtgtttctggtgccaaggctcttgagggccccactctcatccctcctttccctaccagggactcggaggaaggcataggagatatttccaggcttacgaccctgggctcacgggtacctatttatatgctcagtgcagagcactgtggatgtgccaggaggggtagccctgttcaagagcaatttctgccctttgtaaattatttaagaaacctgctttgtcattttattagaaagaaaccagcgtgtgactttcctagataacactgctttctcataataaagactatttgcatttgacatctgttccctttcaccggcaacctccaacctcccccgccctcccacaccactctgggctatagatttgtaatttgtggtttggggtctggccctcatccacctctgctccgagccagtctgcccccaatcccaccccagggagaacatgtagaaagggaaaggtttctcaacttagttcagaccaaaacacattgtaaaggcaaagaaggtttttatttaagtgacaacatttgagagctaaaaaccagctcacatcaaaatcaagacccagttgtaaaaatcttttaactccataatgctgtttttgtcttgttagaaatctgatatcttacattagcgtttctaacggattttgtacaaggcagccataaggaatataataaacctttttcaccacagaa

SEQ ID NO: 668 - DNA, 1470 bp, Homo sapiens
ggcgaggagcagctgtgctgcggctgtgctcggccttagtggtgtcggggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagagccgtcaacctcaacctccgcgcagggccctcctggaaacgcctggaaaccccagagccaggtcagcagggcctccaggctgcagctcgctcagctaagagtgctttgggtgccgtgtcccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagaggaaacaagccctgtctgaccgccaaggcttcatactcaaggatgtctatgcttccccgtgagcttcctggaaaaaacccccgggagtcgtcagtacccctgggccactgctaacaagcacctaacaaggggcccagagccccctgctccagccacatctggacccatcagtgactgcctgccatagcctgagagtgtcttggggagaccttgcagagggggagaattgttccttctgctttcctaggggactcttgagcttagaaactcatcgtacacttgaccttgagccttctatttgcctcatctataacatgaagtgctagcatcagatatttgagagctcttagctctgtacccgggtgcctggtttttggggagtcatccgcagagtcactcacccactgtgtttctggtgccaaggctcttgagggccccactctcatccctcctttccctaccagggactcggaggaaggcataggagatatttccaggcttacgaccctgggctcacgggtacctatttatatgctcagtgcagagcactgtggatgtgccaggaggggtagccctgttcaagagcaatttctgccctttgtaaattatttaagaaacctgctttgtcattttattagaaagaaaccagcgtgtgactttcctagataacactgctttctcataataaagactatttgcatt

SEQ ID NO: 669 - DNA, 1515 bp, Homo sapiens
ggcgaggagcagctgtgctgcggctgtgctcggccttagtggtgtcggggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagagccgtcaacctcaacctccgcgcagggccctcctggaaacgcctggaaaccccagagccaggtcagcagggcctccaggctgcagctcgctcagctaagagtgctttgggtgccgtgtcccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagagtggtgacatcgtctctctcattcatgactgaggaagtgcctgcaggaaacaagccctgtctgaccgccaaggcttcatactcaaggatgtctatgcttccccgtgagcttcctggaaaaaacccccgggagtcgtcagtacccctgggccactgctaacaagcacctaacaaggggcccagagccccctgctccagccacatctggacccatcagtgactgcctgccatagcctgagagtgtcttggggagaccttgcagagggggagaattgttccttctgctttcctaggggactcttgagcttagaaactcatcgtacacttgaccttgagccttctatttgcctcatctataacatgaagtgctagcatcagatatttgagagctcttagctctgtacccgggtgcctggtttttggggagtcatccgcagagtcactcacccactgtgtttctggtgccaaggctcttgagggccccactctcatccctcctttccctaccagggactcggaggaaggcataggagatatttccaggcttacgaccctgggctcacgggtacctatttatatgctcagtgcagagcactgtggatgtgccaggaggggtagccctgttcaagagcaatttctgccctttgtaaattatttaagaaacctgctttgtcattttattagaaagaaaccagcgtgtgactttcctagataacactgctttctcataataaagactatttgcatt

SEQ ID NO: 670 - DNA, 2515 bp, Homo sapiens
agaagtcctgtagggagatgggcagttaccttctctccgtctctctctcggggactctatttgtggctggtggagctgtcttaaacgaagagaaccatgagcaatgaatcttgtttaccttattacacagcccacagctactcttcaatgagtgcgttcaaaacctccatgggggacctgcaacgacaattgtacaacagaggagagtacaacattttcaagtatgcaccaatgttcgagagtaattttattcagataaacaaaaagggagaggtgattgatgtacacaaccgtgtccgaatggtgacagtgggcatcgtctgcaccagccccatcctcccactgcctgacgtcatggttctggcccaaccaactaaaatctgtgaacagcatgtcagatggggccggtttgccaaggggagaggtcgcaggcccgtcaagactctagagctcacgagactgcttcccttgaaatttgtgaagatctccatccacgatcatgagaaacagcagctgcgcctgaaactcgccactggccgtactttttatctgcagttgtgtccctcttctgacacacgggaagatctcttttgctattgggaaaaacttgtctatctcctgaggccaccagtagagagttactgcagtaccccaacacttctatctggggacgcaccacccgaagacaacaaaagcctagtggctgcagagctccacagagaaggggatcagagtgagactgggctctacaagccttgtgatgtatctgcagccacctcttctgcttatgctgggggagagggaatccaacatgcctcccacggaacggctagtgcggcttctccatccacgagcactccaggggctgctgaaggaggagcagcaaggacagcaggtggcatggcagtggcaggaacagcaacaggacctagaacagatgtggcaatagcaggggcagcaatgagtcctgcaacaggtgctatgagcatagcaacaaccaaatctgcaggcccaggtcaagtgaccacagcgctggcgggagcagctatcaaaaatccaggagaaaatgaatccagcaagtccatggcaggtgctgccaacatatcctcagagggtattagcttggccttggtgggtgctgcaagcacctccttggaaggtacttccacctcgatggcgggggccgccagtctctcccaagacagcagcttgagtgcggcgtttgcaggcagtattacgaccagcaagtgtgcagcagaaagaactgaaggaccagcagtgggacccctcatctccaccttgcaaagcgaaggctacatgagtgaacgagatggaagccagaaagtttcccagcccagtgctgaagtctggaatgaaaacaaggaaagaagagaaaagaaggacagacatcccagtaggaaaagttctcatcaccgcaaggcaggtgaaagtcaccgcaggagagcgggggacaagaatcagaaagcgtcttcccaccggtccgcatctggccataaaaacacgagagatgacaaaaaagaaaaagggtacagcaacgtaaggggcaagcgacatggctcctctcgcaagagctccacccacagctccaccaaaaaggagtcgagaacaactcaggaactggggaagaaccaatctgcatctagcacaggagctttacaaaagaaagccagtaagatcagctcttttttaaggagcctcagggccactcctggttcaaaaacaagggtcacatcacatgacagagaggtagatatcgtggctaagatggtggagaagcaaaacatagaggccaaagtggagaaagcccagggtggccaggagctggagatgatcagtggcactatgacatccgagaagacggagatgatcgtctttgaaaccaaatccatttaaagaggagccagggctacaaccgcccagggatctggaagtatccctagaggagcccatcccagctttctttactgcagttcaaataataaaggaaatcgtacaactccaaaagaaatacaatctcctgcttgaatttttctgcccatagcctggtggtgacctcacagtggcttctgtgatggtggctatgctacagctggagaccccagcctccaggcaagtagagctccaccacccgcccacggccagcagagccaacgtgagtgttcagctttgcctcaatcccttttgcttccccgagactgtcaaagccacagactaagagctgggatgcatggccaccaccatgtcccctcgcccattctcctcttttccctgaatgcccctgaacatggacattcagtccagttcttagcctatgcagagacaggattcacatcccctcaggggatattcagggtaggaaggagcaatacagcagtatttgtaggcaattagaataggaaatctattcttctagatcaggaattggcaaatcatgttctgaggtccaaatcttaccagctgcctggatttgtaaataaagttttattggaacata

SEQ ID NO: 671 - DNA, 4888 bp, Homo sapiens
ggcgcgcggagccaggtgggaggtgcgaggtggccgcgcggggatcttgggtgacagggcaccgagggaaggaggacgcgagggcagccaggccctagggagcagggagagtggctcgggctcagtcgcgtggccccaggaagaagaaattgtcgagacgaataacatgaggtcatatagaatcccacttttggtgatttcaagtcaagaaagtaaaagtaaaccattgctatctttcaccttaaatatcctgtgttttattgctcagaacatccagtttttctaatactcatgatgtcagaagggaaacctcctgacaaaaaaaggcctcgtagaagcttatcaatcagcaagaataagaaaaaagcatctaattctattatttcgtgttttaacaatgcaccacctgctaaacttgcctgccccgtttgcagtaaaatggtgcctagatatgacttaaaccggcaccttgatgaaatgtgtgctaacaatgacttcgttcaagtggatccagggcaggttggcttaataaattcaaatgtgtctatggtagatttaaccagtgttaccttagaagatgtaacacctaagaagtcaccaccaccaaagacaaatttaacccctggccaaagtgattcagcaaaaagggaagtaaagcagaagatcagtccctactttaaaagtaatgatgtggtgtgcaaaaatcaagatgagctgagaaatcgtagtgtgaaagtcatttgtttgggaagcctagcatctaaattgtccagaaaatacgtaaaggctaaaaaatcaatagataaggatgaagaatttgccggttctagtccacagagttccaaatccacagttgttaagagcctgattgataactcttcagaaattgaggacgaggatcaaattttggagaacagttctcaaaaagaaaacgtgtttaaatgtgattctctaaaggaagagtgcattcctgaacatatggtaagaggaagtaaaataatggaagccgaaagccaaaaggctacccgggaatgtgagaaatcagccctcacccctggattctcagataatgcgatcatgttattctcaccagatttcactcttaggaatacattaaagtctacttcagaagacagtcttgtaaagcaagagtgtatcaaagaagtggttgaaaaacgtgaggcatgtcattgtgaagaagtaaaaatgactgttgcttcagaagctaaaatacagctgtcagattcagaggcaaaatctcatagttctgcagatgatgcttctgcatggagtaacatccaagaggctcctctgcaggatgacagttgcttaaacaatgatatccctcacagcattcctttggagcaggggtcaagctgcaatggtcctggtcaaacaaccggtcatccttactaccttcggagtttccttgtggtgctgaaaaccgtacttgagaatgaagatgatatgttgctctttgatgagcaggagaagggaattgtaactaaattttatcagttatcagctactggtcagaagttatatgtaaggctctttcaacgtaaattaagctggattaagatgaccaaattagagtatgaagagattgccttagacttaacacctgtgattgaagaattgacgaatgcaggctttctacagacagaatctgagttgcaagaactctctgaagtgcttgaactcctttctgctcctgaactaaaatccctagccaagaccttccacttggtgaatcccaatggacagaaacagcagctggtggacgcctttctcaaattggccaaacagcgttcagtctgcacttggggcaagaataagcctggaattggtgcagtgattttaaaaagagccaaagccttggctggacagtcagtacgaatctgtaaaggccccagggctgtgttttcccgcatcttgctactgttttcgttgaccgactcaatggaagatgaagacgccgcttgtggaggtcagggacagctttcaacagtcctgttggtcaacctcggccgaatggagtttcctagttacaccatcaatcggaaaacccacatcttccaagacagagatgatcttatcagatatgcagcagccacgcacatgctgagtgacatttcttccgcaatggccaatgggaactgggaagaagctaaggagctcgctcagtgtgcaaaaagggattggaacagactgaaaaaccacccttctctgagatgccacgaagatttaccactcttcctgcggtgtttcactgttgggtggatttatacaaggattttgtctcggtttgtggaaatactgcagagacttcacatgtatgaggaagccgtcagagaacttgaaagccttttgtctcagagaatttattgtcctgacagcagaggccgatggtgggatcgactggcccttaatttacaccagcacttgaagcgcctggaaccgactatcaagtgcatcacagaggggctggcggatccggaagtcagaacgggacaccgcctttcactgtatcagcgagccgtgcgcctgcgagagtctccgagctgtaaaaagttcaagcacctcttccagcagctcccagaaatggctgtgcaagatgtgaaacacgtgaccatcacaggcaggctgtgcccacagcgtgggatgtgcaagtctgtgtttgtgatggaggccggggaggccgctgaccccaccacggtcctgtgctctgtggaggagctggcactggcccattacagacgcagcggttttgaccaggggattcatggcgaagggtccaccttcagcaccctgtatggcctcctcctgtgggacatcatcttcatggatgggattccggatgtcttcagaaacgcctgtcaggcattccccctggacttgtgcacagacagcttcttcacaagcagacgcccagcccttgaggccaggctgcagctgattcatgatgcccccgaggagagcctgcgggcctgggtggcagccacgtggcatgagcaggaaggcagagtggcttcccttgtcagctgggatcgcttcacgtctcttcagcaagctcaggatcttgtctcctgcctggggggccctgtgctcagtggtgtgtgcaggcacctggctgctgactttcgacactgtcgagggggcctccccgacctggtggtgtggaactcccagagccgtcactttaagctggtggaagttaaaggccccaatgatcgtctttcacataagcagatgatctggctggctgaactgcagaagctgggggctgaagtagaagtctgccatgtggttgcagttggagctaagagccaaagccttagctaaaagattccctacaggagaaaatggaaatgaggaggagagaaactccggtgtccccgaggtgtcggtgtggtgagggccgctggcgttgaagtacatcctgctctggcccagctccccatagcaggcctccagggggccactgcgctgttgccgcagcatcctgctcagtacgtcgacttcatcagccaggagggagagcttgtgaaaggctgtgatggagccacccaggctgatctgggcctcgggaacccagcggaagtagcacagtttccacagttttatgtgtgttccagagacacgtggcagaataacaccgtgcaggttggcgggtttggaaaaccattctctaaaatactgctccgtatcactgttctggctgtcggtttgctgagctggatctggctttggttttaatatcaatgaatttctccttggaagtaattcttggtcactgatgattccattctttaaggcagacggcattcctcttagtgtggagctgtagcttttctatacagaagagattttattatgttccggggattccctttttagaaagattgaaggatgcaatggcaaatataaactcaatactatgaaaaattaatggaatttcagcctcaaagaacattttcctcccttcctttgtgtccttattctaatcctcctcccctggaattacacttttttatgtgttgactctacctaggctgttactatcagcctgaatgggggcgggatgagagtacctcctatccactaatttgcttaaggataagttctaagacgggctagaaaaaacactagacctggccgattctatcaagaacaatggcaaactgaacagaggcagtcaggaggccaaatgtctgattctttgttctgtacctttcagtagtctgcaaattttctaccaaaaaaaatcccaagaatttatttgggaattattaaaaaggcaaacaatgaatgttattaggacaagaatatagcagtcaggaggccatgactacatcacagccaggcggcattccctgccacagtggcggcttgaatcatcaagaaatggataaatggggctttagtaaatcaggcttgcaggctcaaagctgcaatctgcccactctcaggtactgagactttgtgggcctcagacaccaggaagaaagctgggatacagtcatttgagttaaaaagggaatgacccctcagaaacccgcattagcagtgttactcttggaagtgcctttacttttaacgctctctgttctgaaaaagaggtgtttggttacgtgtgagccaacatcacgttttgttagctgtgatttacctttgtccgtttaaaagacttcacggagccattctgtatacaaggtgtgctctttccaatgtagaaggggttatggaaaagggtgcgatcctttgctgtaaactggagagaccagtcccaaacagaggggaattttaagcccttctcatcacccaattggatgtttttgcttatagcaaattcctgcaaaataaataaataaatatttgcaaaact

SEQ ID NO: 672 - DNA, 2738 bp, Homo sapiens
ctgggaatgcctggaagcgccggcgcgcggagccaggaagaagaaattgtcgagacgaataacatgaggtcatatagaatcccacttttggtgatttcaagtcaagaaagtaaaagtaaaccattgctatctttcaccttaaatatcctgtgttttattgctcagaacatccagtttttctaatactcatgatgtcagaagggaaacctcctgacaaaaaaaggcctcgtagaagcttatcaatcagcaagaataagaaaaaagcatctaattctattatttcgtgttttaacaatgcaccacctgctaaacttgcctgccccgtttgcagtaaaatggtgcctagatatgacttaaaccggcaccttgatgaaatgtgtgctaacaatgacttcgttcaagtggatccagggcaggttggcttaataaattcaaatgtgtctatggtagatttaaccagtgttaccttagaagatgtaacacctaagaagtcaccaccaccaaagacaaatttaacccctggccaaagtgattcagcaaaaagggaagtaaagcagaagatcagtccctactttaaaagtaatgatgtggtgtgcaaaaatcaagatgagctgagaaatcgtagtgtgaaagtcatttgtttgggaagcctagcatctaaattgtccagaaaatacgtaaaggctaaaaaatcaatagataaggatgaagaatttgccggttctagtccacagagttccaaatccacagttgttaagagcctgattgataactcttcagaaattgaggacgaggatcaaattttggagaacagttctcaaaaagaaaacgtgtttaaatgtgattctctaaaggaagagtgcattcctgaacatatggtaagaggaagtaaaataatggaagccgaaagccaaaaggctacccgggaatgtgagaaatcagccctcacccctggattctcagataatgcgatcatgttattctcaccagatttcactcttaggaatacattaaagtctacttcagaagacagtcttgtaaagcaagagtgtatcaaagaagtggttgaaaaacgtgaggcatgtcattgtgaagaagtaaaaatgactgttgcttcagaagctaaaatacagctgtcagattcagaggcaaaatctcatagttctgcagatgatgcttctgcatggagtaacatccaagaggctcctctgcaggatgacagttgcttaaacaatgatatccctcacagcattcctttggagcaggggtcaagctgcaatggtcctggtcaaacaaccggtcatccttactaccttcggagtttccttgtggtgctgaaaaccgtacttgagaatgaagatgatatgttgctctttgatgagcaggagaagggaattgtaactaaattttatcagttatcagctactggtcagaagttatatgtaaggctctttcaacgtaaattaagctggattaagatgaccaaattagagtatgaagagattgccttagacttaacacctgtgattgaagaattgacgaatgcaggctttctacagacagaatctgagttgcaagaactctctgaagtgcttgaactcctttctgctcctgaactaaaatccctagccaagaccttccacttggtgaatcccaatggacagaaacagcagctggtggacgcctttctcaaattggccaaacagcgttcagtctgcacttggggcaagaataagcctggaattggtgcagtgattttaaaaaggttttgttggctattgttacagtaaaaacatttaaaatgttgatagcacatattaacttacagtagattgtatacttgattgaactgtaattgtttatttcagttgtagttagattgagaaggctggaaaagccttaattgcaatagcctggattctttcttgggttattattcaaaatttttgtcgtaataccgtactaatttccaggaccaagaaaaatcggaaggcaataggcctttggtaaattgtagtattttattttccgagaaaaatacagttttaagtgattcttatgggattttaaggtaaactatttagtcaaatttttattttagtttttgtttactaaacaaagtataatcaggcagtcttaatgtgcaagttttcctgagtttaaacgtaacaatttaccaaaaactgtgagtggcttcttttgtccttgagaagcccttgacctgtttcagttgaaaattacaaaaacttttagaattgatttcttttgcccatgttatttatataatcaaactatatcaactctagcctgggaattcactactgtggagtcgaggatgaaatgagaggatgcttttgaaaacactttaacatgatgttgttatttattttatatatttgttttgtatatttcagttgttatgagcccatccttgttggggaggtgctataaatactaatctttaatgaaacataggtgtaataaggcagacattaagaaaaatataaataccaacacttgaaaaaagctcgtgttatagatttttaaaaagtacttcaataaattacatacttgtaattaattgacttgagaagtatagaatcctcatctgtgtggtatgttaaatgtcttctaagtcctttctttatctaattgtatttcttaagtatttgatgttaaccttatatgtaacattttataagcaagtaaacattaaatttagccaccctctggctggg

SEQ ID NO: 673 - DNA, 3124 bp, Homo sapiens
cgggaggccggaccggggagccgagcggcggcgtcggcggcgtcggcggcggcggcgacggcggcgggggcggtaatggcggagctggtgcaggggcagagcgctcctgtggggatgaaggccgagggcttcgtggatgccctgcaccgggtccggcagattgctgctaaaattgattcaattcctcacttgaataattccacacctctagtggacccctcagtatatggatacggagtacaaaaacggcccttggatgatggagtaggtaaccagttaggggccttggtacatcaaaggacggtaataacggaagaattcaaagtgcctgacaaaatggttggatttattatcggcaggggaggtgagcagatttcacggattcaagcagaatctggttgcaaaattcagattgcttcagagagttctgggattccagagaggccctgtgtacttaccggaaccccagaaagtattgaacaagccaaacggctcctgggacagattgtggaccgctgtcgaaatggacctggctttcataatgacatagacagcaacagcacaatccaggagattctcattcccgcatctaaagtgggtctggtcatcggcagaggaggggaaacaatcaagcagttgcaggagcggacaggggtgaagatggtcatgatccaggatggcccattgcccacgggagcagacaagcctcttcgtatcactggagatgcatttaaagtacagcaagcaagagaaatggtactagagattatccgagaaaaagaccaagctgactttcggggtgtacgcggcgatttcaactctcgaatgggaggaggcagtatagaggtatctgtgcctaggtttgctgtggggattgtaataggaagaaacggggaaatgatcaaaaagatccagaatgatgctggtgtgaggattcagtttaaaccagatgatgggattagtccagaaagagctgcccaggtcatgggccctccggatcggtgtcagcatgcagcgcatatcatcagcgagctgattcttacagcccaggaaagagacggctttggaggcctggcagcagccagaggaagaggtcgtggccgtggcgactggagcgtgggagcccctggtggcgtccaggagataacatacacggtgccagccgataagtgtggcctcgtcataggcaaagggggtgagaacatcaaaagcatcaaccagcagtcaggggcgcacgtggagcttcagaggaacccccctcccaacagcgaccccaacctgcggagattcaccatcaggggggttccccagcagatcgaggtggccaggcagctcatagatgagaaagttggcgggaccaatctcggagcacctggagccttcggacagagtccattcagccagccacctgccccacctcatcaaaatacctttcctccaaggagctccgggtgcttcccaaacatggctgccaaggtgaatgggaacccccacagcacccctgtgagtggtcctccggcctttctgacccagggctggggcagcacctaccaggcgtggcagcagcccacacagcaggtcccaagccagcagagccagccgcagagcagccagcccaactacagcaaggcctgggaagactattacaaaaaacagagtcacgccgccagcgctgctcctcaggccagctccccaccggactacacaatggcctgggcagaatattacagacagcaggtcgctttctacggacagacgttagggcaggcgcaggcccacagccaggagcagtaggacagcgtcctcgtggccaactctcccctcaaaatcattgtcaaagaaaacctatttgtaacagaggtttttacatttgcaaaccttttgatgaagaactgttgttttgttctgtgaaacactatatttagattaacggaatttttctaaaaatcaggaaaattagttactaaaaattgctgatcatttttgtttcattatttttgttatttcaaatgtataagctctgggattctttttggagcaatacctacaaagtcaggcaccagaatgtgcctcagagctgtgacatttcaacatgatggttttggtttggtttggttttgtgtcctttttatttgcagttttttctgttgcaacagaaagtggcttggaagtcttaggtggtatgtaacaaattctttttaaaaattttaaagcagtatttaagtattcttaaatgtgtaaattcatttaatgttttacttctaatttcttgtatcttggctgtctggttttattgcatttttaaaaaaactgaactattatgtattgtaatgaatgatgtgaattctgaactgagacagataattgtattgctgtccaacaggggttgggaggggcattttgtagggtttgtataatttctagagttcgaaaggggtaatataaaaatgtgctcgtgtgtttagcctacgtttttctcatgcctccattaccagttgcaattgtgtatctaagacctccaagcttgtttttaaaacaaaacaaaaaacctttctctattatctcagaaatataaatactgttatttttaatattaagaaattcaatataacttttaacacacactgtggaacattaaaccgtataaaaatgtagttataactatttttaattccaaggtgttgtttgcttttttcttttaaatattttcttaatattttgtcagattaactagatgaataaataaatctagtattaaccgcattatgaattaaataattttgatttaatgaaagggataatatgatttccagtgtttactgtagtgtatcttgtacagataacatgtatttttaaaggaaaaaaaacggaattgaagctattttttcttgcatttctaattgacctgagggacattccgtttgaaatgtactgaagttacagtttctggttttttctccttatttttcttataatgcttgaaatgtctaactattaaaaaagacaattggaaaatgttatgcatggggtttttaagaaaacaaagtgttctttttatttgactgacaattcattttacactctatataataaaatctccacaaggcatcttgtgggcaaagtc

SEQ ID NO: 674 - DNA, 1071 bp, Homo sapiens
tttccttttccggctacgggtccccaagcggagcgggaggccggaccggggagccgagcggcggcgtcggcggcgtcggcggcggcggcgacggcggcgggggcggtaatggcggagctggtgcaggggcagagcgctcctgtggggatgaaggccgagggcttcgtggatgccctgcaccgggtccggcagattgctgctaaaattgattcaattcctcacttgaataattccacacctctagtggacccctcagtatatggatacggagtacaaaaacggcccttggatgatggagtaggtaaccagttaggggccttggtacatcaaaggacggtaataacggaagaattcaaagtgcctgacaaaatggttggatttattatcggcaggggaggtgagcagatttcacggattcaagcagaatctggttgcaaaattcagattgcttcagagagttctgggattccagagaggccctgtgtacttaccggaaccccagaaagtattgaacaagccaaacggctcctgggacagattgtggaccgctgtcgaaatggacctggctttcataatgacatagacagcaacagcacaatccaggagattctcattcccgcatctaaagtgggtctggtcatcggcagaggaggggaaacaatcaagcagttgcaggagcggacaggggtgaagatggtcatgatccaggatggcccattgcccacgggagcagacaagcctcttcgtatcactggagatgcatttaaagtacagcaagcaagagaaatggtactagagattatccgagaaaaagaccaagctgactttcggggtgtacgcggcgatttcaactctcgaatgggaggaggcagtatagaggtatctgtgcctaggtttgctgtggggattgtaataggaagaaacggggaaatgatcaaaaagatccagaatgatgctggtgtgaggattcagtttaaaccagatgatgggattagtccagaatattacagacagcaggtcgctttctacggacagacgttagggcaggcgcaggcccacagccaggatgag

SEQ ID NO: 675 - DNA, 2474 bp, Homo sapiens
gagcggcggcgtcggcggcgtcggcggcggcggcgacggcggcgggggcggtaatggcggagctggtgcaggggcagagcgctcctgtggggatgaaggccgagggcttcgtggatgccctgcaccgggtccggcagattgctgctaaaattgattcaattcctcacttgaataattccacacctctagtggacccctcagtatatggatacggagtacaaaaacggcccttggatgatggagcgatgggatcacactctgctcaggctagagtgcagtggcgccgttgaactcctgggctcgagtgatcctcccacctcggcttcccaagtagctgggactacaggcatgagccaccatgcctcctataggtaaccagttaggggccttggtacatcaaaggacggtaataacggaagaattcaaagtgcctgacaaaatggttggatttattatcggcaggggaggtgagcagatttcacggattcaagcagaatctggttgcaaaattcagattgcttcagagagttctgggattccagagaggccctgtgtacttaccggaaccccagaaagtattgaacaagccaaacggctcctgggacagattgtggaccgctgtcgaaatggacctggctttcataatgacatagacagcaacagcacaatccaggagattctcattcccgcatctaaagtgggtctggtcatcggcagaggaggggaaacaatcaagcagttgcaggagcggacaggggtgaagatggtcatgatccaggatggcccattgcccacgggagcagacaagcctcttcgtatcactggagatgcatttaaagtacagcaagcaagagaaatggtactagagattatccgagaaaaagaccaagctgactttcggggtgtacgcggcgatttcaactctcgaatgggaggaggcagtatagaggtatctgtgcctaggtttgctgtggggattgtaataggaagaaacggggaaatgatcaaaaagatccagaatgatgctggtgtgaggattcagtttaaaccagatgatgggattagtccagaatattacagacagcaggtcgctttctacggacagacgttagggcaggcgcaggcccacagccaggagcagtaggacagcgtcctcgtggccaactctcccctcaaaatcattgtcaaagaaaacctatttgtaacagaggtttttacatttgcaaaccttttgatgaagaactgttgttttgttctgtgaaacactatatttagattaacggaatttttctaaaaatcaggaaaattagttactaaaaattgctgatcatttttgtttcattatttttgttatttcaaatgtataagctctgggattctttttggagcaatacctacaaagtcaggcaccagaatgtgcctcagagctgtgacatttcaacatgatggttttggtttggtttggttttgtgtcctttttatttgcagttttttctgttgcaacagaaagtggcttggaagtcttaggtggtatgtaacaaattctttttaaaaattttaaagcagtatttaagtattcttaaatgtgtaaattcatttaatgttttacttctaatttcttgtatcttggctgtctggttttattgcatttttaaaaaaactgaactattatgtattgtaatgaatgatgtgaattctgaactgagacagataattgtattgctgtccaacaggggttgggaggggcattttgtagggtttgtataatttctagagttcgaaaggggtaatataaaaatgtgctcgtgtgtttagcctacgtttttctcatgcctccattaccagttgcaattgtgtatctaagacctccaagcttgtttttaaaacaaaacaaaaaacctttctctattatctcagaaatataaatactgttatttttaatattaagaaattcaatataacttttaacacacactgtggaacattaaaccgtataaaaatgtagttataactatttttaattccaaggtgttgtttgcttttttcttttaaatattttcttaatattttgtcagattaactagatgaataaataaatctagtattaaccgcattatgaattaaataattttgatttaatgaaagggataatatgatttccagtgtttactgtagtgtatcttgtacagataacatgtatttttaaaggaaaaaaaacggaattgaagctattttttcttgcatttctaattgacctgagggacattccgtttgaaatgtactgaagttacagtttctggttttttctccttatttttcttataatgcttgaaatgtctaactattaaaaaagacaattggaaaatgttatgcatggggtttttaagaaaacaaagtgttctttttatttgactgacaattcattttacactctatataataaaatctccacaaggcatcttgtgggcaaagtc

SEQ ID NO: 676 - DNA, 2412 bp, Homo sapiens
gtagaagtattgcgccgttggtgattacggaagaaccaggagtttggcgtgaccatggggaagcaaaagaaaacaaggaagtatgcgaccatgaagcgaatgcttagtctcagagatcagaggcttaaagaaaaggatagattaaaacctaaaaagaaagaaaagaaggatcccagcgcattaaaggaaagagaagttccccaacacccttcctgcttatttttccaatataatacacagctgggcccaccttaccacatcctcgttgataccaactttatcaacttttccataaaagccaaactggacttagtgcagtcaatgatggactgtctgtatgccaagtgtatcccatgtataaccgattgtgtaatggctgaaattgagaaattggggcagaagtatcgagtggctctaaggattgccaaggatccaagatttgaacgattaccatgtacacacaaaggaacctatgcagatgactgcttagtacagagagtaactcagcataagtgttacattgtggccacagttgaccgggacctgaaaagaagaatccgtaagattcctggagttcctatcatgtacatttctaaccatagatacaacattgaacggatgccagatgattatggagcccctcgattctaattcttacaagacacagttcctctgcctttcttcgaccaactttctcttgttgccagttcattacacaaaatgtagcgggatttttaaggaatcagagagactgatggagttcagggagatatttattatttaggtgcaccagcccagtcagattaacatccaaaggactgaaccctgaacagagttaagttaccttttaagcattttgtggggccgcgggggttggggggaatctgtgcagggggaagcatattacagaagcaagaaagacagttattcaattaactgagacatgcattacatcatttcttacttttcaaggaaaatcatgttttacgacttgagtttatctgtctagttaccttgcagctgcacagctagagaaacagggtatttacaatgcctgggaaaggaggagagataaggctcactagccacagaaaaacaggcagttaatttttaaaggactccagctctttctctttctcacggggaattggattttcttacatgcaactgaatttctgcttacacatttttaaatttcttttaattgcttttccaatgcaatagcatgaattattattctgttgacctatttgccttactatgagctgagggtagttcaatatgctcactcttttttttttttttcttgagatgaagttttgctctgtcaccaggctggagtgcagtggcgtgatctgggctcactgcaacccctgcctcccatccttcaagtgattctcctgcctcagcctcccgagtagctgggattacaggtacacaccaccatgctcaactaatttttcttttttgggcggggggggtggatatttttagtagagacaaatacttttgtatttttaatacagaaaagtatgcctcggcctcccaaagtgctggaattacagacatgagccactgtgcctggcctgctcactttctgatgctgcttttttgttgtttgtttgtttatttgtttgttttgagacggagtctcgctctgtcaccaggctggagtgcagtggcgcaatctcggctcattgcaacctccgcctcccaggttcaagcgattctcctgcctcagcctgcggagtagctgggactataggtgcgtgccaccacgtccagccactgatgctgttttgccactgatgctgttttgaaattgatattttgtctcataaaaactaggccaggcatggtggctcattcctgtaatcccagcactttgggaggccaaggtgggtggatcacctgaggtcaggagttggagatgagcctggacaacatggcaaaaccccacctctactaaaaatacaaaaaaaattagctgggtatggtgtcacgtgcctgtaatcccagccactggggaggctgaggcaggagaacctcttgaacccaggaggtggaggttgcagtgagctgagattgcgccactgcattccagcctgggtgacagagtgagactgtctcaaaaaaaaaaaaaaattaatgatggtcaaagggtataaaatctcagacaggaagaatatgttttatgctttttttgagttctgttgtacagtgtggtgcctatacttaataatggggtattatacatttcaaaattgatgttctcatcacagaaatgtatttgaagtattgcatatgttaactagcttgatttaactattccatattgtatccacaatttatgatatcactttgtaacccatacatttatacaattataaattgtcaatttacaataaaaaa

SEQ ID NO: 677 - DNA, 640 bp, Homo sapiens
accagcaacctcgcccctccctgcggaaaaccgatgagaggcagggccaagccgaagcgatggcggcctatccggagagctgcgtggacactacggtgctggacttcgtcgcagacctgtccctggcctccccgagacgccctctcctctgcgacttcgcacccggggtctccttgggggacccagcccttgcgctccgagagggaagacccaggaggatggcgcggtttgaagagggggacccagaagaagaggagtgcgaagtggaccagggggacggagaagaggaggaggaagaggagcgcggaagaggtgtctccctattaggccgccccaagaggaaaagggtgatcacctacgcccagcgccaggccgccaacatccgcgaaaggaagcggatgttcaacctcaacgaggcctttgaccagctgcggaggaaggtgcccacgtttgcttacgagaaaaggctgtcccggatcgagaccctccgcctggccatcgtctatatctccttcatgaccgagctcttggagagctgtgagaagaaggaaagcggctgagcctggtgtggagagtctgcccttcctcgtctggtagtgctggggtgtgtcaggaccgggcactgggtgaggctaaaggg

SEQ ID NO: 678 - DNA, 9536 bp, Homo sapiens
ttttgggtttgaaattccaacatggcagaggctgcagtccgtcttcccttcaaaaacttggaatgatttcaaatcataggcaccttcacttaaccctagcttccattcatcagcaaacacatcggatcgatgctacgctaacctatcgggttctctctccgcgcgttcaggttaaatgaatacctgacgaaagggcccacgtttcaaggcagtgacatttgatagctgagaggaaaagtggctttaatgaaaagcaacctttggaattcctgcttgtgagaaatccaattcagctttttgtgctgccagcaagaaatgatcagtagcaccagtgtttatggcttgaagatgcagtggacgccagagcatgcccagtggccagaacagcactttgacatcacctcaaccactcggtctcctgcccacaaagttgaagcctacagaggtcatctgcagcgcacctatcagtacgcctgggcgaatgatgacatatctgctctgactgcatccaacctactaaaaaaatatgcagagaagtattccggcattttggaaggtcctgtggaccgacccgtactcagcaactattcggacacaccatcaggactagtgaacggtcggaaaaatgaaagtgaaccctggcagccttccttgaattcagaagctgtttatcccatgaactgtgttccggatgttatcactgccagcaaagctggagtcagttcagccctccctccagcagatgtctctgcgagtataggaagctctcctggggtagccagcaacctgacagaacctagttattcaagtagtacctgtggaagccacactgtacccagtcttcatgcagggctcccatctcaggaatatgccccaggatacaacggatcatatttgcattctacttatagtagccagccagcacctgcacttccttcacctcatccgtctcctttgcatagctctgggctactacagcccccaccaccacctcctccgccaccagccttggtcccaggctacaatgggacttctaacctctccagttacagctatccgtctgctagctatcctcctcagactgctgtggggtctgggtacagccctgggggggcaccgcctccgccttcagcgtacctgccttcaggaattcctgctcccacccccctaccccccaccactgttcctggctacacctaccagggccatggtttgacacctattgcaccgtcggctctgacaaacagttcagcaagttctctcaaaaggaaagctttctacatggcagggcaaggagatatggactccagttatggaaattacagctatggccaacagagatctacacagagtcctatgtacagaatgcccgacaacagcatttcaaacacaaatcgggggaatggctttgacagaagtgctgaaacatcatccttagcatttaagccaacgaagcagctaatgtcctctgaacagcaaaggaaattcagcagccagtccagtagggctctgacccctccttcctacagtactgctaaaaattcattgggatcaagatccagtgaatcctttgggaagtacacatcgccagtaatgagtgagcatggggacgagcacaggcagctcctctctcacccaatgcaaggccctggactccgtgcagctacctcatccaaccactctgtggacgagcaactgaagaatactgacacgcacctcatcgacctggtaaccaatgagattatcacccaaggacctccagtggactggaatgacattgctggtctcgacctggtgaaggctgtcattaaagaggaggttttatggccagtgttgaggtcagacgcgttcagtggactgacggccttacctcggagcatccttttatttggacctcgggggacaggcaaaacattattgggcagatgcatcgctagtcagctgggggccacatttttcaaaattgccggttctggactagtcgccaagtggttaggagaagcagagaaaattatccatgcctcttttcttgtggccaggtgtcgccagccctcggtgatttttgttagtgacattgacatgcttctctcctctcaagtgaatgaggaacatagtccagtcagtcggatgagaaccgaatttctgatgcaactggacactgtactaacttcggctgaggaccaaatcgtagtaatttgtgccaccagtaaaccagaagaaatagatgaatcccttcggaggtacttcatgaaacgacttttaatcccacttcctgacagcacagcgaggcaccagataatagtacaactgctctcacagcacaattactgtctcaatgacaaggagtttgcactgctcgtccagcgcacagaaggcttttctggactagatgtggctcatttgtgtcaggaagcagtggtgggccccctccatgccatgccagccacagacctttcagccattatgcccagccagttgaggcccgttacatatcaagactttgaaaatgctttctgcaagattcagcctagcatatctcaaaaggagcttgatatgtatgttgaatggaacaaaatgtttggttgcagtcagtgataacttctttagaaaaaaaaaatgtaatgaatgttggcacacacacataaaacctgctacatagggaatagagcccctttccagtagagtttaaattgcaaagggtactggggaagatgacgattaagttgcatctttagagtcagggtagatttggaggaaaagtgcatcaaatgagagcttctgatttgaaagccccagatgacagaaagcatatgtggatgctcagttctgttcaagctagacaacactcaccaaggagcaaggtgcaagtgtgttgatttcagaaggacatgaacctcgtgtgttgattccattctgctgttctcgagatttagttgctgtcaagtgcctggagtggtgctttattttttgtttgcctcacaattacattggtggcatgtgctaatataaagagctttaacttcaaacattattggactaaagagatgaacagttgtgttatgacagaaaaccagatttttgccattttaagagcaacagtattcctcaatcctgtctgttctgcagtattaagctaagaacaggtaaaacagggtaacggtaatctggaccttaatttctgcagttcatttcttttaatgttcttgtctgcaaaaactcaggaaagtgattgtgatttgtacagtacctcaaaggaatgtgttgaaagcactatgtactgctgagagtaataggataggcttcaatgttactttatattaaaatgtatgtttacctcaacaattggaaaatagcaaggaaaattactttgaatgtatccagaaaaatactgaagtgtgatacaactgaatatttacagtttaaagtagaaatggaaggatttttttaagttcttttactaattatggggaattaaccagagcagaataattctttatgtcaataactgcaagagttcttagtacattgctccttgataattaagtgaaaatgttcttaaaaggtacactggttaattgaaagctacttattcagtttgtgttagtgtctagacctgtcagccacaagacctgtttaggaccctgaaagtcacagtacctaaaaactatgactgcctttttattgcataggtggtagtggtggtgatggtggtggtagtttgcaagttatctcttaaaactgctgggaatggtgtcattctattcactaatctagcttatagacttgccgtgctgtttgatagaatgcagaggatagcaaccaaaacaaatacacaaataaataaaaacaaaaaccaaccaacaaaccaacttacatacacatatatatatccacaaagaacctctccatctcctccccttctttttgactccactcttgtcagtgcaattttgcttctcattttgaaatctgggctgtagtgctcctgctttatttctacctcagttttgttacatttctcttggaaagtaaagtagaaaattggaagtggacacacacactgcaatgtagcttgccaaacatgttactttgttttcttccatctttcaccgtaaatctagtttccaaagacatcagcatttgtgcttacttccacctcagtctaccagccccacccctacccatggcataagtggcatttttcttaatttcctatttttctcctgctctctgtcaagttgttctttgtatcctttaatgctttatgtgcaacctttcattgatagtgggctgatgtttggcaatgcttctgaactgtcacagagcaggctgtagctttccacagccactgcccatgcataagcagaacagcctggccttttgaatgtattttcctgggttttttccccttttctttttttagtttagagatgcagtaacaaaactgttgcaaagcactggcattttatgtattcaataaataagtgatgtacatttttaaaaaaatttaaataaatgcaatgagaagccccaagaaaggcctttctgttttttttttcttacaaaaatttttaccgatcttatccacaatatccaattctctgaaacacttaacatagagaaagctcatgagggatttcttatctctgaaattttatgatgcttgatctttactcccctttttttattttttatgttgctaaaaactgagcaattgaaccagaatttaatttactgtgacattctgtcaattaaagctgtgcttaaatataaatattccatattaaaaagcagtgcctttcattaaggatacaaaaaataatacttaaatacgccctctgcttttcgcaagtgaataaatgctacaatcgtgttctgggtctaccctgtgcatcccttgtaaggaaattctaatatccacattaacttgtaggttcatattgatctcactgacaagtttacttttgcacagtgctgacctattttctgacttttagacattatatttcatttccgccaacatgctgtgttcacttgaaagcgtctggcaagttttgacaaacccagtcttatttagacaactttggaaaatccaatattgacccacatttttttgtggctagtaagatttaatgccaaatatatgactgcactattgtgttttacactcatttataaaactgaaaataaattgaagtcatacatcttggcttttagctttaagtgacttaaaaattagaactctgagtgacttaaaaattaatttgagatgcaagtggtcaaaaatccatgtatttagacagaagctgaagtcgtatgtgattttcatttagcctcacaaaatccaagatttgatctcttaggaaattgggcatgttgaagaaatgaagatctgttggaggagatatggctgacctttgagtagatagtgctctcctgtgattctttgattctgcatggcagcattatgagctcttctataaactagcttaataatgagctctattctgaccatctattctggaacttggagtgggggtggggtaccacatcctcagaagtgaatgtgtacagtcggtgatagtacaactgagtaatggggcttcatacccttggcctctttttgactgctaagaatttggagaaggctattaatgaaggtaaggtaatgagccagtccaaatccctcactgtctggctaagagattgagccattccactttacagcccctaattcccttcttcccaactgcagcaacatttccaacagggacaaaaaggaagtgaaggaaaccacttcagtattgggatcaatagaaattcaagaggtagttcataatgaccttatatgtgacacaaatggaaatactctacacttctggcatgcttctctcccaaatatttagaacattagtgacaatatgaaaaactttgctgactgagctgatcaatggaatgtgaaggcagtatactttaaggctatttactttcacacagaatgtttatctattagtcagtttgtattctactcaaatgcagatagacgggtataatgttttcttgtgcatttgaaacctatcaaggagaaaataaaccattccactaaaatacataggccaaacaccatctgggaaagtgataaaagctatccagaggctatgctatgtaaaatagcaaggtcaatttacatgggttgcatagtacttggctatgcagttttcaaaagaacacatccaaaaaaaaaaaaaatccaaattagttcctataataggtctttgtaaatttaaatatatttgtgggttggaaaatacgtttttagagacatttagaatttctttctctaaaaatgtatccaactccaagcagaaagagacttctgtactcacattctcatgtttcttagaattgggtagcatgatcattgaatctgtattttgcaaagtgaaagggacgcagcttgttgaactattgaggccactaaagtaaagttctaatatatatatataaatataaaattagtgtgtgtgtttgtatgtgtgtatgtgtgtgtgttctttcatcaccacctagttgaactttaaaacagacgtctacttttcattattcagaagcaacttgttacttcctttcttcatatgtgcagagatacacatgatcatgttacaatttgaagtgttttaatgtgtttttttttcttttgaaacgtaaagccttcagttgttgaatcatctgccgatttttatatgaagcacattagcaaacctggagctattagtatttcagaattcacaaccagctgtacttgtgactaaccaacacatgaactgaagctcacactttgctaagacctttggttgacattcgattttgaacctgccagatgcatttgtgtgaaccagggatactgcatctttaatgaacaagtctctcctctttcccctgtttttaaatacaacacaagcagtgtagcactaggcactgcaattgtcaaagacaattagactggaagcaggaaaatttcacctccctgtctcagtgatatgtagaatgtcggcagcatgggtcagccttgccacagagttgtgtgagaatatatgaatcagtcctatagaatgttaaatatttataaaatggttctgtagtacaccaaggttgggagcacattcattccttcttgttgtcttatgatacaaaaaaaaaaaaaaaaaaagcaaaagtttatttctgggcttaaaactctccctctaatatctctctctcttttacccccattccccaaccattcttctctccatccctctcctctcctcttcctctctcttctctctctctctctctctctctgtctctaactctcgctctctcttgtatgtgggtgtgtgtgtgtatgagtttccactgtggattatatacacttgctagagaatattcatttcttttttttcttttttcatctgatgtatattcaaacattgttctttataaccatttctacctcattgctacatattgtacatgtagtatttatttgttgtctttttttgaatgtcatgcatttcgtaagaaaaagacttgtccttgaacttgaacagtctacctcagaaagactgtctttacactgaacagtattagcaacctaaatgataagacgcattagtgaagtgtggcagggtagataatgcacgagtacttgggatactgatggacttttaattgtattcataacacaagactgcttaaaagaacttaaaagaaattatgcactgtgtaggtcttcatcgaggtcccatttgggacattatatacagaatagagctttattcctatgtgcccatctctgagaaatgtgttagcattcccaagtattttacactggcaatctggctacttaagacaaacaaattcaaacaacatttttatattttgactgacaccctcagctcctaaatttaagagaaataatggtacttaactattttcaactatagtcttcagtgattgaaaatgccttcattttaattctgtgactcctgatataaattaagaaaaacaatgcagttgcaagggcctgcacaacactgaaaataaaccaaaaattaaaaatggcacttcccaaaggaattaacaaacgtggagtcatggtgcttgcaagttccataactgaaagcattttgtttctgatttccctttataacatgtatttgtttattgaagcaattgtacaactaatggcacattgaattactttgtatgaagtgttttatattatactatttattttagcattcgttctttttcttcaccagctctatattacagtagcaaaagaacacttagttttaaaaaatgctgaaaggggttcaccacccacccaatcgatgaatggacttttgaagttgcttgtcagcaaattgtggatattttacaaaagcaaatgaactgtgacaatccacaactcccacagatgtgaattcagaaatgcatctgaaactccggtatgcctgacaatctattctttaagtttcattaacaaagtggcatccaatcctttcacttacaattccttgcaggaatgtattgtctagaggctgtctagtagtgattaagagagggtttttgttttgttttatttgtttactgtattaggtgaggaatgccatatttcttgtcagccaacagtacttgtctgagacagaaatttaaaaaaagaaaaagaaacctaactaattaaaatttctgtgcactttgcttccctgaccatattgattttatttgcttaaattgaaacaatacgctggatttgaccagattttgaccccttgaaagaagaaaagccctatatagtacatgtttctttgggttattctagtactgtttccttatttgttctgcaaatttcaaatcatttttttgtgtgcattattttacatctgctgaaactaaatgtgttattattgcactcattaaaaatgaaacaatccatttctcttggaaaaaaatgacaagctttagatgatgaaagcttaaattatccatcacttgcaaaatgaattcatataatttgtgaacattattaatgtaaatgagacatttctgcttagattttttttattttgatgggatcattatatggttgatcatatgtgtgtaggaagctgctgtacaattaacttggagatctgaaaatgctttttgtcctcattgttgcagtttcaattgtaatccattgcatctcattttcttgggtgttggcactgtaatatattaaaaaaaaattcagtgctcagtattgtaacaactgtccctactgaatattccttttcataaatacttgctaccacagggaaattaagttttcatatagaataactagtttcagtagtaaccattgaagaattaaaaatgtggttcaaggcagatatttttatgaaaagttttctctattgtaaaatttgttgtatatggctatgctactatcatggaataagaaaagaacaagcatacctcaaataaaaaaaaattctgagttaaaaaaa

SEQ ID NO: 679 - DNA, 1345 bp, Homo sapiens
agggttagttgtcagtatctttcccagttgttccgccccctacccccgcctcccgcaccgcgcccctctccggctgccctctccgcgtggggcaaggctccgagggcagcattcagtagccatttagctttggaaggagaggtgattcgaatggcccggctcctcctgtcaccatgctaggcactttggccgcgcaggtgctgacctgaacctggttcatccctttctgaccaaaactgttcactcaccgtggaagggactaagcatccatatggagacgccaccagtcaatacaattggagaaaaggacacctctcagccgcaacaagagtgggaaaagaaccttcgggagaaccttgattcagttattcagattaggcagcagccccgagaccctcctaccgaaacgcttgagctggaagtaagcccagatccagccagccaaattctagagcatactcaaggagctgaaaaactggttgctgaacttgaaggagactctcataagtctcatggatcaaccagtcagatgccagaggcccttcaagcttctgatctctggtactgccccgatgggagctttgtcaagaagatcgtaatccgtggccatggcttggacaaacccaaactaggctcctgctgccgggtactggctttggggtttcctttcggatcagggccgccagagggctggacagagctaactatgggcgtagggccatggagggaggaaacttggggggagctcatagagaaatgcttggagtccatgtgtcaaggtgaggaagcagagcttcagctgcctgggcactctggacctcctgtcaggctcacactggcatccttcactcaaggccgagactcctgggagctggagactagcgagaaggaagccctggccagggaagaacgtgcaaggggcacagaactatttcgagctgggaaccctgaaggagctgcccgatgctatggacgggctcttcggctgctcctgactttacccccacctggccctccagaacgaactgtccttcatgccaatctggctgcctgtcagttgttgctagggcagcctcagttggcagcccagagctgtgaccgggtgttggagcgggagcctggccatttaaaggccttataccgaaggggggttgcccaggctgcccttgggaacctggaaaaagcaactgctgacctcaagaaggtgctggcgatagatcccaaaaaccgggcagcccaggaggaactggggaaggtggtcattcaggggaagaaccaggatgcagggctggctcagggtctgcgcaagatgtttggctgattaaaagttaaaccttaaaagaga

SEQ ID NO: 680 - DNA, 1345 bp, Homo sapiens; identical to SEQ ID NO: 679

SEQ ID NO: 681 - DNA, 1345 bp, Homo sapiens
agggttagttgtcagtatctttcccagttgttccgccccctacccccgcctcccgcaccgcgcccctctccggctgccctctccgcgtggggcaaggctccgagggcagcattcagtagccatttagctttggaaggagaggtgattcgaatggcccggctcctcctgtcaccatgctaggcactttggccgcgcaggtgctgacctgaacctggtttatccctttctgaccaaaactgttcactcaccgtggaagggactaagcatccatatggagacgccaccagtcaatacaattggagaaaaggacacctctcagccgcaacaagagtgggaaaagaaccttcgggagaaccttgattcagttattcagattaggcagcagccccgagaccctcctaccgaaacgcttgagctggaagtaagcccagatccagccagccaaattctagagcatactcaaggagctgaaaaactggttgctgaacttgaaggagactctcataagtctcatggatcaaccagtcagatgccagaggcccttcaagcttctgatctctggtactgccccgatgggagctttgtcaagaagatcgtaatccgtggccatggcttggacaaacccaaactaggctcctgctgccgggtactggctttggggtttcctttcggatcagggccgccagagggctggacagagctaactatgggcgtagggccatggagggaggaaacttggggggagctcatagagaaatgcttggagtccatgtgtcaaggtgaggaagcagagcttcagctgcctgggcactctggacctcctgtcaggctcacactggcatccttcactcaaggccgagactcctgggagctggagactagcgagaaggaagccctggccagggaagaacgtgcaaggggcacagaactatttcgagctgggaaccctgaaggagctgcccgatgctatggacgggctcttcggctgctcctgactttacccccacctggccctccagaacgaactgtccttcatgccaatctggctgcctgtcagttgttgctagggcagcctcagttggcagcccagagctgtgaccgggtgttggagcgggagcctggccatttaaaggccttataccgaaggggggttgcccaggctgcccttgggaacctggaaaaagcaactgctgacctcaagaaggtgctggcgatagatcccaaaaaccgggcagcccaggaggaactggggaaggtggtcattcaggggaagaaccaggatgcagggctggctcagggtctgcgcaagatgtttggctgattaaaagttaaaccttaaaagaga

SEQ ID NO: 682 - DNA, 4994 bp, Homo sapiens
gcgcgcgcggtcacggggctcgctcccgaggggcaggtcggggctgggagctggtgcccgggtcggggtggcggcggcggcctgggtcgcggggtcgacgctcgctgctgcagcggcagaggctgaaggatccgccgcggcgctgtcgcgggagagggagggccccgctgccgtcggtgaaaccagcccagagaagttacgggatttgcccccggggctcctgcccagcaagccagcgccgtgacccaggtgtgggggatgatggtgacgcttctcactcacgtgtgaaggacggaaccactgcactccaggttccttgctgggtgctgagcgtggcctgagggacaggccctgggtcccgggatgcccctgcccgagcccagcgagcaggagggcgagagtgtgaaggccggccaggagccatcccccaagccaggcacggacgtcatcccggcagcccccaggaagcccagggagttctccaaactggtgctgctcacagcctccgaccaagatgaggatggggtgggatccaagccccaggaagtgcactgcgtcctgtccctggagatggctggccccgccaccctcgccagcaccttgcagatcctgccagttgaggagcagggaggggtggtccagccagccctagagatgcctgaacagaagtgcagcaagctggatgcagcagcccctcagtccctggagttcctgaggacaccattcgggggccgcctcctggtgctggagtccttcctgtacaagcaggagaaggcagtgggggacaaggtgtactggaagtgccgccaacatgctgagctgggctgccggggccgggccatcacccgaggcctgcgggccacagtgatgcggggccactgccacgcgcccgatgagcaaggcctggaggcccggcgccagagggagaaactgcccagcctggccctgccagagggcttgggagagccccagggtcctgagggccctggaggccgagtggaggagcccctggagggggtgggcccgtggcagtgccctgaggagcccgagcccactcctgggctggtgctgagcaagccggccctggaggaggaggaggcaccccgagccctgtcactgctgagcctgccgcccaagaagcgctcgatcctggggctgggacaggcccggcccctcgagttcctgaggacgtgctacgggggcagcttcctggtacacgagtcgttcctctacaagcgggagaaggctgtcggggacaaggtgtattggacctgccgggaccacgcgctgcacggctgccggagccgggccatcacccagggacagcgggtgactgtgatgcgtgggcactgccaccagcccgatatggagggcctggaagcccggcggcagcaggagaaggccgtggagacgctgcaggctgggcaggacggccctgggagccaagtggacacgctgctccgaggcgtggatagtttgctctaccgcaggggtccgggtcccctgactctcaccaggcctcggcccagaaagcgagcaaaggtcgaagaccaggagctgccaacccagcccgaggccccagacgagcaccaggacatggacgcagacccgggaggccctgagttcctgaagacgcccctggggggcagcttcctggtgtacgagtccttcctctaccggcgggagaaggcggctggggagaaggtgtattggacctgccgggaccaggcccgcatgggctgccgcagccgcgccatcacccagggccgacgggtgactgtcatgcgtggtcactgccacccgcccgacctgggaggcctggaggccctgaggcagcgggagaaacgccccaacacggcgcagcgggggagcccaggaggccccgagttcctgaagacgcccctggggggcagcttcctggtgtacgagtccttcctctaccggcgggagaaggcggccggggagaaggtgtattggacctgccgggaccaggcccgcatgggctgccgcagccgcgccatcacccagggccggcgggtcatggtcatgcgcaggcactgccacccaccggacctgggcggcctggaggccctgcggcagcgggagcacttccccaacctggcgcagtgggacagcccagatcctctccggcccctggagttcctgaggacttccctggggggcaggttcctggtgcacgagtccttcctctacaggaaggagaaggcggctggggagaaggtgtactggatgtgccgggaccaggctcggctgggctgccgcagccgcgccataacccagggccaccgcatcatggtcatgcgcagccactgccatcagcctgacctggcaggcctggaggccttgaggcaacgggagcggctccccaccacggcccagcaggaggacccagaaaagattcaagttcagctgtgcttcaagacgtgttctcctgaaagccagcagatttatggggacatcaaagacgtcagactggatggcgagtcccagtgaggcgatgtgggcagaggagctccgagccgcccacccaaggtggcttcacatccacacaggcacttcccatccacctaggtttggcttagcagaaacttcttttcattcttccaaagcatcgatggtcttcgcgtctcctcaggaggtctcccaggaggaattcttggatggtgtcctcatgtcggcggagaacagtgctcagagctggcgcttgcagacgcagctgtcgtggggcagggcggtggcgccttcctgacctttggaagacatgacaaagctgcctggacacggacgcccctgctgtacggccacagcacccctgggtttgcagagcacgcagccttcctagggctttccacctggcgaggccccgctctgctcagcacggtgcaaagtgaatgctgctgtcttggagcctgggcacgtttggggaagttcctgcttcaaactgagctgccccgcataggccaggtcaacccacaccaatctcttctggacaggtgctgggtaggccttcctggtctctggccgcctgctgccagggtgtggccatccccagcaaccggagctggccaaaccagaggcctcgctccgcactccacactttcctttctgtgctccttccaagttaaattaaaccccctctccacgattcccacggcaggcgtcattcccgagatgggagccagtccaggggtcagcaggagccagcgctgggcacacgtgccctggctgaggccagcggcatcctgggtggcccaggtccatcctgggcagcaaaggcgtgtccccttctgtcagacagcttcacagagtgtggcttcaccagtcagagggagcagtccggagaggcaagatgaccccaccgggactgcagagcctcctccttactaacaaggacctgtccgcagccgcgaggtccttcactcccaccctgtaattgtggggggagtgccagcaacaggcctgtcccctggcaagttggccacggaacccaccatgcactgcaaggctgtgacagcctgggcacccctgcttctcctctgcttgtacggttcccccaataaatcctattttccatctcaccgtgtggagctggtacttgttcacatccctcttgcagcaacagttggccgccgtgaaaccacactccgtcacatctccatgccagtgcccagggggagacccctccccatgcctgggctgttacagtcacctggcccagacgtaacctggaccaagagtggacggagacacctggggttggggcctctggaagggctgctggggggccagctgcagcctgtggcctctcccaggcccggatatggcaggacatttgcgtcgtgttgctggaagaggcaggatgctctgttctcgccattagcctgcgttacgcctagactcatctgcataagcctgggcaagtggcacccctgggccaagggcagacttgcccacccgtccatcctttgcctatggcagaggacacacaacacagtggctgcgctttgggcactgttctcggccctgaagcatcctgccccgaggctgacctaactgcccccagctggactcatggccaaggctacagacccagtactccaatcccgactcccactgtgtggtccaaatgtgtacgcccacaggaggcagccatgcccgaggaaggtacttgctgaaagatggtccagttcatgccgccaccagctggacctctgatcaggccccctgcagaaggggaagctctccacatgcccaagatacgagagaaacgcccgggtcacagcagcctgagtcactgcagcctctgctacctgccaagcctgcgccctccacctgtgggctccttgcctctgtgatggggcctccacggccagcatcttcccgccatggtcacatgatgccatgccctgctctgggcacccctaagcgggtatgaggcgaatcagaggaagaatatcggcttctcttcccttttggatatttgcgtcattgaccgggactggcccactcttcctctgcctcacgcctgctttgaccttagaagacagacggcagctcgcgttgctgggctgagattctccaatggacgtgaatttagatgatgctgttgccttgggtggcttcatggccaccaacccgcaccctggtggccactcagccatgacaagggcctgacagccactaagtgagcttcagagccttccccttgcaaagttccagggccaccagatgtcgcctgcccagtcactgtcacagagttaaagcgtgcgggtgaacgctggccgcggagcgtgcagcccggcagcagctcagcggggcagctcctgcttccagccctgcctctgctggtgcttcgcccacaaaccctgctgtatgacatttgcaccacatggtgtgtgtccgtgccctttgacatgacagtgccaacaacatctcatgaaatttaaaataaatccccaaggcatcagaaacgt

SEQ ID NO: 683 - DNA, 3467 bp, Homo sapiens
atgccccaggccacctccccacctctgtggcccctgagcctgcacggaggaaagggtatcctctgggcaaggcacagccacccgccaggtcctccctctcaccacatccaggacagtggacgctgctccctgcctcttcctcagagtcctggggtcacacctctacctgcgcggctctcgggggccacccctctcagccccatccggctcctgagcagctttgtccccagagggccccgggtcattcctctgaccaaccaggcacggcgcaccctgcatgcaagcctgggcgggtgctggggacggacgagtgacgcagcagacactgcctccctgaaggcatggcaaggaggccccgagttcctgaagacgcccctggggggcagcttcctggtgtacgagtccttcctctaccggcgggagaaggcggccggggagaaggtgtattggacctgccgggaccaggcccgcatgggctgccgcagccgcgccatcacccagggccggcgggtcatggtcatgcgcaggcactgccacccaccggacctgggcggcctggaggccctgcggcagcgggagcacttccccaacctggcgcagtgggacagcccagatcctctccggcccctggagttcctgaggacttccctggggggcaggttcctggtgcacgagtccttcctctacaggaaggagaaggcggctggggagaaggtgtactggatgtgccgggaccaggctcggctgggctgccgcagccgcgccataacccagggccaccgcatcatggtcatgcgcagccactgccatcagcctgacctggcaggcctggaggccttgaggcaacgggagcggctccccaccacggcccagcaggaggacccagaaaagattcaagttcagctgtgcttcaagacgtgttctcctgaaagccagcagatttatggggacatcaaagacgtcagactggatggcgagtcccagtgaggcgatgtgggcagaggagctccgagccgcccacccaaggtggcttcacatccacacaggcacttcccatccacctaggtttggcttagcagaaacttcttttcattcttccaaagcatcgatggtcttcgcgtctcctcaggaggtctcccaggaggaattcttggatggtgtcctcatgtcggcggagaacagtgctcagagctggcgcttgcagacgcagctgtcgtggggcagggcggtggcgccttcctgacctttggaagacatgacaaagctgcctggacacggacgcccctgctgtacggccacagcacccctgggtttgcagagcacgcagccttcctagggctttccacctggcgaggccccgctctgctcagcacggtgcaaagtgaatgctgctgtcttggagcctgggcacgtttggggaagttcctgcttcaaactgagctgccccgcataggccaggtcaacccacaccaatctcttctggacaggtgctgggtaggccttcctggtctctggccgcctgctgccagggtgtggccatccccagcaaccggagctggccaaaccagaggcctcgctccgcactccacactttcctttctgtgctccttccaagttaaattaaaccccctctccacgattcccacggcaggcgtcattcccgagatgggagccagtccaggggtcagcaggagccagcgctgggcacacgtgccctggctgaggccagcggcatcctgggtggcccaggtccatcctgggcagcaaaggcgtgtccccttctgtcagacagcttcacagagtgtggcttcaccagtcagagggagcagtccggagaggcaagatgaccccaccgggactgcagagcctcctccttactaacaaggacctgtccgcagccgcgaggtccttcactcccaccctgtaattgtggggggagtgccagcaacaggcctgtcccctggcaagttggccacggaacccaccatgcactgcaaggctgtgacagcctgggcacccctgcttctcctctgcttgtacggttcccccaataaatcctattttccatctcaccgtgtggagctggtacttgttcacatccctcttgcagcaacagttggccgccgtgaaaccacactccgtcacatctccatgccagtgcccagggggagacccctccccatgcctgggctgttacagtcacctggcccagacgtaacctggaccaagagtggacggagacacctggggttggggcctctggaagggctgctggggggccagctgcagcctgtggcctctcccaggcccggatatggcaggacatttgcgtcgtgttgctggaagaggcaggatgctctgttctcgccattagcctgcgttacgcctagactcatctgcataagcctgggcaagtggcacccctgggccaagggcagacttgcccacccgtccatcctttgcctatggcagaggacacacaacacagtggctgcgctttgggcactgttctcggccctgaagcatcctgccccgaggctgacctaactgcccccagctggactcatggccaaggctacagacccagtactccaatcccgactcccactgtgtggtccaaatgtgtacgcccacaggaggcagccatgcccgaggaaggtacttgctgaaagatggtccagttcatgccgccaccagctggacctctgatcaggccccctgcagaaggggaagctctccacatgcccaagatacgagagaaacgcccgggtcacagcagcctgagtcactgcagcctctgctacctgccaagcctgcgccctccacctgtgggctccttgcctctgtgatggggcctccacggccagcatcttcccgccatggtcacatgatgccatgccctgctctgggcacccctaagcgggtatgaggcgaatcagaggaagaatatcggcttctcttcccttttggatatttgcgtcattgaccgggactggcccactcttcctctgcctcacgcctgctttgaccttagaagacagacggcagctcgcgttgctgggctgagattctccaatggacgtgaatttagatgatgctgttgccttgggtggcttcatggccaccaacccgcaccctggtggccactcagccatgacaagggcctgacagccactaagtgagcttcagagccttccccttgcaaagttccagggccaccagatgtcgcctgcccagtcactgtcacagagttaaagcgtgcgggtgaacgctggccgcggagcgtgcagcccggcagcagctcagcggggcagctcctgcttccagccctgcctctgctggtgcttcgcccacaaaccctgctgtatgacatttgcaccacatggtgtgtgtccgtgccctttgacatgacagtgccaacaacatctcatgaaatttaaaataaatccccaaggcatcagaaacgt

SEQ ID NO: 684 - DNA, 5141 bp, Homo sapiens
gcgcgcgcggtcacggggctcgctcccgaggggcaggtcggggctgggagctggtgcccgggtcggggtggcggcggcggcctgggtcgcggggtcgacgctcgctgctgcagcggcagaggctgaaggatccgccgcggcgctgtcgcgggagagggagggccccgctgccgtcggtgaaaccagcccagagaagttacgggatttgcccccggggctcctgcccagcaagccagcgccgtgacccaggtgtgggggatgatggtgacgcttctcactcacgtgtgaaggacggaaccactgcactccaggttccttgctgggtgctgagcgtggcctgagggacaggccctgggtcccgggatgcccctgcccgagcccagcgagcaggagggcgagagtgtgaaggccggccaggagccatcccccaagccaggcacggacgtcatcccggcagcccccaggaagcccagggagttctccaaactggtgctgctcacagcctccgaccaagatgaggatggggtgggatccaagccccaggaagtgcactgcgtcctgtccctggagatggctggccccgccaccctcgccagcaccttgcagatcctgccagttgaggagcagggaggggtggtccagccagccctagagatgcctgaacagaagtgcagcaagctggatgcagcagcccctcagtccctggagttcctgaggacaccattcgggggccgcctcctggtgctggagtccttcctgtacaagcaggagaaggcagtgggggacaaggtgtactggaagtgccgccaacatgctgagctgggctgccggggccgggccatcacccgaggcctgcgggccacagtgatgcggggccactgccacgcgcccgatgagcaaggcctggaggcccggcgccagagggagaaactgcccagcctggccctgccagagggcttgggagagccccagggtcctgagggccctggaggccgagtggaggagcccctggagggggtgggcccgtggcagtgccctgaggagcccgagcccactcctgggctggtgctgagcaagccggccctggaggaggaggaggcaccccgagccctgtcactgctgagcctgccgcccaagaagcgctcgatcctggggctgggacaggcccggcccctcgagttcctgaggacgtgctacgggggcagcttcctggtacacgagtcgttcctctacaagcgggagaaggctgtcggggacaaggtgtattggacctgccgggaccacgcgctgcacggctgccggagccgggccatcacccagggacagcgggtgactgtgatgcgtgggcactgccaccagcccgatatggagggcctggaagcccggcggcagcaggagaaggccgtggagacgctgcaggctgggcaggacggccctgggagccaagtggacacgctgctccgaggcgtggatagtttgctctaccgcaggggtccgggtcccctgactctcaccaggcctcggcccagaaagcgagcaaaggtcgaagaccaggagctgccaacccagcccgaggccccagacgagcaccaggacatggacgcagacccgggaggccctgagttcctgaagacgcccctggggggcagcttcctggtgtacgagtccttcctctaccggcgggagaaggcggctggggagaaggtgtattggacctgccgggaccaggcccgcatgggctgccgcagccgcgccatcacccagggccgacgggtgactgtcatgcgtggtcactgccacccgcccgacctgggaggcctggaggccctgaggcagcgggagaaacgccccaacacggcgcagcgggggagcccaggcgctggcctctctttccagtggctcttccggatcctgcagcttttgggtcatgctcctgtgctgctgtgcccctcagggtcctcctgcctcccgagcctccctgctccacatggcccctgcccagccctctccatccctcttgaaggaggccccgagttcctgaagacgcccctggggggcagcttcctggtgtacgagtccttcctctaccggcgggagaaggcggccggggagaaggtgtattggacctgccgggaccaggcccgcatgggctgccgcagccgcgccatcacccagggccggcgggtcatggtcatgcgcaggcactgccacccaccggacctgggcggcctggaggccctgcggcagcgggagcacttccccaacctggcgcagtgggacagcccagatcctctccggcccctggagttcctgaggacttccctggggggcaggttcctggtgcacgagtccttcctctacaggaaggagaaggcggctggggagaaggtgtactggatgtgccgggaccaggctcggctgggctgccgcagccgcgccataacccagggccaccgcatcatggtcatgcgcagccactgccatcagcctgacctggcaggcctggaggccttgaggcaacgggagcggctccccaccacggcccagcaggaggacccagaaaagattcaagttcagctgtgcttcaagacgtgttctcctgaaagccagcagatttatggggacatcaaagacgtcagactggatggcgagtcccagtgaggcgatgtgggcagaggagctccgagccgcccacccaaggtggcttcacatccacacaggcacttcccatccacctaggtttggcttagcagaaacttcttttcattcttccaaagcatcgatggtcttcgcgtctcctcaggaggtctcccaggaggaattcttggatggtgtcctcatgtcggcggagaacagtgctcagagctggcgcttgcagacgcagctgtcgtggggcagggcggtggcgccttcctgacctttggaagacatgacaaagctgcctggacacggacgcccctgctgtacggccacagcacccctgggtttgcagagcacgcagccttcctagggctttccacctggcgaggccccgctctgctcagcacggtgcaaagtgaatgctgctgtcttggagcctgggcacgtttggggaagttcctgcttcaaactgagctgccccgcataggccaggtcaacccacaccaatctcttctggacaggtgctgggtaggccttcctggtctctggccgcctgctgccagggtgtggccatccccagcaaccggagctggccaaaccagaggcctcgctccgcactccacactttcctttctgtgctccttccaagttaaattaaaccccctctccacgattcccacggcaggcgtcattcccgagatgggagccagtccaggggtcagcaggagccagcgctgggcacacgtgccctggctgaggccagcggcatcctgggtggcccaggtccatcctgggcagcaaaggcgtgtccccttctgtcagacagcttcacagagtgtggcttcaccagtcagagggagcagtccggagaggcaagatgaccccaccgggactgcagagcctcctccttactaacaaggacctgtccgcagccgcgaggtccttcactcccaccctgtaattgtggggggagtgccagcaacaggcctgtcccctggcaagttggccacggaacccaccatgcactgcaaggctgtgacagcctgggcacccctgcttctcctctgcttgtacggttcccccaataaatcctattttccatctcaccgtgtggagctggtacttgttcacatccctcttgcagcaacagttggccgccgtgaaaccacactccgtcacatctccatgccagtgcccagggggagacccctccccatgcctgggctgttacagtcacctggcccagacgtaacctggaccaagagtggacggagacacctggggttggggcctctggaagggctgctggggggccagctgcagcctgtggcctctcccaggcccggatatggcaggacatttgcgtcgtgttgctggaagaggcaggatgctctgttctcgccattagcctgcgttacgcctagactcatctgcataagcctgggcaagtggcacccctgggccaagggcagacttgcccacccgtccatcctttgcctatggcagaggacacacaacacagtggctgcgctttgggcactgttctcggccctgaagcatcctgccccgaggctgacctaactgcccccagctggactcatggccaaggctacagacccagtactccaatcccgactcccactgtgtggtccaaatgtgtacgcccacaggaggcagccatgcccgaggaaggtacttgctgaaagatggtccagttcatgccgccaccagctggacctctgatcaggccccctgcagaaggggaagctctccacatgcccaagatacgagagaaacgcccgggtcacagcagcctgagtcactgcagcctctgctacctgccaagcctgcgccctccacctgtgggctccttgcctctgtgatggggcctccacggccagcatcttcccgccatggtcacatgatgccatgccctgctctgggcacccctaagcgggtatgaggcgaatcagaggaagaatatcggcttctcttcccttttggatatttgcgtcattgaccgggactggcccactcttcctctgcctcacgcctgctttgaccttagaagacagacggcagctcgcgttgctgggctgagattctccaatggacgtgaatttagatgatgctgttgccttgggtggcttcatggccaccaacccgcaccctggtggccactcagccatgacaagggcctgacagccactaagtgagcttcagagccttccccttgcaaagttccagggccaccagatgtcgcctgcccagtcactgtcacagagttaaagcgtgcgggtgaacgctggccgcggagcgtgcagcccggcagcagctcagcggggcagctcctgcttccagccctgcctctgctggtgcttcgcccacaaaccctgctgtatgacatttgcaccacatggtgtgtgtccgtgccctttgacatgacagtgccaacaacatctcatgaaatttaaaataaatccccaaggcatcagaaacgt

SEQ ID NO: 685 - DNA, 4991 bp, Homo sapiens
gcgcgcgcggtcacggggctcgctcccgaggggcaggtcggggctgggagctggtgcccgggtcggggtggcggcggcggcctgggtcgcggggtcgacgctcgctgctgcagcggcagaggctgaaggatccgccgcggcgctgtcgcgggagagggagggccccgctgccgtcggtgaaaccagcccagagaagttacgggatttgcccccggggctcctgcccagcaagccagcgccgtgacccaggtgtgggggatgatggtgacgcttctcactcacgtgtgaaggacggaaccactgcactccaggttccttgctgggtgctgagcgtggcctgagggacaggccctgggtcccgggatgcccctgcccgagcccagcgagcaggagggcgagagtgtgaaggccggccaggagccatcccccaagccaggcacggacgtcatcccggcagcccccaggaagcccagggagttctccaaactggtgctgctcacagcctccgaccaagatgaggatggggtgggatccaagccccaggaagtgcactgcgtcctgtccctggagatggctggccccgccaccctcgccagcaccttgcagatcctgccagttgaggagcagggaggggtggtccagccagccctagagatgcctgaacagaagtgcagcaagctggatgcagcccctcagtccctggagttcctgaggacaccattcgggggccgcctcctggtgctggagtccttcctgtacaagcaggagaaggcagtgggggacaaggtgtactggaagtgccgccaacatgctgagctgggctgccggggccgggccatcacccgaggcctgcgggccacagtgatgcggggccactgccacgcgcccgatgagcaaggcctggaggcccggcgccagagggagaaactgcccagcctggccctgccagagggcttgggagagccccagggtcctgagggccctggaggccgagtggaggagcccctggagggggtgggcccgtggcagtgccctgaggagcccgagcccactcctgggctggtgctgagcaagccggccctggaggaggaggaggcaccccgagccctgtcactgctgagcctgccgcccaagaagcgctcgatcctggggctgggacaggcccggcccctcgagttcctgaggacgtgctacgggggcagcttcctggtacacgagtcgttcctctacaagcgggagaaggctgtcggggacaaggtgtattggacctgccgggaccacgcgctgcacggctgccggagccgggccatcacccagggacagcgggtgactgtgatgcgtgggcactgccaccagcccgatatggagggcctggaagcccggcggcagcaggagaaggccgtggagacgctgcaggctgggcaggacggccctgggagccaagtggacacgctgctccgaggcgtggatagtttgctctaccgcaggggtccgggtcccctgactctcaccaggcctcggcccagaaagcgagcaaaggtcgaagaccaggagctgccaacccagcccgaggccccagacgagcaccaggacatggacgcagacccgggaggccctgagttcctgaagacgcccctggggggcagcttcctggtgtacgagtccttcctctaccggcgggagaaggcggctggggagaaggtgtattggacctgccgggaccaggcccgcatgggctgccgcagccgcgccatcacccagggccgacgggtgactgtcatgcgtggtcactgccacccgcccgacctgggaggcctggaggccctgaggcagcgggagaaacgccccaacacggcgcagcgggggagcccaggaggccccgagttcctgaagacgcccctggggggcagcttcctggtgtacgagtccttcctctaccggcgggagaaggcggccggggagaaggtgtattggacctgccgggaccaggcccgcatgggctgccgcagccgcgccatcacccagggccggcgggtcatggtcatgcgcaggcactgccacccaccggacctgggcggcctggaggccctgcggcagcgggagcacttccccaacctggcgcagtgggacagcccagatcctctccggcccctggagttcctgaggacttccctggggggcaggttcctggtgcacgagtccttcctctacaggaaggagaaggcggctggggagaaggtgtactggatgtgccgggaccaggctcggctgggctgccgcagccgcgccataacccagggccaccgcatcatggtcatgcgcagccactgccatcagcctgacctggcaggcctggaggccttgaggcaacgggagcggctccccaccacggcccagcaggaggacccagaaaagattcaagttcagctgtgcttcaagacgtgttctcctgaaagccagcagatttatggggacatcaaagacgtcagactggatggcgagtcccagtgaggcgatgtgggcagaggagctccgagccgcccacccaaggtggcttcacatccacacaggcacttcccatccacctaggtttggcttagcagaaacttcttttcattcttccaaagcatcgatggtcttcgcgtctcctcaggaggtctcccaggaggaattcttggatggtgtcctcatgtcggcggagaacagtgctcagagctggcgcttgcagacgcagctgtcgtggggcagggcggtggcgccttcctgacctttggaagacatgacaaagctgcctggacacggacgcccctgctgtacggccacagcacccctgggtttgcagagcacgcagccttcctagggctttccacctggcgaggccccgctctgctcagcacggtgcaaagtgaatgctgctgtcttggagcctgggcacgtttggggaagttcctgcttcaaactgagctgccccgcataggccaggtcaacccacaccaatctcttctggacaggtgctgggtaggccttcctggtctctggccgcctgctgccagggtgtggccatccccagcaaccggagctggccaaaccagaggcctcgctccgcactccacactttcctttctgtgctccttccaagttaaattaaaccccctctccacgattcccacggcaggcgtcattcccgagatgggagccagtccaggggtcagcaggagccagcgctgggcacacgtgccctggctgaggccagcggcatcctgggtggcccaggtccatcctgggcagcaaaggcgtgtccccttctgtcagacagcttcacagagtgtggcttcaccagtcagagggagcagtccggagaggcaagatgaccccaccgggactgcagagcctcctccttactaacaaggacctgtccgcagccgcgaggtccttcactcccaccctgtaattgtggggggagtgccagcaacaggcctgtcccctggcaagttggccacggaacccaccatgcactgcaaggctgtgacagcctgggcacccctgcttctcctctgcttgtacggttcccccaataaatcctattttccatctcaccgtgtggagctggtacttgttcacatccctcttgcagcaacagttggccgccgtgaaaccacactccgtcacatctccatgccagtgcccagggggagacccctccccatgcctgggctgttacagtcacctggcccagacgtaacctggaccaagagtggacggagacacctggggttggggcctctggaagggctgctggggggccagctgcagcctgtggcctctcccaggcccggatatggcaggacatttgcgtcgtgttgctggaagaggcaggatgctctgttctcgccattagcctgcgttacgcctagactcatctgcataagcctgggcaagtggcacccctgggccaagggcagacttgcccacccgtccatcctttgcctatggcagaggacacacaacacagtggctgcgctttgggcactgttctcggccctgaagcatcctgccccgaggctgacctaactgcccccagctggactcatggccaaggctacagacccagtactccaatcccgactcccactgtgtggtccaaatgtgtacgcccacaggaggcagccatgcccgaggaaggtacttgctgaaagatggtccagttcatgccgccaccagctggacctctgatcaggccccctgcagaaggggaagctctccacatgcccaagatacgagagaaacgcccgggtcacagcagcctgagtcactgcagcctctgctacctgccaagcctgcgccctccacctgtgggctccttgcctctgtgatggggcctccacggccagcatcttcccgccatggtcacatgatgccatgccctgctctgggcacccctaagcgggtatgaggcgaatcagaggaagaatatcggcttctcttcccttttggatatttgcgtcattgaccgggactggcccactcttcctctgcctcacgcctgctttgaccttagaagacagacggcagctcgcgttgctgggctgagattctccaatggacgtgaatttagatgatgctgttgccttgggtggcttcatggccaccaacccgcaccctggtggccactcagccatgacaagggcctgacagccactaagtgagcttcagagccttccccttgcaaagttccagggccaccagatgtcgcctgcccagtcactgtcacagagttaaagcgtgcgggtgaacgctggccgcggagcgtgcagcccggcagcagctcagcggggcagctcctgcttccagccctgcctctgctggtgcttcgcccacaaaccctgctgtatgacatttgcaccacatggtgtgtgtccgtgccctttgacatgacagtgccaacaacatctcatgaaatttaaaataaatccccaaggcatcagaaacgt

SEQ ID NO: 686 - DNA, 1672 bp, Homo sapiens
aaggcgattgtcatatgatagctaagaagtggcacattaatgaagcgccgctacaggggtcttttctgctcctgtcaccgcttaaaactatcagatggttcgagggaggacatggaggcagccacctagctcagcggagacgcggagcccacagcagcgccctccggagccctaacacgtcgctgccaccatccgcgccgggactccgcagccgagctcggccgcccgcaggacgctccaggagcgtcgcggaccgggcggcacgggacgctgcggggctgagctcaagagcccaggttcgcgccgagtccaaccggacccggacgctgcgcgcggagtgcgcgtcgagtgcgcgccgagagagaagcggcgcgcagcggcgtcctcccggatgcggacgcgcaacttgaagcaactttaagatccgagcagtccgccggcccgcgcggacccagagcaagaagagggcgaggaagaagatgcctcggcccggccgcaacacgtacagcgaccagaagccgccctactcgtacatctcgctgaccgctatggccatccagagctctcccgagaagatgctgccgctgagcgagatctacaagttcatcatggaccgcttcccctactacagggagaacacgcagcgctggcagaacagtctgcgccacaacctctccttcaacgactgcttcatcaagatcccgcggcggccggaccagccaggcaagggcagcttctgggcgctgcacccaagctgcggggacatgttcgagaacggcagcttcctgcggcgccgcaagcgcttcaaggtgcttaagtccgaccacctggcgcccagcaagccagccgacgcggcgcagtacctgcagcagcaggccaagctgcggctcagcgcgctggcggcctcgggcacgcacctgccacagatgcccgccgccgcctacaacttgggcggcgtggcgcagccctcgggcttcaagcaccccttcgccatcgagaacatcatcgcgcgggaatacaagatgcctggggggctggccttctccgccatgcagccggtgcccgctgcctacccgctccccaaccagttgactaccatgggcagctcgctgggcaccggctggccacacgtgtatggctccgccggcatgatcgactcggccacccccatctccatggcgagtggcgactacagcgcctacggcgtgccgttgaagccgctgtgccacgcggcgggccaaacgctgcccgccatccccgtgcccattaagcccacgccggccgccgtgcccgcgctgcctgcgctgccagcgcccatccccaccttgctctcgaactcgccgccctcgctcagccccacgtcctcgcaaacagccaccagccaaagcagccccgccacccccagcgaaacgctcaccagcccggcctccgccttgcactcggtggcggtgcactgacccgcaggagcccacgccccctctcgttctcctccccaccacctcactcgccttccctggctcccagtcctgccggcccccacctgggaccgccaccctaacttgttcatttcaccttcggccaacccgccttgccccaagagaactttgttttggacccaggagaccaaacacaaacttgcagatgggccgagaggcgcgtgggagttgtcctc

SEQ ID NO: 687 - DNA, 1299 bp, Homo sapiens
atgccgcggccggggaagagctcgtacagcgaccaaaaaccgccctactcttacatctcgctgaccgccatggcaatccagcactcggccgagaagatgctgccgctgagcgacatctacaagttcatcatggagcgcttcccctactaccgcgagcacacacagcgctggcagaacagcctgcgccacaacctctccttcaacgactgcttcatcaagattccgcggaggcccgaccagcctggcaagggtagcttctgggcgctgcaccccgactgcggggacatgttcgagaacggcagcttcctgcggcgtcgcaagcgcttcaaggtgctgcgcgccgaccatactcacttgcacgcgggaagcaccaagagcgcgccgggcgccggtccgggagggcaccttcacccccatcaccaccaccacccccaccaccaccatcatcaccacgctgccgcacaccaccaccatcaccaccacccaccccagccgccgccgccgccgcccccgccgccgccgcacatggtacactatttccatcagcaaccgcctactgctccgcagccgcctccgcacctcccgtcacagcccccgcagcaaccgccccagcagtcgcagcctcagcagccgtctcaccccggcaagatgcaggaggcggcggccgtggcggcggcggcggcggcggccgcggcagccgcggtgggcagcgtgggacgcctgtctcagttcccaccctacgggctgggctcggccgccgccgctgccgccgcggccgcggcgtccacgtcaggcttcaagcacccctttgccattgagaacattattggccgggactacaagggcgtgctgcaggctggagggctgcccttggcgtccgtcatgcaccacctgggctaccccgtgcccggccagcttggcaacgtcgtcagctccgtgtggccgcacgttggcgtcatggattcggtggccgccgccgcggccgccgcagccgcagccggagtccctgtaggcccggagtatggggccttcggggtcccggtcaagtccctgtgccactcggcaagccagagcctgcctgccatgccggtgcccatcaagcccacgcctgcgctgccgcccgtgtccgcgctgcagccggggctcactgtccccgcggcttcgcagcagcctccggcgccatccaccgtgtgctccgcggccgcggcctcgcccgttgcctctctgctggagcccacagcccctacctcggccgaaagcaagggcggctccttgcactcggtgctagtgcactcctag

SEQ ID NO: 688 - DNA, 3109 bp, Homo sapiens
ctctcctgccttccctgaataaacttacacaatttagtgctgggacatttggaccttttctgaaaatttgagtcagggagagcatcttggggaggtgggaaggaaggtagaaggagcaaagcaacacccccctgaagcctgggaatattgtcagaaccttaaatataattcagctcaccattctgggtaaggacagactctaccaatgaaaatgggtgattaccagctgtgaaacacaaaaacatacttttacggttacacattcctttacaaacaaccgtgtacatttcagcctcctgccccaccatttcttttctccaggagggaaggctgcatgtcgaggtggtcatagaatgttgagtatcatactttcctacctcgcttttatttgcgcgggtttaaatgcgccttaacagaacccgtgcaaaggcttgccaactgtctggctgcaccggatgagtagagcatcttccttggtggcaggtgggtgcgaggaggaggggcctgggcttttctccggacagtgtttgcccagaagaccatcatccctggactacgttaggaggaagtggcaccgctccgaggtaggggaagaagggttataaaggggggagtccaccacacatggtcttgaagaagcttttataaaaggcaaaggcatctttgccggacgttgttgcaaaggagtagaaacaagcagacgaaaacatcccaaagggtaaccactagcgttcctgcttcttgcaacattcatcccaggcttccagctcagcccgccccaggccaggtgatcggccgccacatcccctgcgactgaagcacctgctcctccatgaacctgccaagagctgagcgccctcgctccacaccgcagcgcagcctccgggactccgatggggaagacggtaaaatcgatgtcctgggagaggaggaagatgaagacgaggtggaagacgaggaggaggaggcgagacagcagttcctagagcagtcgctccagccggggctgcaggtggcccggtggggcggggttgcgcttccccgagagcacatcgagggcggcggcggcccgagtgacccttcagagtttggcaccaagttcagggcaccgccaaggtctgcggcggcctctgaagatgcccggcagccggcaaagcccccctactcgtacatcgcgctcatcaccatggccatcctgcaaaacccgcacaagcgcctcacgctcagcggcatctgcgccttcattagtggccgcttcccatactaccgccgcaagttccccgcctggcagaacagcatccgccacaacctctcgctgaacgactgcttcgttaagatcccccgcgagccgggccacccaggcaagggcaactactggagcctggaccccgcctcccaggacatgttcgacaatggcagctttctccggcgtaggaagcgtttcaagcgccaccaactgaccccgggagcccacctgccccaccccttccctctacctgctgcacacgccgccctgcacaacccccacccaggccctctgcttggggcccctgccccgccgcagccagtcccgggggcctaccccaacaccgcccccgggagacgcccttacgctctgctgcacccgcatcctcttcgctacctactgctctcggcccgcgtctatgccggggcaccgaagaaagcagaaggcgcggacctggcgaccccggcacccttcccgtgctgcagccctcacttggtcctcagccttgggaggagggcaagggtctggcgtcgccaccgggaggcggatgcttctctttcagcattgagagtattatgcaaggggtcaggggagcgggtacaggggctgcgcagagtttgtccccgaccgcgtggagctactgccacctgctccagcgaccatcaagcctgttgcatccccaaaccgctgcccctttgctgcaagtgtccgccgccgctgctgctcggacaattttgcagcaatagcagcagcatcaggaggactgcgccaacggctgcgctcccaccaagggcgcggtgctgggcgggcacctgtcggcctcgtcggcgctgctgaggtatcaggcagtggcggagggctctaggctgacatcgctggctgcccctttgggcggagaggggacctcaccagtttttttagtatcgcccacgcccagttccctggccaactccgcagggccctcctagagccaggtgggagtggggagcgacccgcagctgctcactccaccttgcgcggcccatactgggcgtgtgcatctgaatcccgctggagagcaaacacgaacttctgttcgttcgctgcaaaatggttagaaagattacattcctctaagctggattacgttcctctaaaaaccacctgaacgtaaccttcgcagggcgtcaagtcatcttttcttgccttcggttgtggcttctatggctgtcccgatttgcacattgtcatctttgaagattagtgacatagcattcatcttctgttgtcaccttttccgtcattccctgtatgcctgatggacaggtttcactgaagttcagagaacagcatgcaaaattagctaccaattaatctttatgaagtgagctgcatttctagccacactgagcttatgttttagcaggaagcatttttgggaaatgtttatgttagagtttgcccttcttgacaaggtgagacataaatgtctactttagagacatgaattaagatgggaagatatttgggggaatcatttactcaaacgctaagtaataaaggtacacaaagggcaaattatactagatttctttcccacttgttttctatgtctcttgcaattcaccttgattcccttcagtttctgtttaatgtagaaagtggcattttcattattttaagcttctagcacaatgaaagaatttctctttttcatgaacaggatcataaatgaaagggaggaagagtgtcctatatcatatttattgttcaacaaaacactgctccacggcttcaattcagtttaaaaaagagaatttattgaacatttaacacatacataaaaggcagtaaagacaaatgagaagagggggggatattgaa

SEQ ID NO: 689 - DNA, 3109 bp, Homo sapiens
ctctcctgccttccctgaataaacttacacaatttagtgctgggacatttggaccttttctgaaaatttgagtcagggagagcatcttggggaggtgggaaggaaggtagaaggagcaaagcaacacccccctgaagcctgggaatattgtcagaaccttaaatataattcagctcaccattctgggtaaggacagactctaccaatgaaaatgggtgattaccagctgtgaaacacaaaaacatacttttacggttacacattcctttacaaacaaccgtgtacatttcagcctcctgccccaccatttcttttctccaggagggaaggctgcatgtcgaggtggtcatagaatgttgagtatcatactttcctacctcgcttttatttgcgcgggtttaaatgcgccttaacagaacccgtgcaaaggcttgccaactgtctggctgcaccggatgagtagagcatcttccttggtggcaggtgggtgcgaggaggaggggcctgggcttttctccggacagtgtttgcccagaagaccatcatccctggactacgttaggagtaagtggcaccgctccgaggtgggggaagaagggttataaaggggggagtccaccacacatggtcttgaagaagcttttataaaaggcaaaggcatctttgccggacgttgttgcaaaggagtagaaacaagcagacgaaaacatcccaaagggtaaccactagcattgctgcttcttgcaacattcatcccaggcttccagctcagcccgccccaggccaggtgatcggccgccacatcccctgcgactgaagcacctgctcctccatgaacctgccaagagctgagcgccctcgctccacaccgcagcgcagcctccgggactccgatggggaagacggtaaaatcgatgtcctgggagaggaggaagatgaagacgaggtggaagacgaggaggaggaggcgagacagcagttcctagagcagtcactccagccggggctgcaggtggcccggtggggcggggttgcgcttccccgagagcacatcgagggcggcggcggcccgagtgacccctcagagtttggcaccaagttcagggcaccgccaaggtctgcggcggcctctgaagatgcccggcagccggcaaagcccccctactcgtacatcgcgctcatcaccatggccatcctgcaaaacccgcacaagcgcctcacgctcagcggcatctgcgccttcattagtggccgcttcccatactaccgccgcaagttccccgcctggcagaacagcatccgccacaacctctcgctgaacgactgcttcgttaagatcccccgcgagccgggccacccaggcaagggcaactactggagcctggaccccgcctcccaggacatgttcgacaatggcagctttctccggcgtaggaagcgtttcaagcgccaccaactgaccccgggagcccacctgccccaccccttccctctacctgctgcgcacgccgccctgcacaacccccacccaggccctctgcttggggcccctgccccgccgcagccagtcccgggggcctaccccaacaccgcccccgggagatgcccttacgctctgctgcacccgcatcctcttcgctacctactgctctcggcccccgtctatgccggggcaccgaagaaagcagaaggcgcggacctggcgaccccggcacccttcccgtgctgcagccctcacttggtcctcagccttgggaggagggcaagggtctggcgtcgccaccgggaggcggatgcatctctttcagcattgagagtattatgcaaggggtcaggggagcgggtacaggggctgcgcagagtttgtccccgaccgcgtggagctactgccacctgctccagcgaccatcaagcctgttgcatccccaaaccgctgcccctttgctgcaagtgtccgccgccgctgctgctcggacaattttgcagcaatagcagcagcatcaggaggactgcgccaacggctgcgctcccaccaagggcgcggtgctgggcgggcacctgtcggcctcgtcggcgctgctgaggtatcaggcagtggcggagggctctaggctgacatcgctggctgcccctttgggcggagaggggacctcaccagtttttttagtatcgcccacgcccagttccctggccaactccgcagggccctcctagagccaggtgggagtggggagcgacccgcagctgctcactccaccttgcgcggcccatactgggcgtgtgcatctgaatcccgctggagagcaaacacgaacttctgttcgttcgctgcaaaatggttagaaagattacattcctctaagctggattacgttcctctaaaaaccacctgaacgtaaccttcgcagggcgtcaagtcatcttttcttgccttcggttgtggcttctatggctgtcccgatttgcacattgtcatctttgaaggttagtgacatagcattcatcttctgttgtcaccttttccgtcattccctgtatgcctgatggacaggtttcactgaagttcagagaacagcatgcaaaattagctaccaattaatctttatgaagtgagctgcatttctagccacactgagcttatgttttagcaggaagcatttttgggaaatgtttatgttagagtttgcccttcttgacaaggtgagacataaatgtctactttagagacatgaattaagatgggaagatatttgggggaatcatttactcaaacgctaagtaataaaggtacacaaagggcaaattatactagatttctttcccacttgttttctatgtctcttgcaattcaccttgattcccttcagtttctgtttaatgtagaaagtggcattttcattattttaagcttctagcacaatgaaagaatttctctttttcatgaacaggatcataaatggaagggaggaagagtgtcctatatcatatttattgttcaacaaaacactgctccacggcttcaattcagtttaaaaaagagaatttattgaatatctaacacatacataaaaggcagtaaagacaaatgagaagaggggaggatattgaa

SEQ ID NO: 690 - DNA, 2725 bp, Homo sapiens
acatacttttacggttacacattcctttacaaacaaccgtgtacatttcagcctcctgccccaccatttcttttctccaggcgggaaggctgcatgttgaggtggtcatagaatgttgagtatcatactttcctacctcgcttttatttgcgcgggtttaaatgcgccttaacagaacccgtgcaaaggcttgccaactgtctggctgcaccggatgagtagagcatcttccttggtggcaggtgggtgcgaggaggagggggctgggcttttctccggacgggtgtttgcccagaagaccatcatccctggactacgttaggaggaagtggcaccgctccgaggtaggggaagaagggttataaaggggggagtccaccacacatggtcttgaagaagcttttataaaaggcaaaggcatctttgccggacgttgttgcaaaggagtagaaacaagcagacgaaaacatcccaaagggtaaccactagcgttcctgcttcttgcaacattcatcccaggcttccagctcagcccgccccaggctaggtgatcggtcgccacatcccctgcgactgaagcacctgctcctccatgaacctgccaagagctgagcgccttcgctccacaccgcagcgcagcctccgggactccgatggggaagacggtaaaatcgatgtcctgggagaggaggaagatgaagacgaggtggaagacgaggaggaggcggcgagccagcagttcctagagcagtcgctccagccggggctgcaggtggcccggtggggcggggttgcgcttccccgagagcacatcgagggcggcggcggcccgagcgacccctcagagtttggcaccaagttcagggcaccgccaaggtctgcggcggcctctgaagatgcccggcagccggcaaagcccccctactcgtacatcgcgctcatcaccatggccatcctgcaaaacccgcacaagcgcctcacgctcagcggcatctgcgccttcattagtggccgcttcccctactaccgccgcaagttccccgcctggcagaacagcatccgccacaacctctcgctgaacgactgcttcgttaagatcccccgcgagccgggccacccaggcaagggcaactactggagcctggaccccgcctcccaagacatgttcgacaatggcagctttctccggcgtaggaagcgtttcaagcgccaccaactgaccccgggagcccacctgccccaccccttccctctacctgctgcacacgccgccctgcacaacccccacccaggccctctgcttggggcccctgccccgccgcagccagtcccgggggcctaccccaacaccgcccccgggagacgcccttacgctctgctgcacccgcatcctcttcgctacctactgctctcggcccccgtctatgccggggcaccgaagaaagcagaaggcgcggccctggcgaccccggcacccttcccgtgctgcagccctcacttggtcctcagccttgggaggagggcaagggtctggcgtcgccaccgggaggcggatgcatctctttcagcattgagagtattatgcaaggggtcaggggagcgggtacaggggctgcgcagagtttgtccccgaccgcgtggagctactgccacctgctccagcgaccatcaagcctgttgcatccccagaccgctgcccctttgctgcaagtgtccgccgccgccgctgctcggacaattttgcagcaatagcagcagcatcaggaggaggactgcgccaacggctgcgctcccaccaagggcgcggtgctgggcgggcacctgtcggcctcgtcggccctgctgaggtatcaggcagtggcagagggctctaggctgacatcgctggctgcccctttgggcggagaggggacctcaccagtttttttagtatcgcccacgcccagttccctggccaactccgcagggccctcctagagccaggtgggagtggggagcgacccgcagctgctcacttcaccttgcgcggcccattcagggcgtgtgcatctgaatcccgctggagagcaaacacgaacttctgttcgctgcaaaatggttagaaagaaacagctggattacgttcctctaaaaaccacctgaacgtaaccttcgcagggcgtcaagtcatcttttcttgccttcggttgtggcttctatggctgtcccgatttgcgcatttcctggggtactatgaacgtgagtggggtattttgttctggcattaaaagaaaaacaagcaagcaaacaaaaacacagcctccgatgccaaacatgttcccccttcttcacttccttggagctggaagtattattcctaagtctagtgcaaaatgcttctactctctgtgtcttcctgatagggatgtttaatgtaagtaggatattaatttcagaacattgatttcttatctgtgtgtctgacgtgccatctttaatgttaaaattaaggtgttaaaattaagcctagttatatagacgaaataaaatgctaagtcactacactacatcgtttattttctattacatctcattcttccctttctaaatggaactttttaaaacctacgttactttccctcaaacaatttattttcacaattcatatttattatagatagcagaagtaatccattttaatatggcctttaaaaattccaaatatttgaggttgaaaatgtcctgg

SEQ ID NO: 691 - DNA, 2557 bp, Homo sapiens
gcggcagcggcggcggcggcagcagccacccgatgtcttcggcgcccgagaagcagcagccaccgcacggcggcggcggcggcggcggcgggggaggcggcgcggccatggaccccgcgtcgtccggcccgtccaaggccaagaagaccaacgccggcatccggcgcccggagaagccgccctattcctacatcgcgctcatcgtcatggccatccagagttcacccaccaagcgcctgacgctgagcgagatctaccagttcctgcagagccgcttccccttcttccggggctcctaccagggctggaagaactccgtgcgccacaacctctcgctcaacgagtgcttcatcaagctacccaagggccttgggcggcccggcaagggccactactggaccatcgacccggccagcgagttcatgttcgaggagggctcctttcggcggcggccgcgcggcttccgaaggaaatgccaggcgctcaagcccatgtacagcatgatgaacgggctcggcttcaaccacctcccggacacctacggcttccagggctcggccggcggcctctcgtgcccgcccaacagcctggcgctggagggcggcctgggcatgatgaacggccacttgccgggcaacgtggacggcatggccctgcccagccactcggtgccccacctgccttccaacggcggccactcgtacatgggcggctgcggcggcgcggcggccggcgagtacccgcaccacgacagctcggtgcccgcctccccgctgctgcccaccggcgccggtggggtcatggagccgcacgccgtctactcgggctcggcggcggcctggccgccctcggcgtccgcggcgctcaacagcggcgcctcttatatcaagcagcagcccctgtccccctgtaaccccgcggccaaccccctgtccggcagcctctccacgcactccctggagcagccgtatctgcaccagaacagccacaacgccccagccgagctgcaaggcatcccgcggtatcactcgcagtcgcccagcatgtgtgaccgaaaggagtttgtcttctctttcaacgccatggcgtcctcttccatgcactcggccggcgggggctcctactaccaccagcaggtcacctaccaagacatcaagccttgcgtgatgtgaggctgccgccgcaggccctcctggtgcaggcaggcgggtcacagggaccctggaccggcacaagaaactgctttcttctcgaggtataaccgtcggcagaagaaaagggttccacctctccccaaccggagtttttggcaaggagtccccaatgcaaagacacagcgctgcggttggcacctccttcctcactccttcaaaattgttaagaaatgttagtggtgggtctgatctgactgcagccatcggtaaataaaagtttttgatcctgttgaacccgcctgagacggtgctgtgcaggggaaagcccccgcacccacacaggaattctgctgaggtcccccctccttccggccaatggcagaagtgggggaaaatttttagaagaaaagcaaacatgtgagaccaatcattatcaaatacttttattttttggttgagtatttatctttttattttttattttttttttgaaagaatgtcttggaatgcgcaagtctccctttagagccgtcttttgcagggagcgggaagtgacaagagctcagatctccctcccgatctccctccccacctccgaagtctcctccgtggaccacaggtggatctttgtgcgaacaacttgcatttcggaagccactgtccgtctttaaacagaaagtcaaaggagccacgaagcaagcggccgtccgggcgtccgcctccgtccccttccatgttcctcctcttccttcgcttcagcctcttctgttatgttttgtcttgaattttatttagactttttcagtgggtatttttctgtctcccaacctctactgtaaactttctggtccgagaacgagccgaacacagcgcgacgcagggactaggacggcccggtgaccgcgcggattcaggattgcggggacgcagaaaggttaaggcacttttaaaaactatagcaaggctcctgtttatttattctactttctttccctaataatcaaaacaccgcgtaggctcctccgtttatcagtattaatggtgtaactttgttggcaatatttgccgtgtagaattttttttagatatccattgtaaatttgaaacaaagaccgatctgtgtaaaaacaaatttccatatgttttatataaatatatatataatatgaaggactaccctccttttttttttttgtattttggctgctagagtgcagcatttgtgacacgtatttgaaatttgaaatttccttctgcactgtataaaaggaccatttgaggatgttttgccttttgtgtattttttcctaaaaaaagaacaaaaataaaaatgtataacatttgtacatggcctttaaaattgtatcaactagaaataaaattgcatgagtattttattggga

SEQ ID NO: 692 - DNA, 1497 bp, Homo sapiens
cccggccctgccttctacactgccccaccgccctgcaccctccacccggccaggcccctgcccacgctgtctaccgtcccgcatggggccctgcagcggctcccgcctggggcccccagaggcagagtcgccctcccagccccctaagaggaggaagaagaggtacctgcgacatgacaagcccccctacacctacttggccatgatcgccttggtgattcaggccgctccctcccgcagactgaagctggcccagatcatccgtcaggtccaggccgtgttccccttcttcagggaagactacgagggctggaaagactccattcgccacaacctttcctccaaccgatgcttccgcaaggtgcccaaggaccctgcaaagccccaggccaagggcaacttctgggcggtcgacgtgagcctgatcccagctgaggcgctccggctgcagaacaccgccctgtgccggcgctggcagaacggaggtgcgcgtggagccttcgccaaggacctgggcccctacgtgctgcacggccggccataccggccgcccagtcccccgccaccacccagtgagggcttcagcatcaagtccctgctaggagggtccggggagggggcaccctggccggggctagctccacagagcagcccagttcctgcaggcacagggaacagtggggaggaggcggtgcccaccccaccccctccctctgggggcagctgcccacctcctacttgcctatctacactcccaatgtggtaatgcccttggcaccaccacccacctcctgtccccagtgtccgtcaaccagccctgcctactggggggtggcccctgaaacccgagggcccccagggctgctctgcgatctagacgccctcttccaaggggtgccacccaacaaaagcatctacgacgtttgggtcagccaccctcgggacctggcggcccctggcccaggctggctgctctcctggtgcagcctgtgaggctcttaagacaggggccactcctccctcccgctcccacccccaccttgttgacagggagccaaggcgaggcggctgtctgcgaccacagcagcctcgaaacaccaggcagcagccttgctgggagtccacggtgtttattgggccaccccacgcatggccgtggcccagctgggcacaaccctcaccctggtctgtcatgcctgtttttcctacactcagcggcaaagctgcaggagcagggctgagcctggaatagcccttcctagtcccctcttctcagcccactacccatccatcagtcaccagccgtcacctcccctcccgtgctccaggctgggggagggagagcccagtggtggatccagcctgaagtcctgccctctctcatctgtctggaaaggaggtagcacctttttcgggaaacgggttagggagtaaagactgcaccctacatggtcctggtggtgggggggataacagtaaaggaatttgcaacgtttt

SEQ ID NO: 693 - DNA, 2503 bp, Homo sapiens
gttgagtcaatgtgtccccctcttgttcctagggtgcgggcttcatggccttctcctccaggaagctccacctgatcatgtcctgggtggatatccagcccccatagttcagggcctactagcagctgctagatcttgaactccaggagcgccccacgccttgggagcttggcatgggctaaatactcccccatttgttaaatggggtcctgaaacctgaccagggaagacgggataaagtagccatgggtcatcgcagcccctttgaagccgggcctggccacccaaaggcaactcaggggtggagactgaggcctcaggagaagcccccactagaatgctctctgcccctcccttccagattaaccaaaacctgctaattgtggaagccctcggcatgctcccctcccccacagcctcttcctcccttccctcccctcccccttccatccgaatgataaaggccccagcccgcctgccccagcccggcctcaggtcccggccctgccttctacactgccccaccgccctgcaccctccacccggccaggcccctgcccacgctgtctaccgtcccgcatggggccctgcagcggctcccgcctggggcccccagaggcagagtcgccctcccagccccctaagaggaggaagaagaggtacctgcgacatgacaagcccccctacacctacttggccatgatcgccttggtgattcaggccgctccctcccgcagactgaagctggcccagatcatccgtcaggtccaggccgtgttccccttcttcagggaagactacgagggctggaaagactccattcgccacaacctttcctccaaccgatgcttccgcaaggtgcccaaggaccctgcaaagccccaggccaagggcaacttctgggcggtcgacgtgagcctgatcccagctgaggcgctccggctgcagaacaccgccctgtgccggcgctggcagaacggaggtgcgcgtggagccttcgccaaggacctgggcccctacgtgctgcacggccggccataccggccgcccagtcccccgccaccacccagtgagggcttcagcatcaagtccctgctaggagggtccggggagggggcaccctggccggggctagctccacagagcagcccagttcctgcaggcacagggaacagtggggaggaggcggtgcccaccccaccccttccctcttctgagaggcctctgtggcccctctgcccccttcctggccccacgagagtggagggggagactgtgcaggggggagccatcgggccctcaaccctctccccagagcctagggcctggcctctccacttactgcagggcaccgcagttcctgggggacggtccagcgggggacacagggcctccctctgggggcagctgcccacctcctacttgcctatctacactcccaatgtggtaatgcccttggcaccaccacccacctcctgtccccagtgtccgtcaaccagccctgcctactggggggtggcccctgaaacccgagggcccccagggctgctctgcgatctagacgccctcttccaaggggtgccacccaacaaaagcatctacgacgtttgggtcagccaccctcgggacctggcggcccctggcccaggctggctgctctcctggtgcagcctgtgaggctcttaagacaggggccactcctccctcccgctcccacccccaccttgttgacagggagccaaggcgaggcggctgtctgcgaccacagcagcctcgaaacaccaggcagcagccttgctgggagtccacggtgtttattgggccaccccacgcatggccgtggcccagctgggcacaaccctcaccctggtctgtcatgcctgtttttcctacactcagcggcaaagctgcaggagcagggctgagcctggaatagcccttcctagtcccctcttctcagcccactacccatccatcagtcaccagccgtcacctcccctcccgtgctccaggctgggggagggagagcccagtggtggatccagcctgaagtcctgccctctctcatctgtctggaaaggaggtagcacctttttcgggaaacgggttagggagtaaagactgcaccctacatggtcctggtggtgggggggataacagtaaaggaatttgcaacgttttaatgccatgcctgatttttgggtcaggagtggtgacttgggtaaccacttggcgggggggcctgggattccctgctgtgtgccgtgataacagcaaatggtgataaggagaaagccaagacctgtggcctgatgcagggctgggggcggggggtgatcacttcagcaggcacaacacacttcactggctgcggaggtggaggggtgactctgggagctcaggggcaatggatccaaagaggctagggagcttgtgccctgggagacggggtacagggactttactaccgcctctgccagcagagacctggcctgagacccca

SEQ ID NO: 694 - DNA, 3217 bp, Homo sapiens
ggtgcggcaccgctggcccaggcccgggcgcggctggacatggccacctactgcgacgacctgggcccctcctcggccccgcccggccaggcccaggccaccgcgcaccccccgggctatgagccaggggatctgggcgcggtgggcgggggccccctcctgtgggtgaacgcgccagcgctcagccccaagtcctacgcttcgggtcccgggcctgcgccgccctacgcggccccgagctacggggctcccggcccgctcctcggcgccccgggcggcctggcgggcgccgacctcgcctggctgagcctctccggccagcaggagctgctgaggctggtgcggccgccctactcctactcggcgctcatcgccatggccatccagagcgcgccgctgcggaagctgacgctcagccagatctaccagtacgtggctggtaacttccctttctacaagcgcagcaaggcgggctggcagaactccatccgccacaacctgtcgctcaacgactgcttcaagaaggtgccccgcgacgaggacgacccaggtaaaggcaattactggaccctggaccccaactgcgagaagatgtttgacaacgggaacttccgaaggaagaggaagaggagagctgaagccagcgcggccgtgcgctcgggagccaggagcgtgggaggggccgaggcgccagcgctggagcccccgagcgcggcttgcctggacctgcaggcctcgccctctccatccgcacccgaggccgccacctgcttctccggtttcgcttctgctatgagcgctctggctggcggccttggcaccttccccgggggcctggcgggcgacttttctttcgggaggcggccaccgacagtcgccacccacgctccccagacccttaacccctcccctggcttcgcccctggccaccagaccgcggccgccggcttccgcctcagtcacctcctctacagccgggaagggaccgaagtttgaagggaggctggaggctagccgggtgcgggtccagaggtgctgagctcaggcctccggtttcccctggtgacagccccacgtgttggcgttgaaggccttggtgccctgggaggaagcgcagagccgggggcggctcggccagcagggagctgggctgagcggctcttgggctttggggtgggtggcccttctgctgtgcacccctcacccaggcgaccttcggaacctccctgctctgcctctaagtccagccgccctgggcgtctagaacctgtgctctcgagggatttgccttgaaggggcggcgggtcggccctcagctccagcgttttccaaggaggctggctgactccaaagagccttagagcagatgggaagaaggtgggctgccagagcggcccaggtggtgggggccctttccacctccacccagcttggcccacctggctcagggccttcccttctgcttcagggaagctgccgcaggggctgggggacagagctcaggagcagctgcagtgggctccaggtgggccaggagcctgcagtgaggggatctgagacagttggcattgggtcctgtgtaaggaaggtcttgctaatggttggaactgctggtggtgggagggagaagcactgcgtgggcagaaagcgcccttgggataccagctcccttccctgtcactcagccctggtccttgatgacccccctctaggacaaggcaactccccagggccccgccaccactgaccacaggagcggtgcccagcacccaggagttccccaagggtccaggtttgtgccacccacacccacactcacacccacactcacacccacactcacacccacacccacacccacacccacactcacactcacactcacacccacactcacacccacactcacacccacacccacacccacactcacacacactcacacccacacccacactcacacccacacacactcacacccacacacacccacactcatactcacactcacacccacactcacaccacacccacactcacactgacacccacactcacacccacactcacactgacacccacactcacacccacactcatactcacactcacacccacactcacactcacacccacactcacaccacactcacacccacacacacccacactcatactcacacccacacccacactcatactcacacacccacacccacacccacacccacacccacacccacacccacactcacacaggctcatggaaggccacacttgttttggtctctttcccctccaaacccacagtttgagccaaagctgtgcgtgtgttcagagctcctgaacagcagcctcctgtgtaaattgaaccctgccccacccagttccttcttagggatggtatctttgtgaaggacaaggagcccccagtcactgggaagaggaattttttggcctctgtactccttagaggacctaagtgccccagtcagatgccctgagtctttgtggcatctgggactccctggagatggagacgttggtggggggggggtacccaccttgttgttgatgggggtacctatcttccctgcattttgggggagggtgggaggggtccttcccaggaagagagtggagacaggttactgttactttggagtgggacaggctggtttagcaatcctaagccccagccacgcaggtattcctgatctgcctgcagggcccctcactgcagctgccaccagtgctggaaatgagagcagggctcctgactgtccctagagctgactcatcatggccctgctgaagagtgaggtgtgtgtgtgtgtgtgcgtgtgtgcgtaagacagagagggagggagaaggaaggaggcgggggaacatggagagaaggagccaggagttgggataaacctggccctggtcatatgtttcatcagcagtggctcctaactccacgtgccatctctgctgctgccctccacaagcaggtgagcagagtgccagttgtgttgaaggtgatgatgtcgcctaactaaactcacaaccaacccgcaatctctcttggggggacactccccataagcaatacaattaaagaagaccaggaaaggaaaataaattccttagcttatacatttaaaaagtatcccttgaacctattttaatagaatgaaatgctaaaaataaagaccaatataacatacat

SEQ ID NO: 695 - DNA, 5523 bp, Homo sapiens
ggagccggggcctgcagcggagccgagccgagcccgagcccgcgccgagccctgacactgtctgcccgccttctggctccccgggagcccagactggtcggagcccgagcggtggcagcgcggggagccccacgcgccgaagggagcggacccgacaggacggccctagaggaggtgctgccgccacagtagcagggaccggagtctcgagccgcggcctcccggaccgtgctgcccaggccagctcagggacagccgggagtacgaaagccccaccctctggggcaccccgggagcggaggcgggagcggggacgcgagcaacctctccccctgttggagagaaaagacccttaccactcgggtgagggaaagaagagacccctggaggggacgcctctctcctgcctagaggcgaggaagacccctgtactggccggggaggagacccccagaagtggaaagaagggagctttccgtagggaagcagagtgagaccaccctagcgcgcccccgcccctccaaacacacactctcaacagttcaggactttggaggcaaagagagacggggctgtgcctgtggagtaggcaccctcggcccaccactattcacaggagacaggagtccttacgttcagaagccactccagggaaagaagaggaatcggctttcagccttctggagaggggaagacctccccctcaacttcctcgtgcctagacagtggaacggggtggagcccctccgctcctatctccagcagacagaaagagccctccacctcagaaagatccagtttgggggggaggggaactcccccaagggggaggagacaactcctggttgggagaggctcctcccctcctcccccgggtaacaagcagggtgtggggggtgtgccaccttccccaagtaggacctccttctcctccccctccccctcctccaaccttgactcctcatcctcaggggacccagttcccctcaccaacttgggaggctcagcctcgtccaggaagagccactgaggatgagagccgtcacctgcctctgaagaggggaatccctccaaccccaaactccagtaccaggtggttccctccctttgccggaggaaccttggagacagaacccagaagtaccatggcttctgacctagagagtagcctcacctccatagactggctcccccagctgaccctccgagctaccattgagaagcttggaagtgcctcccaggctgggcctcccgggagcagccgcaagtgttcaccagggtcacccacagatcctaatgccaccctgagcaaagacgaggcagcagtgcaccaggacggcaagccacgatacagctatgccactctcatcacctatgccatcaactcctctccagccaagaagatgaccctcagcgagatttaccgctggatctgtgataacttcccctattacaagaatgctggcattggttggaagaattcaatacggcacaacctttctctcaacaagtgtttccggaaggtgcccagacctcgggatgaccctgggaagggttcctattggacaattgacacctgccctgacatttcccgaaagagaagacaccctccagatgatgatctgtcccaagactcaccagaacaggaggcaagcaagagcccacggggaggcgttgcagggagtggagaagcctcactgcctcctgaggggaatccgcagatgtcacttcagagccccacatctatagccagctacagccagggcacaggatctgtggatggtggagcagtggcagcaggggcttcaggccgagaaagtgctgagggtccccctcccctctataacaccaaccatgactttaaattctcctactcagagatcaactttcaggatctaagctggtccttccgcaacctctataagtccatgctggagaagtcctcttcctcctctcagcacggcttttcttctctcctgggggacatcccaccctcgaacaactactacatgtatcagcagcagcagccaccgccacctcaacagcagcagcagcagcagcagccgccacagccacctccccagcagtcccagccacagcagcagcaggcacctgcccagggcccctcagctgtagggggtgctcctccactgcacaccccaagcacagatggttgtaccccaccagggggaaagcaagctggggcggaaggctatgggcctccccctgtaatggccatgcatccacccccgctgcagcatggaggctaccaccctcatcagcaccatccccactcccaccctgcccagcagccaccacctccacagccacaggcacaaggccaggctcccatcaacaacactggctttgcctttccttctgactggtgctctaatattgactctttaaaggaaagcttcaagatggtgaatcggctcaattggtccagcattgagcagtcacaattctcagaactgatggagagtctacgacaggcagagcagaagaactggaccctcgaccagcatcacattgccaatctgtgtgactccctcaaccacttccttactcagactggtcacgtgccccctcaagggggtacccaccgcccaccagcccctgcccgtattgctgactcctgtgccctcaccagtggcaaacaggagtcagccatgagccaagtgaactcttatgggcacccacaagctccccacctctaccctggcccatcaccaatgtacccaatccccacccaggactcagcaggatacaatcgcccagcacaccatatggtccctcggccatcagtgccacctcctggtgccaatgaggagatccctgatgacttcgactgggacttgatcacttagtgcatcacagagtgtggacatcagcccagggccgcgtggtgaaatctggcagtggggaaagagcaaccccagcccgtcccttccccccgtctgtatatagacatatatcctctttttgttctttctctgtcagagaagccactgcaagatgctgccgaagataaccctctctttcctgcctcattcttctctcttccttcctgttttttcctagttcttttattattattcttatattattattattattattggttatatactgtccatagtctcctgtccctacatcatggatcatgtccaccttttgctaatttaaaatcatcaggctggaagatgaagccatgatagctacagagaaaggttttagactccagtttacctttctcttggagaaactcaatgctaatcccaccttttggccctaaattgttttttgttcccatcagtttcaggccaggactggagaggccacattaccaagtagaaagggtctgaaacattacttggcagccaagaatttggaggttttaaaatggtgctaattctgtcctctgaggtcttccttgtccctttataccttcaatccttacttctgccagtctgtatttcctatcaagggtgaaagtgatgatggtggtgcaggagggtgacaataaaatcctagtggaattggagaccattggaagggatggaatataagtcagtgtgaaactgagtatacactgccatgttacatcagtgtccattggcttgttttgagcctgttctctaagaagataggattggttttagcccaaactctgcttctatggtagggcatgaggacaactattcagcatggttttagcttcttggagatgattccaacttaactattttggctttttaaacataattttctctgaaaattaattgtggctcttatttgcatttacgaatgatcttcccatccctttttcccattcagcaaatattagtttgtcctcctttaattgtttgcccaaatcttccacccatcttttttcttccctcattttctgggattctcaagaaagaaaaagtaacccattatcactctgagtttcgtcgtgccctgagacatgatgggaatctcattcccacctctcatagcagagccaaacctttagtgttggtggtaggaggatggggagaggaaaaaagagctggcaaagaaatggatagggaatattttagttctttaaatatataggcagatgcttctcttggaatccagatcatctggctgaagcttttgcaagtaggctttgaggggtgaaggagattggtggaggagagtaaataatctagaggcaagagttcagtgagggccaagggggacccccagaaaaaggtatggagctaactcatctcttttacaaggggtggccatgacttactgttgcaaagtactcagtgtatatttaatgttgattgttgaattttagttacgagagggaagaacaattttacttctgtccttatttcacttgctgaaaagctgtgggacaaaatgtatggaatagacaaggccactttctttgtgatttctgcttttcatgcatattattttatttacccataatttccaagaggtttggcgttccgctctcctgcttttttctttcatccacccctttcctttttttggaagggggttatatatgagagttcattgaagaagtccagtgaggctgaagtaaaggggcaagatagggcagttaactaaagagcactttatttctttgaagcctttctaagaaagaaatgggggtgcgagtggcttgaatctcccatgatgttggagggcacttagtggggttgaagtatgacataatatttcccattggggaaaggagaatttctcttagagggtggcaaaatgcctttgcccagtgtccctattttaggcatcttttccttccttattccttccagtcagggtgtgtcctatacaaaacttcccatcagttctcctcaatattccccatttgtaaatgatcacttctcttttctaaacccttttcctgttcagatccatacaggatttgcaagggtaggatcatacatgcaaatgccccttgttcatctgtgtcttctgcaaactagtctcatgaagaattctggcgtgcagccagggtagctgaagtttgggtctgggactggagattggccattaggcctcctgagattccagctcccttccaccaagcccagtcttgctacgtggcacagggcaaacctgactccctttgggcctcagtttcccctccccttcatgaaatgaaaagaatactactttttcttgttggtctagcattgctggacacaaagtgtagtcattattgttgtattgggtgatgtgtgcaaaactgcagaagctcactgcctataagaggaaataagagagaaagtggaggagagggacaaaaggagtaattatttggtatagatccacccatcccaacctttctctcctcagtccctgctcctcatgtttctggtttggtgagtcctttgtgccaccacccataatgctttgcattgctgcatcctgggaagggggtatatggtctcacaagttgttgtcattgtttttttgcatgctttcttaataaaaaaaaaaaaagaa

SEQ ID NO: 696 - DNA, 2676 bp, Homo sapiens
aagaggaatcggctttcagccttctggagaggggaagacctccccctcaacttcctcgtgcctagacagtggaacggggtggagcccctccgctcctatctccagcagacagaaagagccctccacctcagaaagatccagtttgggggggaggggaactcccccaagggggaggagacaactcctggttgggagaggctcctcccctcctcccccgggtaacaagcagggtgtggggggtgtgccaccttccccaagtaggacctccttctcctccccctccccctcctccaaccttgactcctcatcctcaggggacccagttcccctcaccaacttgggaggctcagcctcgtccaggaagagccactgaggatgagagccgtcacctgcctctgaagaggggaatccctccaaccccaaactccagtaccaggtggttccctccctttgccggaggaaccttggagacagaacccagaagtaccatggcttctgacctagagagtagcctcacctccatagactggctcccccagctgaccctccgagctaccattgagaagcttggaagtgcctcccaggctgggcctcccgggagcagccgcaagtgttcaccagggtcacccacagatcctaatgccaccctgagcaaagacgaggcagcagtgcaccaggacggcaagccacgatacagctatgccactctcatcacctatgccatcaactcctctccagccaagaagatgaccctcagcgagatttaccgctggatctgtgataacttcccctattacaagaatgctggcattggttggaagaattcaatacggcacaacctttctctcaacaagtgtttccggaaggtgcccagacctcgggatgaccctgggaagggttcctattggacaattgacacctgccctgacatttcccgaaagagaagacaccctccagatgatgatctgtcccaagactcaccagaacaggaggcaagcaagagcccacggggaggcgttgcagggagtggagaagcctcactgcctcctgaggggaatccgcagatgtcacttcagagccccacatctatagccagctacagccagggcacaggatctgtggatggtggagcagtggcagcaggggcttcaggccgagaaagtgctgagggtccccctcccctctataacaccaaccatgactttaaattctcctactcagagatcaactttcaggatctaagctggtccttccgcaacctctataagtccatgctggagaagtcctcttcctcctctcagcacggcttttcttctctcctgggggacatcccaccctcgaacaactactacatgtatcagcagcagcagccaccgccacctcaacagcagcagcagcagcagcagccgccacagccacctccccagcagtcccagccacagcagcagcaggcacctgcccagggcccctcagctgtagggggtgctcctccactgcacaccccaagcacagatggttgtaccccaccagggggaaagcaagctggggcggaaggctatgggcctccccctgtaatggccatgcatccacccccgctgcagcatggaggctaccaccctcatcagcaccatccccactcccaccctgcccagcagccaccacctccacagccacaggcacaaggccaggctcccatcaacaacactggctttgcctttccttctgactggtgctctaatattgactctttaaaggaaagcttcaagatggtgaatcggctcaattggtccagcattgagcagtcacaattctcagaactgatggagagtctacgacaggcagagcagaagaactggaccctcgaccagcatcacattgccaatctgtgtgactccctcaaccacttccttactcagactggtcacgtgccccctcaagggggtacccaccgcccaccagcccctgcccgtattgctgactcctgtgccctcaccagtggcaaacaggagtcagccatgagccaaggtactgcaccaagccagttgccatggaggtggagactatgttgaaaaggaagcataggagaaaggcaaaagagaactgagagaaaggattttatggggcagtgacccaaattgagcagtggaactagtttatcagttgactgaatatctgttgaatcagtgaagtcctaaactgaaaaatgcaaaagaaatagactgtatgattcctttttagacctcagtttgggagatcagaattgtttaagaaaagggaggagatttgttagagaaaggctgtattttaaatttgcgtctcagtaatccctaccgcctgggtgataccggatgaaatggtggttctatgcttatgtgatgttcaaactagtgaaatgagagagatgtcatgattatgttcctgtttcttgctttttgtttttgagatggggtctcgctctgtcgcccaggctctggagtgcagtggtgtgatcacggctcactgcaaccttgacccctggagctcaggtgatcctcccactttagcctcctgagtagctgggactacaggtgtgtaccaccatgcccagctaattttttttttgtattttgtgtatagctggggtttcaccgtgtcgcccaggctatcttcaaactcttggactcaagggatctaccc

SEQ ID NO: 697 - DNA, 5225 bp, Homo sapiens
agttccgggtgcgcggccccggatgttggctgctcttgctgccgccgccgctctcggggctgctcggggcctcgaccgctcgcagtaggcaccgttgggacctttcccgggggggcggagacgcacggagcggccgggggctcggccgggccgtcccggcctgcgcagcctgagattctctttgtggccagatgggtttgtatggacaggcttgtccatctgtaacttcattaaggatgacatctgaactggagagcagcctaacgtctatggactggttaccacagctcaccatgagagcagccatccaaaaatctgatgctacacaaaatgcacatggaacaggaatttctaagaagaatgcactccttgacccaaatacaactctggaccaggaagaagtccaacagcacaaagatgggaaacctccatacagttatgccagcctcattacatttgcaattaatagctcacccaaaaagaaaatgactttaagtgaaatttatcagtggatttgtgataacttcccatattatagagaggctggcagtggttggaagaattccatacgacataatctgtcattgaacaaatgtttccttaaagtgcctcgatctaaggatgaccctggaaaggggtcctactgggcaatagacaccaatccgaaggaagatgtgctgcctactcggccaaagaagagggcacgatctgtagaacgggcctcaactccatatagcatagattcagattctttgggaatggagtgtattatttcgggaagtgcctctccaactctggcaatcaacactgtgactaacaaagtaacattgtataacactgatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttccagaaagagacaagcaactacttttctcagaatataattttgaagatcttagtgcctcatttcggagcctttataagtcagtttttgagcagtcacttagtcaacaaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccagcatccctctccacatcaacacatacagcaccatccgaaccatcagcatcagacgttaacacatcaggcacccccacccccacaacaggtatcctgtaattctggtgtttcaaatgattggtatgcgacacttgatatgctaaaagaaagctgtcgaattgccagcagtgttaattggtcagatgtagacctttcacagtttcaaggtctgatggagagtatgagacaggcagatctcaagaactggtctttagaccaggttcagtttgccgatctttgttcttctcttaatcagttctttacacaaactggccttatacattcacagagtaatgttcaacaaaatgtttgtcatggtgccatgcatccaacaaaaccttcccaacacattggaacaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccgaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctatggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctattt

SEQ ID NO: 698 - DNA, 5123 bp, Homo sapiens
agttccgggtgcgcggccccggatgttggctgctcttgctgccgccgccgctctcggggctgctcggggcctcgaccgctcgcagtaggcaccgttgggacctttcccgggggggcggagacgcacggagcggccgggggctcggccgggccgtcccggcctgcgcagcctgagattctctttgtggccagatgggtttgtatggacaggcttgtccatctgtaacttcattaaggatgacatctgaactggagagcagcctaacgtctatggactggttaccacagctcaccatgagagcagccatccaaaaatctgatgctacacaaaatgcacatggaacaggaatttctaagaagaatgcactccttgacccaaatacaactctggaccaggaagaagtccaacagcacaaagatgggaaacctccatacagttatgccagcctcattacatttgcaattaatagctcacccaaaaagaaaatgactttaagtgaaatttatcagtggatttgtgataacttcccatattatagagaggctggcagtggttggaagaattccatacgacataatctgtcattgaacaaatgtttccttaaagtgcctcgatctaaggatgaccctggaaaggggtcctactgggcaatagacaccaatccgaaggaagatgtgctgcctactcggccaaagaagagggcacgatctgtagaacgggtaacattgtataacactgatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttccagaaagagacaagcaactacttttctcagaatataattttgaagatcttagtgcctcatttcggagcctttataagtcagtttttgagcagtcacttagtcaacaaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccagcatccctctccacatcaacacatacagcaccatccgaaccatcagcatcagacgttaacacatcaggcacccccacccccacaacaggtatcctgtaattctggtgtttcaaatgattggtatgcgacacttgatatgctaaaagaaagctgtcgaattgccagcagtgttaattggtcagatgtagacctttcacagtttcaaggtctgatggagagtatgagacaggcagatctcaagaactggtctttagaccaggttcagtttgccgatctttgttcttctcttaatcagttctttacacaaactggccttatacattcacagagtaatgttcaacaaaatgtttgtcatggtgccatgcatccaacaaaaccttcccaacacattggaacaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccgaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctatggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctattt

SEQ ID NO: 699 - DNA, 4468 bp, Homo sapiens
gggaaaatacagatttgtgtggcatttcctatctgttcatttattggtactgtaatgtaaagagcagtatcaagtttgatattactaggtgatgtggcaatttggaaactgctagactggaggttagaagacctgggttcaagtcttagattcatcatgataaccttgctaagttatgtcacttctctggttcagtttcttttatttgtaaaatggagagaaataatacctttctgcctgtctcacagagcagattgcccaacacgtgatataatgggtacaaatccccttgtaagacgggacaagaatcagccaatttcaggaataagggcagctcatcgttttcccttaccacacttcaccctttcaccatccaggaattacactgttgtcaatattttataggtgtttcaaatgattggtatgcgacacttgatatgctaaaagaaagctgtcgaattgccagcagtgttaattggtcagatgtagacctttcacagtttcaaggtgagtgttggttctttttgacatataaccaaatacacatgatcctgtttctctgctagattataactttctttgtagtagaaataaacatcatcttatatagcatttcttttgcagttggtaaaattcataataattttggccacttggtatagcagagggtcacagacaagttctgaaagaaatttgaccacatttaaaataattgggctttgaataatttaaaaaggtcattcttcattgcgtggataaatcactaccataaagtggagtgagtggaaattttgagagctgaaaaaaattatgtcttgctattttccttgcaatgtttattgcataacagtgctaacatatttttaatgctttcctcataggtctgatggagagtatgagacaggcagatctcaagaactggtctttagaccaggttcagtttgccgatctttgttcttctcttaatcagttctttacacaaactggccttatacattcacagagtaatgttcaacaaaatgtttgtcatggtgccatgcatccaacaaaaccttcccaacacattggaacaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccgaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctatggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctatttacaaca

SEQ ID NO: 700 - DNA, 5352 bp, Homo sapiens
gcgagacgccctctctcttccagccgcagccgcgttgcgggttcttccctgtggaacagtagagacctagtctgccttctttcacaagataatccttcaattatttgaaggtgattattcagcatatatctcttgagtacctgtgcatgcaagacactgtcctggatattgtgagagatccaaagtttagtatgagatcattttcccttgcctgagttttgagctgattgagaaataagaacctacagatgaagaagcaagacagtacctttaaaaaaattagctttttattcagattctctttgtggccagatgggtttgtatggacaggcttgtccatctgtaacttcattaaggatgacatctgaactggagagcagcctaacgtctatggactggttaccacagctcaccatgagagcagccatccaaaaatctgatgctacacaaaatgcacatggaacaggaatttctaagaagaatgcactccttgacccaaatacaactctggaccaggaagaagtccaacagcacaaagatgggaaacctccatacagttatgccagcctcattacatttgcaattaatagctcacccaaaaagaaaatgactttaagtgaaatttatcagtggatttgtgataacttcccatattatagagaggctggcagtggttggaagaattccatacgacataatctgtcattgaacaaatgtttccttaaagtgcctcgatctaaggatgaccctggaaaggggtcctactgggcaatagacaccaatccgaaggaagatgtgctgcctactcggccaaagaagagggcacgatctgtagaacgggcctcaactccatatagcatagattcagattctttgggaatggagtgtattatttcgggaagtgcctctccaactctggcaatcaacactgtgactaacaaagtaacattgtataacactgatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttccagaaagagacaagcaactacttttctcagaatataattttgaagatcttagtgcctcatttcggagcctttataagtcagtttttgagcagtcacttagtcaacaaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccagcatccctctccacatcaacacatacagcaccatccgaaccatcagcatcagacgttaacacatcaggcacccccacccccacaacaggtatcctgtaattctggtgtttcaaatgattggtatgcgacacttgatatgctaaaagaaagctgtcgaattgccagcagtgttaattggtcagatgtagacctttcacagtttcaaggtctgatggagagtatgagacaggcagatctcaagaactggtctttagaccaggttcagtttgccgatctttgttcttctcttaatcagttctttacacaaactggccttatacattcacagagtaatgttcaacaaaatgtttgtcatggtgccatgcatccaacaaaaccttcccaacacattggaacaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccgaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctatggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctatttacaaca

SEQ ID NO: 701 - DNA, 5309 bp, Homo sapiens
ataacctgggtagctaccttgagaattagaagggcctttagaggtccaactcctttaagaaagaaagaaagaccaggcacgggaaaggcctccgcagacatgagtctagcacctgggactcatgaagttctgaaaagaggggtgtcctgaaggtccaaggcgcctttgttgggggtcccggaatccgcggtgtgccaggtcggaaaaggcgtccgctttcctggagaggaggctaaggtgccgggcgcttcgattctctttgtggccagatgggtttgtatggacaggcttgtccatctgtaacttcattaaggatgacatctgaactggagagcagcctaacgtctatggactggttaccacagctcaccatgagagcagccatccaaaaatctgatgctacacaaaatgcacatggaacaggaatttctaagaagaatgcactccttgacccaaatacaactctggaccaggaagaagtccaacagcacaaagatgggaaacctccatacagttatgccagcctcattacatttgcaattaatagctcacccaaaaagaaaatgactttaagtgaaatttatcagtggatttgtgataacttcccatattatagagaggctggcagtggttggaagaattccatacgacataatctgtcattgaacaaatgtttccttaaagtgcctcgatctaaggatgaccctggaaaggggtcctactgggcaatagacaccaatccgaaggaagatgtgctgcctactcggccaaagaagagggcacgatctgtagaacgggcctcaactccatatagcatagattcagattctttgggaatggagtgtattatttcgggaagtgcctctccaactctggcaatcaacactgtgactaacaaagtaacattgtataacactgatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttccagaaagagacaagcaactacttttctcagaatataattttgaagatcttagtgcctcatttcggagcctttataagtcagtttttgagcagtcacttagtcaacaaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccagcatccctctccacatcaacacatacagcaccatccgaaccatcagcatcagacgttaacacatcaggcacccccacccccacaacaggtatcctgtaattctggtgtttcaaatgattggtatgcgacacttgatatgctaaaagaaagctgtcgaattgccagcagtgttaattggtcagatgtagacctttcacagtttcaaggtctgatggagagtatgagacaggcagatctcaagaactggtctttagaccaggttcagtttgccgatctttgttcttctcttaatcagttctttacacaaactggccttatacattcacagagtaatgttcaacaaaatgtttgtcatggtgccatgcatccaacaaaaccttcccaacacattggaacaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccgaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctatggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctatttacaaca

SEQ ID NO: 702 - DNA, 447 bp, Homo sapiens
tagaagagatttcactagtgatttaaattcattttcagaaacaaagcacaaaactggatgttcaagaatttgatgagatcccttcaaactgtgttaaagttgctggatatatgagctaataattatttattttgttcttgtattttaggcctcaactccatatagcatagattcagattctttgggaatggagtgtattatttcgggaagtgcctctccaactctggcaatcaacactgtgactaacaaagtaacattgtataacactgatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttcc

SEQ ID NO: 703 - DNA, 1326 bp, Homo sapiens
cgcggccccggatgttggctgctcttgctgccgccgccgctctcggggctgctcggggcctcgaccgctcgcagtaggcaccgttgggacctttcccgggggggcggagacgcacggagcggccgggggctcggccgggccgtcccggcctgcgcagcctgagattctctttgtggccagatgggtttgtatggacaggcttgtccatctgtaacttcattaaggatgacatctgaactggagagcagcctaacgtctatggactggttaccacagctcaccatgagagcagccatccaaaaatctgatgctacacaaaatgcacatggaacaggaatttctaagaagaatgcactccttgacccaaatacaactctggaccaggaagaagtccaacagcacaaagatgggaaacctccatacagttatgccagcctcattacatttgcaattaatagctcacccaaaaagaaaatgactttaagtgaaatttatcagtggatttgtgataacttcccatattatagagaggctggcagtggttggaagaattccatacgacataatctgtcattgaacaaatgtttccttaaagtgcctcgatctaaggatgaccctggaaaggggtcctactgggcaatagacaccaatccgaaggaagatgtgctgcctactcggccaaagaagagggcacgatctgtagaacgggtaacattgtataacactgatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttccagaaagagacaagcaactacttttctcagaatataattttgaagatcttagtgcctcatttcggagcctttataagtcagtttttgagcagtcacttagtcaacaaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccag

SEQ ID NO: 704 - DNA, 499 bp, Homo sapiens
gctacacaaaatgcacatggaacaggaatttctaagaagaatgcactccttgacccaaatacaactctggaccaggaagaagtccaacagcacaaagatgggaaacctccatacagttatgccagcctcattacatttgcaattaatagctcacccaaaaagaaaatgactttaagtgaaatttatcagtggatttgtgataacttcccatattatagagaggctggcagtggttggaagaattccatacgacataatctgtcattgaacaaatgtttccttaaagtgcctcgatctaaggatgaccctggaaaggtaggattcatcttcttaaaacagttgaattcttcagtatgtcacttgtcatgtttgaattaagaacttttccagttcattgaataggaacctctgcaaaatagtaagtcctcccccaccctgctctaaagcttgttagagagttttaagctgtgggaacctaactagtgtatagctgttgcac

SEQ ID NO: 705 - DNA, 5161 bp, Homo sapiens
acagtttagtatgagatcattttcccttgcctgagttttgagctgattgagaaataagaacctacagatgaagaagcaagacagtacctttaaaaaaattagctttttattcagattctctttgtggccagatgggtttgtatggacaggcttgtccatctgtaacttcattaaggatgacatctgaactggagagcagcctaacgtctatggactggttaccacagctcaccatgagagcagccatccaaaaatctgatgctacacaaaatgcacatggaacaggaatttctaagaagaatgcactccttgacccaaatacaactctggaccaggaagaagtccaacagcacaaagatgggaaacctccatacagttatgccagcctcattacatttgcaattaatagctcacccaaaaagaaaatgactttaagtgaaatttatcagtggatttgtgataacttcccatattatagagaggctggcagtggttggaagaattccatacgacataatctgtcattgaacaaatgtttccttaaagtgcctcgatctaaggatgaccctggaaaggggtcctactgggcaatagacaccaatccgaaggaagatgtgctgcctactcggccaaagaagagggcacgatctgtagaacgggcctcaactccatatagcatagattcagattctttgggaatggagtgtattatttcgggaagtgcctctccaactctggcaatcaacactgtgactaacaaagtaacattgtataacactgatcaggatggtagtgatagcccacgcagtagccttaacaacagtctctcagaccagagtttggcatctgttaatttgaacagtgttggaagtgtgcatagttatacaccggtgacaagccatccagaatcagtctctcaatcattaactcctcagcagcaaccacagtacaaccttccagaaagagacaagcaactacttttctcagaatataattttgaagatcttagtgcctcatttcggagcctttataagtcagtttttgagcagtcacttagtcaacaaggtttgatgaacatcccttctgaatcttcccagcagtcccacacttcatgtacctatcagcactctcccagcagtacagtgagcactcacccacacagcaaccaaagcagcctgtccaacagtcatggcagtggcctcaacaccacaggcagtaattcggttgcacaggtctcactgtctcacccccagatgcacacacagccatctccacatcctccccatcgaccgcatggtttaccgcagcatccgcagcgttccccacacccagcaccacacccacagcaacacagccagctccagtcccctcacccccagcatccctctccacatcaacacatacagcaccatccgaaccatcagcatcagacgttaacacatcaggcacccccacccccacaacaggtatcctgtaattctggtgtttcaaatgattggtatgcgacacttgatatgctaaaagaaagctgtcgaattgccagcagtgttaattggtcagatgtagacctttcacagtttcaaggtctgatggagagtatgagacaggcagatctcaagaactggtctttagaccaggttcagtttgccgatctttgttcttctcttaatcagttctttacacaaactggccttatacattcacagagtaatgttcaacaaaatgtttgtcatggtgccatgcatccaacaaaaccttcccaacacattggaacaggaaatttgtacatagattctaggcaaaatctccctccttcagtgatgccaccccctggttatcctcatatcccacaggcactcagcactccaggaacaacgatggcaggccatcacagagccatgaaccagcagcacatgatgccttcccaagccttccagatgcggcgttccctgcctccagatgacatccaggatgactttgattgggattcaattgtgtagggcttgtttctgcaagacaccagaccctaacgttacctttctgtgcagtgaagggaaaggtttaagagaatccagttgagaaaacaaacttgctaatcactttaccaatgttatcaaaattacttttgaagacaatcagaaggattttagctggataacttactgcttttatctgacccaagcaagtactacatgtttgtctccctgccagctgccctatgtagctcctaactgttgtgtgatttggacggctttttgcatatttgtgtcagtttgatgttaaccacaagtgccagactgatttttcagacggagcctattttgctgcaagcagtttatataaagatacatatgtgtaaatatatgtacaaaaattactgaaaggcttcagttttttctaattggattattatgtcttgaaagttattgtcagtttttattccttgttaggctattttctgcaggatgcttttaactgatgtaggaaactgaaaggaaatagattttttccaaaacccagttccccttatttaatcttttttagaaatgtgggtaatgaattctatctaataagtcaaggaaaccagaatttgacacactccaacaatccgaaggggcatgttgctcctgagcagcatgaagaactgaccaaattggttttgatgcttgggggatcatagagtatttatgtctgcttttctaaatctgcattataatagctctaaaatttgttgattggtaagaaattgggcattgcttggctctttaaacacatcagtgcttccacattcacctatgtatttattattcaaaagtgtcattttaatatttattgctaccttctgtgaatgcttagctcctgtcgggttcattaaggagaaatgtgtctgaaagcacagaactattattatttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctatggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactgttttctagacaccaaaatagctgttttgaaactgttttaattgcttgggtagcaatgtgcactttaaacaatttggatattggaatgcagtctcatactgagtgatttgagtagaaccactgatgatgattttataaattgtgtgaagcgaatttcccatttggcaatcatttactgatttgcagtgatgaatatttttatgagaatttaaacttagcaagaatggccatggaggcaaagccttcacccagacccatcccactctcctgtgatccaggtggtccaggagcccaggacaggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactct

SEQ ID NO: 706 - DNA, 5461 bp, Homo sapiens
ggggatgtggtgctgccggggccgccactgcagctgctgctgcctgctggttgccgcgtcttcccggaggcgactgctggaagctgcagggaacagctgcggtgctctgccatattgtgtcttccccggccggtccctcgcctcccggccgagctgacgttggttgaagccatggataacagaacccacagatgcagagggctgactgtacaagtctgtcaaaaaaccaaactgctggttggctaataattggtcactgtatgacttatagtacaggtgatattacttctgattctagatgaactgtaagagtaaatgggtccagtaattggaatgactccagataagagagctgaaaccccaggagctgaaaagattgcaggattaagccagatttacaaaatgggaagcttgcctgaagctgttgatgctgccaggccgaaggccactctagtggacagtgagtcagcagatgatgaactcacaaacttgaactggcttcatgaaagcactaatcttctaacaaacttcagcctcggaagtgagggtcttccaattgttagtccattgtatgacatagagggagatgatgtgccatcctttggaccagcttgctaccagaacccagaaaaaatcagcgacttcaaagcccccatactcctttagtcttctcatttatatggccattgagcactctccaaataaatgtttgcctgtcaaagaaatttatagctggattctggaccattttccatattttgctactgcaccaacaggctggaagaattctgttcgacataatctgtccctgaataaatgttttcagaaagtggaaagaagccatggcaaggttaatggaaaaggttccttatggtgtgttgatccggaatataaacccaatcttatccaggcactgaagaagcaacctttttcttcagcatcttcacaaaatggttctttatcacctcactatttaagctctgtaatcaagcagaaccaggtgcgaaacctcaaagaatctgatattgatgctgctgctgcaatgatgcttttaaatacttctatagaacaaggaattttagaatgtgagaagcctcttcctcttaaaacagcattgcaaaaaaagaggagttacggcaatgcatttcatcatcccagtgctgtacgattacaagagagtgattctttagccaccagcattgatccaaaagaagatcacaattacagtgcaagtagcatggcagcacagcgttgtgcatccaggtctagcgtgtcttccctgtcttctgtggatgaggtatatgaatttatcccaaagaatagtcacgtgggaagtgatggcagtgaaggatttcacagtgaagaagatacagacgttgattatgaagatgatcctcttggagacagtggctatgcatcacagccttgtgcaaaaatctctgaaaaagggcagtcaggcaaaaagatgcgaaaacagacatgtcaagaaattgatgaggagctcaaagaggcagctggatctctgctccaccttgctggaattcgtacatgtttaggttccctaataagtactgcaaagacacaaaatcaaaagcaacggaaaaaatagaaatacttaaagtgtggcaatactctttcacttaattctttacaagggatatcaaagccataatggacttcattagttttagggtagggaagggatactaattacttatttctttcaaaacatttttggtttttggtttttaaaatttttattaaacaattgctgttaggatcatgcctgatcagaaatacatgatgtgaagtcctaaaagcataatttttgtgataaatgtgtccaagatttgaaaatttttatataagaaaatccccagcctctgtcttaaacttgtgggacaaaaatcctttcttctgttaatatgtcagaatgtaagatttggcaactcgataaatttttttcattttcttttccaatctgtaactatagttactgaaccagctaaaaattttgctgatgtatttttcatatacttctctcctgacacgcaatccggtaacataagattgaaatttttttactttgtcttaatttgtttctaattttttttttgttgtcgtgtgagcaaagacaaacataaattgaaaaacatcctgatgtttagaaagtttcttttggttacgtaggtagagaatacaacaaagagttctaagacttagaaaagacaattttgtggtgtcatttcatccaagaacactcccaattcctattagaatggtagctttgaagtgtttttacttcagagatcctgcatagcatttattggggccttttattctttcccaaagtgctttgcaaacattaagttttagccactagctgcctttgttgagtataagttatccagtgagaggatatagccaattaagtgtgttatggagtacacccattttgacacacttgtaataagagaatctttcatttgcctgccatgtgtactgtattatgagaatcttataatcggaatggagtgaaatgaaacattttgagtactgatggcatgttatcatacataaagtaggtcatttaggaaaaaacttctgtccaagctttgtatgaattaaattcataagtataccaaattaaatcttaatagatttaatgcaattttacagacacaataccttcatgaatttcaaaattcatataaaatttgatcttatgcaatacacctttttgaggaggcagtgtaacaacctatagtgccattgatccatgagaaaaagattttctggtactactccaaaagtgctttgactaagtatcttaactatttgaacagtctgcttatatgagacagtttttcatagtatcatttgtataatttgattagattattcagaaacaataggatgctaaactaattcattgtatcttttttttacaatggtggaagcaactttctgaaagttcagtcttatgctacatcctaagtcatagacaatgaccttgttttcattattctgatagattgtatacatatgtacacatacatatacacatatgcacagtcaaggtcatgatgttgatttgctttcagctgtttctgtgattataaagcattttttaagagacaaattttaacttttaatttttattttggcaaaactgtcaaatgagaaaaatgattttaaaaacttttttttcaattgacaagactttaagtcagggataacagtattaatgttctctgttctgtttccatgttaaatttaatttaacctggatagccacattaatgaattggtgctgtcaaaatatagtaatttttaaatttgttaataatgaaaacccttaagcatgcaggatgaggtatttgggttttttttttagatcgatcacatctacagaaaatggctaaaccaagttaacttttattatagacagtgaataaaacaccaaaaacccaaaaatgctttaaccacagtataaataatagattatacacatcatcttaataactatttttaagttatttaccatagcctctgtatagaccttaggaacagtgtttcagtgatctggcaccagtttattttgttctgctgaaattctgtatcacaaatgtgctacctggtttttgtccattagataattactctttataaggaaaggaaagagaagcagagttagttccagctctaatagggatcttcaaagttattttgtcttgatgtatgtaacagtaattctttacatcttttgatttttctcttcctttttattcactcttcccacgaatttaaatgtttaagttatattcatcactagcaaggatgataaacacttgtgcactgaaagctaacagggagaggttacacaatattttacagtttcttaaacataatttaatgcatcaccttccacttgctaacataccaagtcagttattttcaagggaagaaccttttaaattatggtcctccatttactacttccactgagagtatgctctcattcctcaggtgttttgagaaacatgactaataaccacacaattaagtagagtcattccaagtcctatggcctggaaattgtattccctataatatacaaattttcctgtaataaagtcaacttagaaactccaaggaggttacatgttttccaacatatcctaaaaactgtgatataagctaacatataatttgccttacgtcaaaagaatatgttttgttgcagctgattccagtttataatagatccctagtaaaaagctttgattcaacacaattgttcatcttcacatcccaaacagaatcactgtttcttgaatatatatttttgaagtttttttgtgcaatatattactaaatcagttattattttacttttccaaattcagagaaagaaaacagattacctgaattcatggaaaaggtggatcacctccctttttccaccttcaagcctttcctgtcctcatagccagcatgacttcttttaacttggattcctttgtatatagtaaagtttagtatatatatatttttttctttttgctactttctgaggcattatgtaaagggctcatactagatgttcagttaaatatactttagcacaaagtcaaactagagaatgtgttaaggagggaatgtatatgtcttggtagaccaggaggcctttgccagcaatttaagcaacagatgtgaatacttcacaaagctgtaaagaccattgtcttaaatactacaacaacttaacacccttttgtgaagatcacagcatttatctaagaaactgtgaggctttctggtttacatatatcttacaggtgtttttttgtatttttttttttttttagtttgaaatgtgtaagctttgatttaaaccaagtttacttcagtatgttaatgatgtagtaaaaatatttattgaaaggtgaattcgagtattttaatgttatacctgccattttttttcttaaagcatattctttgcatctaactgccagtgccattgtcaaaacttattttttaaatcgttgtacatttcttattaaactaagtgcttaattttaaagtattatgttgccatcatatagtgtataaaaatgtataattgccaattgattgtaactattatttatttttaaatgaaagtgtaagaatgctttctgattcaacaaatttgttatcaaactgtttccttatcctcttttctgatgtagcataaaaattgtcccggtttgagttataactgccagtagatgaccagtcacaagtgaaccacttctcagttgccaatctttgctcatattaaaaacaacttacaaatacttagtttttgtatctaatctctgattattaaaatgtttataaagtttatttttaccaaagagatgcaattcattatgagaaagtattgcataataaattttgttttataactttt

SEQ ID NO: 707 - DNA, 5408 bp, Homo sapiens
cgcgtcttcccggaggcgactgctggaagctgcagggaacagctgcggtgctctgccatattgtgtcttccccggccggtccctcgcctcccggccgagctgacgttggttgaagccatggataacagaacccacagatgcagagggctgactgtacaagtctgtcaaaaaaccaaactgctggttggctaataattggtcactgtatgacttatagtacaggtgatattacttctgattctagatgaactgtaagagtaaatgggtccagtaattggaatgactccagataagagagctgaaaccccaggagctgaaaagattgcaggattaagccagatttacaaaatgggaagcttgcctgaagctgttgatgctgccaggccgaaggccactctagtggacagtgagtcagcagatgatgaactcacaaacttgaactggcttcatgaaagcactaatcttctaacaaacttcagcctcggaagtgagggtcttccaattgttagtccattgtatgacatagagggagatgatgtgccatcctttggaccagcttgctaccagaacccagaaaaaaaatcagcgacttcaaagcccccatactcctttagtcttctcatttatatggccattgagcactctccaaataaatgtttgcctgtcaaagaaatttatagctggattctggaccattttccatattttgctactgcaccaacaggctggaagaattctgttcgacataatctgtccctgaataaatgttttcagaaagtggaaagaagccatggcaaggttaatggaaaaggttccttatggtgtgttgatccggaatataaacccaatcttatccaggcactgaagaagcaacctttttcttcagcatcttcacaaaatggttctttatcacctcactatttaagctctgtaatcaagcagaaccaggtgcgaaacctcaaagaatctgatattgatgctgctgctgcaatgatgcttttaaatacttctatagaacaaggaattttagaatgtgagaagcctcttcctcttaaaacagcattgcaaaaaaagaggagttacggcaatgcatttcatcatcccagtgctgtacgattacaagagagtgattctttagccaccagcattgatccaaaagaagatcacaattacagtgcaagtagcatggcagcacagcgttgtgcatccaggtctagcgtgtcttccctgtcttctgtggatgaggtatatgaatttatcccaaagaatagtcacgtgggaagtgatggcagtgaaggatttcacagtgaagaagatacagacgttgattatgaagatgatcctcttggagacagtggctatgcatcacagccttgtgcaaaaatctctgaaaaagggcagtcaggcaaaaagatgcgaaaacagacatgtcaagaaattgatgaggagctcaaagaggcagctggatctctgctccaccttgctggaattcgtacatgtttaggttccctaataagtactgcaaagacacaaaatcaaaagcaacggaaaaaatagaaatacttaaagtgtggcaatactctttcacttaattctttacaagggatatcaaagccataatggacttcattagttttagggtagggaagggatactaattacttatttctttcaaaacatttttggtttttggtttttaaaatttttattaaacaattgctgttaggatcatgcctgatcagaaatacatgatgtgaagtcctaaaagcataatttttgtgataaatgtgtccaagatttgaaaatttttatataagaaaatccccagcctctgtcttaaacttgtgggacaaaaatcctttcttctgttaatatgtcagaatgtaagatttggcaactcgataaatttttttcattttcttttccaatctgtaactatagttactgaaccagctaaaaattttgctgatgtatttttcatatacttctctcctgacacgcaatccggtaacataagattgaaatttttttactttgtcttaatttgtttctaattttttttttgttgtcgtgtgagcaaagacaaacataaattgaaaaacatcctgatgtttagaaagtttcttttggttacgtaggtagagaatacaacaaagagttctaagacttagaaaagacaattttgtggtgtcatttcatccaagaacactcccaattcctattagaatggtagctttgaagtgtttttacttcagagatcctgcatagcatttattggggccttttattctttcccaaagtgctttgcaaacattaagttttagccactagctgcctttgttgagtataagttatccagtgagaggatatagccaattaagtgtgttatggagtacacccattttgacacacttgtaataagagaatctttcatttgcctgccatgtgtactgtattatgagaatcttataatcggaatggagtgaaatgaaacattttgagtactgatggcatgttatcatacataaagtaggtcatttaggaaaaaacttctgtccaagctttgtatgaattaaattcataagtataccaaattaaatcttaatagatttaatgcaattttacagacacaataccttcatgaatttcaaaattcatataaaatttgatcttatgcaatacacctttttgaggaggcagtgtaacaacctatagtgccattgatccatgagaaaaagattttctggtactactccaaaagtgctttgactaagtatcttaactatttgaacagtctgcttatatgagacagtttttcatagtatcatttgtataatttgattagattattcagaaacaataggatgctaaactaattcattgtatcttttttttacaatggtggaagcaactttctgaaagttcagtcttatgctacatcctaagtcatagacaatgaccttgttttcattattctgatagattgtatacatatgtacacatacatatacacatatgcacagtcaaggtcatgatgttgatttgctttcagctgtttctgtgattataaagcattttttaagagacaaattttaacttttaatttttattttggcaaaactgtcaaatgagaaaaatgattttaaaaacttttttttcaattgacaagactttaagtcagggataacagtattaatgttctctgttctgtttccatgttaaatttaatttaacctggatagccacattaatgaattggtgctgtcaaaatatagtaatttttaaatttgttaataatgaaaacccttaagcatgcaggatgaggtatttgggttttttttttagatcgatcacatctacagaaaatggctaaaccaagttaacttttattatagacagtgaataaaacaccaaaaacccaaaaatgctttaaccacagtataaataatagattatacacatcatcttaataactatttttaagttatttaccatagcctctgtatagaccttaggaacagtgtttcagtgatctggcaccagtttattttgttctgctgaaattctgtatcacaaatgtgctacctggtttttgtccattagataattactctttataaggaaaggaaagagaagcagagttagttccagctctaatagggatcttcaaagttattttgtcttgatgtatgtaacagtaattctttacatcttttgatttttctcttcctttttattcactcttcccacgaatttaaatgtttaagttatattcatcactagcaaggatgataaacacttgtgcactgaaagctaacagggagaggttacacaatattttacagtttcttaaacataatttaatgcatcaccttccacttgctaacataccaagtcagttattttcaagggaagaaccttttaaattatggtcctccatttactacttccactgagagtatgctctcattcctcaggtgttttgagaaacatgactaataaccacacaattaagtagagtcattccaagtcctatggcctggaaattgtattccctataatatacaaattttcctgtaataaagtcaacttagaaactccaaggaggttacatgttttccaacatatcctaaaaactgtgatataagctaacatataatttgccttacgtcaaaagaatatgttttgttgcagctgattccagtttataatagatccctagtaaaaagctttgattcaacacaattgttcatcttcacatcccaaacagaatcactgtttcttgaatatatatttttgaagtttttttgtgcaatatattactaaatcagttattattttacttttccaaattcagagaaagaaaacagattacctgaattcatggaaaaggtggatcacctccctttttccaccttcaagcctttcctgtcctcatagccagcatgacttcttttaacttggattcctttgtatatagtaaagtttagtatatatatatttttttctttttgctactttctgaggcattatgtaaagggctcatactagatgttcagttaaatatactttagcacaaagtcaaactagagaatgtgttaaggagggaatgtatatgtcttggtagaccaggaggcctttgccagcaatttaagcaacagatgtgaatacttcacaaagctgtaaagaccattgtcttaaatactacaacaacttaacacccttttgtgaagatcacagcatttatctaagaaactgtgaggctttctggtttacatatatcttacaggtgtttttttgtatttttttttttttttagtttgaaatgtgtaagctttgatttaaaccaagtttacttcagtatgttaatgatgtagtaaaaatatttattgaaaggtgaattcgagtattttaatgttatacctgccattttttttcttaaagcatattctttgcatctaactgccagtgccattgtcaaaacttattttttaaatcgttgtacatttcttattaaactaagtgcttaattttaaagtattatgttgccatcatatagtgtataaaaatgtataattgccaattgattgtaactattatttatttttaaatgaaagtgtaagaatgctttctgattcaacaaatttgttatcaaactgtttccttatcctcttttctgatgtagcataaaaattgtcccggtttgagttataactgccagtagatgaccagtcacaagtgaaccacttctcagttgccaatctttgctcatattaaaaacaacttacaaatacttagtttttgtatctaatctctgattattaaaatgtttataaagtttatttttaccaaagagatgcaattcattatgagaaagtattgcataataaattttgttttataacttt

SEQ ID NO: 708 - DNA, 932 bp, Homo sapiens
gggaggaagcgagcgggagggggatgtggtgctgccggggccgccactgcagctgctgctgcctgctggttgccgcgtcttcccggaggcgactgctggaagctgcagggaacagctgcggtgctctgccatattgtgtcttccccggccggtccctcgcctcccggccgagctgacgaactgtaagagtaaatgggtccagtaattggaatgactccagataagagagctgaaaccccaggagctgaaaagattgcaggattaagccagatttacaaaatgggaagcttgcctgaagctgttgatgctgccaggccgaaggccactctagtggacagtgagtcagcagatgatgaactcacaaacttgaactggcttcatgaaagcactaatcttctaacaaacttcagcctcggaagtgagggtcttccaattgttagtccattgtatgacatagagggagatgatgtgccatcctttggaccagcttgctaccagaacccagaaaaaaaatcagcgacttcaaagcccccatactcctttagtcttctcatttatatggccattgagcactctccaaataaatgtttgcctgtcaaagaaatttatagctggattctggaccattttccatattttgctactgcaccaacaggctggaagaattctgttcgacataatctgtccctgaataaatgttttcagaaagtggaaagaagccatggcaaggttaatggaaaaggttccttatggtgtgttgatccggaatataaacccaatcttatccaggcactgaagaagcaacctttttcttcagcatcttcacaaaatggttctttatcacctcactatttaagctctgtaatcaagcagaaccaggtgcgaaacctcaaagaatctgatattgatgctgctgctgcaatgatgctttt

SEQ ID NO: 709 - DNA, 1159 bp, Homo sapiens
aaatggaccgctccacacctgagctgccgccaagctaactcaatccgagccggcgcatttgagaaggcgcctgtgagggtcgctcctcagccgccgcgctcccactccgcgtccccactccgcgccgccgcgcctctgccagccccgaaggtggacgtgaagctccaacacctcgacttctgggcccgcctccatggccaggtcccgggactgctggactgggacatggggaacgagctctttctggccttcaccacatctcacctccccttagcggagcagaaacttgccaggtataaactccgaattgttaagccaccaaaattacccctagagaaaaaacccaaccctgataaggatggtccagattatgagcccaacctctggatgtgggtaaatcccaacattgtgtatccccctggaaagctggaggtctcaggacgtaggaagagggaggacctgacaagcacactcccctcctctcagccaccccagaaggaggaagatgccagctgctcagaggccgcaggggtggaatcactgtcccagtcctccagcaagcggtctccccctcggaagcggtttgccttttcccccagcacctgggagctcacagaagaggaggaggctgaggaccaggaagacagctcctctatggctctcccatcccctcacaaaagggcccccctccagagtcggaggcttcggcaagccagcagccaggcggggaggctctggtcccggccccctctcaattacttccacctaattgccctggcattaagaaacagttccccctgtggcctcaacgtgcaacagatctacagtttcactcgaaagcacttcccctttttccggacggccccggaaggctggaagaatactgtccgtcacaatctctgttttcgagacagctttgagaaagtgcctgtcagcatgcagggcggggccagcacacggcctcgatcttgcctctggaagttgaccgaggagggacaccgccgctttgcggaggaggcccgcgccttggcttccactcggctagaaagtatccaacagtgcatgagccagccagatgtgatgcccttcctctttgatctttaaccccaagaagcaacagccagctaatgctttattaaaattaccctcactagccttc

SEQ ID NO: 710 - DNA, 2789 bp, Homo sapiens
ttcctcttgaagtgactttctgcttccaatcaaagctcaagaattccacctaaaaatgtttttctgctcaaaagctcttttttattacttccatgttttgagccttgttccagaaagctgaggtttctccaggtctgaccactaatcagtgagacattggtgcctctttcttcagtgcttctagcaggcctactgataagctccctagatgagatacactgcataaaaaaatgatgcccaaaggacagctttaagtgcctgctagatatctgttctttcagaagtctctctccacctatctctccagtaaagatggacttaaaactaaaagactgtgaattttggtatagtctccatggccaggtcccagggctgctggactgggacatgaggaatgagttatttctgccttgtaccacagaccagtgctctttagctgagcaaatccttgccaaatacagagtcggagtaatgaagcccccagaaatgcctcagaagaggagacccagtcctgatggagatggtcctccctgtgaacccaatctgtggatgtgggtggaccccaatatcctgtgcccccttggcagccaggaggccccaaagcccagtggaaaagaggatctgacaaacatttctcctttccctcagcccccacaaaaagacgaagggtctaactgctcagaggacaaagtggtagagtctctgccatcttcctccagtgagcagtctcctttacagaagcagggtatccattcccccagtgactttgagctcacagaagaggaggctgaggaaccagacgacaactccctccagtcccctgaaatgaaatgttaccagagccagaaactatggcaaatcaacaaccaagagaagtcctggcaaaggccccctctcaattgtagccaccttattgccctagcattaagaaacaacccccactgtggcctcagtgtgcaggagatctacaatttcacccgacagcatttcccctttttctggacagctccggatggctggaagagcaccattcattacaacctctgcttcctggacagctttgagaaggtgccagacagccttaaggatgaagataatgcaagacctcgctcttgcctttggaagctcactaaggaggggcaccgccgcttttgggaggagactcgtgtcttagcctttgctcaaagggagagaatccaagagtgcatgagtcagccagagttgttgacctctctctttgatctttgaaatgccattgctcccttttggaacactgccttccttactgtgcctacttatcccctgacattcattaatctctaaacttacccagcctggttggtgccaagtctgtctttagctactgttacaataatggtgttaagtaaagttagaggtgggtacaggggagacagaacttaaatccaggtggagagtcatggaaagtcgcacgaggagagtggctgttgttccaaattttgagcaaaggaaaagaaatcctagaaacaatggcatagaaactaaggaaagaagggtgtgttttgtgaaagaaaggaattttgtttatagagagtattttcacacatgaaagtgaacagtggaatataaagcataaaaggcaggatggagccgagccatggagaacctcgagtgccatgtgaagagaatttgacttgtgatgaagaatcaagtttccccttctaccattcatcagctacatctcctttttaagtaacccattttatccttcagaacctcacttttctatttctggccctggacttctaagccttgtttctttgtcatccaattccaatattgacaaataattctaaacagctacttttagtttgtatgtttaacgtcctgtgaaatattcctgtattaaccccaagccttttgatgataaagctttattttctattatttttagttctcaagattttattgaggatatgctaatgtgtcaaggtccatcttagatgctgaggataaaaagctgagggatactagtgggagacatatttataatgtaaatatgatgaaacagatgtgagaaattgacatggaaatggggagacattcttcctgggaaagacatgaaagggcattggaaaaaatacattttgagctagttttgaagaataaatggcaaactggagtagaggcattacagagacaacaatgtgaacaaagtggatggagtgtttgggggaatggcatgaagttcagtgtgacttaactacatgaggaccgtgagtgactaagagaaaactattaggtgtttggacttcatcttgtgggtttttaggagccaagagacatcagtggagttttgctaaaaaacaaaaaaagaaacaagccagcagcaacaacaaacactacagcatttgtttttctaatttcaaaattatctttaacatcttttctatgcaaataaacttttgtttatcagatttaagcatagctttttgcttcaatgatattaacatatatccaggagaaaatagatttttaggtataaatttagttgcaaaaccttcataatgggggtacaaaaacgcctgtaagctacaaaagcaattaattcaatataattgtaactattttcaaagttcacatttttataatgatgtattatacctcatacaaaattgtatatttaggttaaatcacaaaacaacatatgcaaacagtattttttgaaaaaaattgtaaatgctacttctgtatcataaggcaaagaccaagttaacagaataccttggaattaataaaatattctgcat

SEQ ID NO: 711 - DNA, 1318 bp, Homo sapiens
caggctattccggacgccagccctggaagctgagcctgacccagcaggtcccagcagcctggcagcccggccagcatgcagcagcagcctctgcccgggcctggcgcccccacaactgagccaaccaagcctccctacagctacatcgcccttattgctatggccatccagagctcaccggggcagcgggccaccctcagtggcatctaccgctacatcatgggccgattcgccttctaccgccacaaccggcccggctggcagaacagcatccgccacaacctgtcactcaacgagtgctttgtcaaggtgccccgcgatgaccgcaagccaggcaagggcagctactggacgctggaccctgactgccacgacatgtttgagcacggcagcttcctacgccgccgccgccgcttcacccggcagacaggtgctgagggcacccggggccccgccaaggcacgccgtggacccctcagggcgaccagccaggacccaggagtccccaacgccacgaccggcaggcagtgctcattcccaccagagctgccagatcccaagggcctaagctttgggggtctggtgggggccatgccagccagtatgtgcccagcaaccactgatggcaggcctcggccacccatggagcccaaagagatttccacgcccaagcctgcatgcccaggggagctccccgtggccacctcatcttcctcatgcccagcgtttggctttcctgccggcttctcagaggctgagagttttaataaggcccctacgcccgtcttgtccccggaatcaggcatcgggagcagctaccagtgtcggctgcaggcactgaatttttgcatgggggctgacccaggccttgagcacctcttggcctcagcagccccctcccctgcaccacccacccctccaggctcactccgggccccactgcccctgccaactgaccacaaggaaccctgggttgcaggtggcttccctgtccagggaggctccggctacccattggggctgaccccctgcctataccggacgccaggaatgttcttctttgagtaaaggcagcctcacctcgggcagtccctgcaggtccctcaccctccgggctgagcctggctctaggacctgaagaactctcgaaggacccagccctggtgagccaaggacaaccacacagaaagccaggattgaagcggtgctcagccaggcccctggggcctccggacaaacttgggggtgaggggaagcagggcctcttgggatttactctgtggctctcagggccaataaagccatgtgatgatgaggg

SEQ ID NO: 712 - DNA, 3586 bp, Homo sapiens
cgatcctgcgagggccgctaggagcgagtcacggcgcggggccgctctggtcgcccgcgagtgtcggtggccccgccccgcccgcagccgcgggtggagaccgaggacggcgccggcgcgtgcgcgctccctcggtgcggcgggctgcgtgcgcgagtgggaggtggcaggcctgcgactccggccttgtccgcgcccgctctcggcgcgacgtctccagccatgaaccggtttggtacccggttggtgggagccacggcgacttcttcgccgccgccgaaggcccgcagcaatgaaaacctcgacaaaatagatatgtctttggatgatatcatcaagttgaatcgaaaggaagggaagaagcagaattttccaagactaaatagaagactcctccagcaaagtggtgcccagcaattcaggatgagagtgcgatggggaatccaacagaattctggttttggtaagactagtctgaatcgtagaggaagagtaatgcctggaaagagacgtcctaatggagttatcactggccttgcagctaggaaaacgactggaattcgaaaaggaattagtcctatgaatcgtccacctctaagtgacaagaatatagaacaatattttccagtgttaaaaaggaaggcaaaccttctgagacaaaatgaagggcagaggaaaccagtagcagttctcaagagacctagccagctaagcagaaaaaataacattccagctaattttaccaggagtggaaataaattaaatcatcagaaagatactcgtcaggcaacttttcttttcagaagaggcctgaaggtgcaggcccagttgaatacagaacaactgctagacgatgtagtagcaaagagaactcgtcaatggcggacttccaccacaaatggagggattttgactgtatctattgacaatcctggagcagtgcaatgcccagtaactcagaaaccacgattaactcgtactgctgtaccttcatttttaacaaagcgggagcaaagtgacgtcaagaaagttcctaaaggtgttcccctgcagtttgacataaacagtgtcggaaaacagacagggatgacgttgaatgagcggtttgggatcctgaaggaacaaagagccactctcacatacaacaaagggggaagccgctttgtcaccgtgggataggtcccatgtcaaaggaacttttgagtgatgactctgagaagttgaattgcttgaagagttcatcacggaaattcaagaaactttacttcaaaatattcacaaggctaaataactcttatttttatttttgaaggtttttttttttaaaaaaaaaaacgtataaaataatgccctgaaagaataatagggattatacctgtctgttcttaaagatttcatggttggctcagacagaacaatcatctgtttgacttctttggttcctcatgcagcagaaggaagacagaaagatagaaattgattatttttatgatagcagtattcaggatctcatcacctttgcccgtgttttagactttgtcatggtaaatcctggtcttcataaacatgagtaggtcccttggttgctgtcacttgccctttaatagtgttgatgtagtcagtgccgttgccttttcttcattagagacacagaacaatgtattagaatttccagctgtgggtttgaagacttagggggacatccagaacgtgcttcctctttcagacggtgtaaagtcccctggaattacacagctttagtgctgagcttttaacaggaaatgtggccctaggtattagtcttagtttaaaatgttggtgtttagagactgtaaatgcatattcacaaagttatctgatagggccttggaggagaaggtccagttttaaaaaatgacagtttgtgtttaataaatgaaggcatgagaggaagtaagtagcaagttgaaggacaggtagttgagatgaaacacttcaaaaccctggttatagatgtactgtttggatgtagcatagtcttgagtctagcgtccacaaagaattattcaaatgatatttagaagaattataactattacattgaatggagtcccttggatattttgatagtaaaattaatagccataaagtcctagacttcttatttgaagttaaaatttcttatttgaaaagttgaaatttatgagctttgaagattgctaaattaaataatttatagctccaaaaacaaaaatatacttgtatatgtcacagagaaaaaaaatgcaaaatttataatagagttacattaaccttgttgtttacctttcactgatttcttatatggtataaattaaagttcaggcatttatggggagaaaaggccctccccaccgacccgccacctgccacctctgacggagtgggagaagttagtctgtgctaagatagtactgagtccccagatgttgtatactgtaaattacagtataatgccaaatgcagcaaaatcttccagctgtacgttacaagtttggtcattttgaagcttgacattttagtttgccattatgttaaaaacatctaaataggtgttagtttctcaggagtagattgttagtgttgacttttcctgtaaagcagacatcgttcttggcctgccctgcattgtatactagatttcattgttgtctctcatgcttcttgagttgcttcatggtttatgctcgccatggaaagctatcagtaacagtttcatgcttataccaaagaattaaatctgatctttaatatctgatattttcctggtactcgtactgataagggattattggaagtcagtcacagaatttggaaataaattctagtctctccttagctatttgatgcttttcatataggccaagaactcattgcaaaacatttttgcaaggatgaatgcctgtatttggtctaggaacagtacattttagtctgatttagaattactggtagcttattttaaagcaaggaaaagcagctgagctcaagtttgctgtctttagaatggtttgtgaaaatatggtataaaggtgttttcattttcctgttcttacctattattgtatagagctattcatgccattttttgggaaaactttaaaaattgccccaaatactgacattgagtgcattaaataacaaattatctttgatacattaaacttttattcttcatgcatctgtaatttaattttaagtataatgttttgcctttggtacaactaaattaaaactcttggtggtcacatattgtatataaacaaaacaatatgctttgttgaaggaaaattttctttattggaatgtggttgtaatccttgttcagttcttaagtttcggttttttttaaaaacaggatgcaacttaaacttttctttgcatcaaggtatatgcaaaacattggtgccgtgcatcaccaaatgaaagtttgtatttaacgaggaggtgctttacactgtactttttggtgttttttggaaaagttacatttagatctattctgaagctgttcatttttaacaaataaaatgttacaggtttcacatgatttattctcagctctaaa

SEQ ID NO: 713 - DNA, 3654 bp, Homo sapiens
gaaaggctcgtgtgtaccgaagtataggggacctgtctgcagcaggagggactcgaaggacacggaggattatatcactgaaggcataagattcagagtagagacgggatttcaccatgttggtcaggccagtcccgaactcctgacctcaaatgatccgcccacctcagcctcccaaagtgctgggattataggtgtgagtcaccatgcctggccggaagggggtcatctttaaaaaatggagccttctgtgattatgggaaatgatatcatcaagttgaatcgaaaggaagggaagaagcagaattttccaagactaaatagaagactcctccagcaaagtggtgcccagcaattcaggatgagagtgcgatggggaatccaacagaattctggttttggtaagactagtctgaatcgtagaggaagagtaatgcctggaaagagacgtcctaatggagttatcactggccttgcagctaggaaaacgactggaattcgaaaaggaattagtcctatgaatcgtccacctctaagtgacaagaatatagaacaatattttccagtgttaaaaaggaaggcaaaccttctgagacaaaatgaagggcagaggaaaccagtagcagttctcaagagacctagccagctaagcagaaaaaataacattccagctaattttaccaggagtggaaataaattaaatcatcagaaagatactcgtcaggcaacttttcttttcagaagaggcctgaaggtgcaggcccagttgaatacagaacaactgctagacgatgtagtagcaaagagaactcgtcaatggcggacttccaccacaaatggagggattttgactgtatctattgacaatcctggagcagtgcaatgcccagtaactcagaaaccacgattaactcgtactgctgtaccttcatttttaacaaagcgggagcaaagtgacgtcaagaaagttcctaaaggtgttcccctgcagtttgacataaacagtgtcggaaaacagacagggatgacgttgaatgagcggtttgggatcctgaaggaacaaagagccactctcacatacaacaaagggggaagccgctttgtcaccgtgggataggtcccatgtcaaaggaacttttgagtgatgactctgagaagttgaattgcttgaagagttcatcacggaaattcaagaaactttacttcaaaatattcacaaggctaaataactcttatttttatttttgaaggtttttttttttaaaaaaaaaaacgtataaaataatgccctgaaagaataatagggattatacctgtctgttcttaaagatttcatggttggctcagacagaacaatcatctgtttgacttctttggttcctcatgcagcagaaggaagacagaaagatagaaattgattatttttatgatagcagtattcaggatctcatcacctttgcccgtgttttagactttgtcatggtaaatcctggtcttcataaacatgagtaggtcccttggttgctgtcacttgccctttaatagtgttgatgtagtcagtgccgttgccttttcttcattagagacacagaacaatgtattagaatttccagctgtgggtttgaagacttagggggacatccagaacgtgcttcctctttcagacggtgtaaagtcccctggaattacacagctttagtgctgagcttttaacaggaaatgtggccctaggtattagtcttagtttaaaatgttggtgtttagagactgtaaatgcatattcacaaagttatctgatagggccttggaggagaaggtccagttttaaaaaatgacagtttgtgtttaataaatgaaggcatgagaggaagtaagtagcaagttgaaggacaggtagttgagatgaaacacttcaaaaccctggttatagatgtactgtttggatgtagcatagtcttgagtctagcgtccacaaagaattattcaaatgatatttagaagaattataactattacattgaatggagtcccttggatattttgatagtaaaattaatagccataaagtcctagacttcttatttgaagttaaaatttcttatttgaaaagttgaaatttatgagctttgaagattgctaaattaaataatttatagctccaaaaacaaaaatatacttgtatatgtcacagagaaaaaaaatgcaaaatttataatagagttacattaaccttgttgtttacctttcactgatttcttatatggtataaattaaagttcaggcatttatggggagaaaaggccctccccaccgacccgccacctgccacctctgacggagtgggagaagttagtctgtgctaagatagtactgagtccccagatgttgtatactgtaaattacagtataatgccaaatgcagcaaaatcttccagctgtacgttacaagtttggtcattttgaagcttgacattttagtttgccattatgttaaaaacatctaaataggtgttagtttctcaggagtagattgttagtgttgacttttcctgtaaagcagacatcgttcttggcctgccctgcattgtatactagatttcattgttgtctctcatgcttcttgagttgcttcatggtttatgctcgccatggaaagctatcagtaacagtttcatgcttataccaaagaattaaatctgatctttaatatctgatattttcctggtactcgtactgataagggattattggaagtcagtcacagaatttggaaataaattctagtctctccttagctatttgatgcttttcatataggccaagaactcattgcaaaacatttttgcaaggatgaatgcctgtatttggtctaggaacagtacattttagtctgatttagaattactggtagcttattttaaagcaaggaaaagcagctgagctcaagtttgctgtctttagaatggtttgtgaaaatatggtataaaggtgttttcattttcctgttcttacctattattgtatagagctattcatgccattttttgggaaaactttaaaaattgccccaaatactgacattgagtgcattaaataacaaattatctttgatacattaaacttttattcttcatgcatctgtaatttaattttaagtataatgttttgcctttggtacaactaaattaaaactcttggtggtcacatattgtatataaacaaaacaatatgctttgttgaaggaaaattttctttattggaatgtggttgtaatccttgttcagttcttaagtttcggttttttttaaaaacaggatgcaacttaaacttttctttgcatcaaggtatatgcaaaacattggtgccgtgcatcaccaaatgaaagtttgtatttaacgaggaggtgctttacactgtactttttggtgttttttggaaaagttacatttagatctattctgaagctgttcatttttaacaaataaaatgttacaggtttcacatgatttattctcagctctaaagattgagttgtggtttttagattgttctatgttacgaagaactttgtagtggttatctatatttgtagtttttagggtgtgaaaccttatctactagcaaaattggtaaatcactgtagactcttctatt

SEQ ID NO: 714 - DNA, 1342 bp, Homo sapiens
gaaaggctcgtgtgtaccgaagtataggggacctgtctgcagcaggagggactcgaaggacacggaggattatatcactgaaggcataagattcagagtagagacgggatttcaccatgttggtcaggccagtcccgaactcctgacctcaaatgatccgcccacctcagcctcccaaagtgctgggattataggtgtgagtcaccatgcctggccggaagggggtcatctttaaaaaatggagccttctgtgattatgggaaatgatatcatcaagttgaatcgaaaggaagggaagaagcagaattttccaagactaaatagaagactcctccagcaaagtggtgcccagcaattcaggatgagagtgcgatggggaatccaacagaattctggttttggtaagactagtctgaatcgtagaggaagagtaatgcctggaaagagacgtcctaatggagttatcactggccttgcagctaggaaaacgactggaattcgaaaaggaattagtcctatgaatcgtccacctctaagtgacaagaatatagaacaatattttccagtgttaaaaaggaaggcaaaccttctgagacaaaatgaagggcagaggaaaccagtagcagttctcaagagacctagccagctaagcagaaaaaataacattccagctaattttaccaggagtggaaataaattaaatcatcagaaagatactcgtcaggcaacttttcttttcagaagaggcctgaaggtgcaggcccagttgaatacagaacaactgctagacgatgtagtagcaaagagaactcgtcaatggcggacttccaccacaaatggagggattttgactgtatctattgacaatcctggagcagtgcaatgcccagtaactcagaaaccacgattaactcgtactgctgtaccttcatttttaacaaagcgggagcaaagtgacgtcaagaaagttcctaaaggtgttcccctgcagtttgacataaacagtgtcggaaaacagacagggatgacgttgaatgagcggtttgggatcctgaaggaacaaagagccactctcacatacaacaaagggggaagccgctttgtcaccgtgggataggtcccatgtcaaaggaacttttgagtgatgactctgagaagttgaattgcttgaagagttcatcacggaaattcaagaaactttacttcaaaatattcacaaggctaaataactcttatttttatttttgaaggtttttttttttaaaaaaaaaaacgtataaaataatgccctgaaagaataatagggattatacctgtctgttcttaaagatttcatggttgg

SEQ ID NO: 715 - DNA, 890 bp, Homo sapiens
cacactctgcctttggacgtgagagagagcgcacctttcacttgagcttcaacatgggaaagggaaatgaagaccccgatctccactgctcctccatccagtgctccactgaccagccccctttccaacagatctcctttacagaaaagggctcagatgagaagaaaccattcaaagaaaaaggcaagaccgccttctcccattccagtgagaagcacatacaaaggcaaggatcggagcccaatccaaacaaggagaattctgaggaaaccaagctcaaggccgggaacagcactgctggatcagaaccagagtccagctcatatcgggaaaactgcaggaaaagaaaaatgagttccaaggacagctgccaagacacagcagggaactgtccagaaaaggagtgcagcttgtcattgaataaaaaatcaagatcctccactcctgtgcacaacagtgaaatccaggagacctgtgatgcccaccataggggacgttccagggcttgcactgggcgcagcaagcggcataggtctcgggccctaggagtccaaacaccgtcaattcgaaaaagcttggtgacctctgtgcgagctatgtcagaggctgtttatcaagacctagcccaggtgtgggcacagcagatccattctccacttacctgtgagcagctgacactgctcactcggctccgggggcctctgtgtgcccaggtgcagaccttgtattccatggccacccaggcagcttatgtcttccctgctgagagctggcttgtcccagccacactgccaggtcctggggaatcagccctggatagagaagcccatcccttccctgggcaggagataactgagactgtcagtggatcagatgaggctaagctgtga

SEQ ID NO: 716 - DNA, 2094 bp, Homo sapiens
actctgcctttggacgtgagagagagcgcacctttcacttgagcttcaacatgggaaagggaaatgaagaccccgatctccactgctcctccatccagtgctccactgaccagccccctttccaacagatctcctttacagaaaagggctcagatgagaagaaaccattcaaagaaaaaggcaagaccgccttctcccattccagtgagaagcacatacaaaggcaagcaggatcggagcccaatccaaacaaggagaattctgaggaaaccaagctcaaggccgggaacagcactgctggatcagaaccagagtccagctcatatcgggaaaactgcaggaaaagaaaaatgagttccaaggacagctgccaagacacagcagggaactgtccagaaaaggagtgcagcttgtcattgaataaaaaatcaagatcctccactcctgtgcacaacagtgaaatccaggagacctgtgatgcccaccataggggacgttccagggcttgcactgggcgcagcaagcggcataggtctcgggccctaggagtccaaacaccgtcaattcgaaaaagcttggtgacctctgtgcgagctatgtcagaggctgtttatcaagacctagcccaggtgtgggcacagcagatccattctccacttacctgtgagcagctgacactgctcactcggctccgggggcctctgtgtgcccaggtgcagaccttgtattccatggccacccaggcagcttatgtcttccctgctgagagctggcttgtcccagccacactgccaggtcctggggaatcagccctggatagagaagcccatcccttccctgggcaggagataactgagactgtcagtggatcagatgaggctaagctgtgagcaccctgaccctattcagcagagatgcagctctgggaatgagaacaaggatctgcttcttctcagattcttccagatgaccagcagtgacaattttagacacactgtgttaataaatgacagaacctgaagaagtcataggaaagaaacttgagcggtatactcagaatggtgagagccctgaattttgcagaccgctaagactatagacaaattttatatttcatgttagacatttgatgccttttggatgtctgatgacagtcatgcatttctatataatcagaaaaacattagaatgtaatcgtgaatttgcatattttagattgtagaaaagtaaatataaaattatgtgctccttttttgtttttttttttgagacagtcttgctatgttacccaggctggagtgcagtggcacaatcttagctcactgcaacctctgcttcctgggttcaaacaattctcatgcctcagcctcccaagcagctgggactacaggcatgtactgctatgcctggctaattttttttttcctgtattgttagtagagacagagttttgtcactttggccaggttggcctcgaactcaggtgatctgccagcctccgcctcccaacgtgctgggattacaggcatgagccgccttaccaagaaattgcttctcttttaatccagaaaaggttgtaggctctcactcttccagcctgaacccatggagtactaatatccacaaaccattaatagcactccctgtgggaaaatgtctatatattttgtttgatataattatagtaaaattactatgcaagctgtttacttttaatatttctacataaaatttaagtcaagatatagtaaatggtaaatgattgtacttatttattgacctgcctcatgtttcatttcattttaaacatcctaaatttatattttattatattttatacatttcaattgattgtactatattgcaggatatggagatttcatcacgtactacaatacagtgtattttgttatatttgacgtatattctacttgtattttgtactgagatcatacactatttcattatctaagtgtattaattgtttggttgctttataattttcattttatgtaatgaaataaacaatgttgtttggaattttaaatttctttcatatggaatttgtatttaataaaaatgtgaaaaagagaa

SEQ ID NO: 717 - DNA, 3557 bp, Homo sapiens
gacacagcagatccggtcgcaggcagcgtccagcatggactggtccaggcacctccgacccacccgacgctcctgccccggcccgctctccactcagatcacgctcgctccgcacccagccccgtaacctgccgggccgccactgcacccgccatacctgctctggtccgtcaagcgccatcttctctcttcagcagagaccgccggcatccgagccgtcttggcgcgcaagcgcggaagcggaggattgggacctgaagaccaggcagagaagaattccgggtcaatgggcggggtgtgcggcgagaccacactaagggaaccatgatgggaggggcggctactcgagttcaggggctttggaaggggatgaggaaggagtagaactcctcctcagtgttgcctcattgaaactctgtttatagttcttgtgatatgccttcctagtctcaactttcaacttacaaaacccaaggacagagtattgagaacaatctagggccacactcaaaatggcggaaaacctcgagccagggacgcaggggacgcaagcggaagcggaagtagttagctgcatacttgtgcggttccaagtgtggagaaagcggctctgggtctagattgagggatactccccctttccaccatgggcaagaagggcaaagttggcaagagccgacgagacaagttttatcacttggcgaaggagacgggttaccgttcccgatctgctttcaagctgatccagctcaatcgccgctttcagttcctgcagaaagcccgagccttgctggacctgtgtgctgcgccagggggatggctgcaggtagctgccaagtttatgcctgtatccagccttattgtgggagtggacctggttccaatcaagcctctccccaatgtggtgactctccagcaggacatcacaacagaacgttgtaggcaggccctgaggaaggagctgaagacctggaaggttgatgttgtgctcaatgatggggcccccaacgttggggctagctgggtccatgatgcttactcacaagcccatttgacactgatggctctacgtttggcttgtgactttttggcccgtggtggcagcttcatcacaaaggttttccgttctcgtgactatcagcctctgctatggatctttcagcagctgttccgccgtgtccaggccaccaagccccaagcctctcgccatgaatctgcagagatctttgtagtctgccaaggattcctggcccctgacaaggttgacagtaaattctttgaccccaaatttgcctttaaggaggttgaagttcaggctaagaccgttactgaattggttactaagaagaagccaaaggctgaaggctatgctgagggtgacctcactctctatcaccgtacctcagtcactgacttcctccgagctgccaaccctgttgacttcctctccaaggccagcgaaatcatggtagatgatgaagagttggcacagcatccagctaccactgaggacatacgggtgtgctgtcaggacatcagagtgttggggcgcaaggagctcaggtcgctactaaactggagaacaaaacttcggcgatatgtggccaagaagctgaaagaacaagcaaaggcactggacatcagcctcagctctggagaggaagatgaaggtgatgaggaggactcaacagctggaaccacaaagcagccctctaaggaggaggaggaagaggaggaggaggaacaactgaaccagaccttggcagaaatgaaggcccaggaggtggcggaattgaagaggaagaaaaagaagctgttgcgtgagcagagaaagcagcgggagcgtgtggagctgaagatggatctgcctggggtttccattgcagacgagggggagactggcatgttctccttgagcaccatccggggtcaccagttattagaggaagtaacacaaggggatatgagtgcagcagacacatttctgtccgatctgccaagggatgatatctatgtgtcagatgttgaggacgacggtgatgacacatctctggatagtgacctggatccagaggagctggcaggagtcaggggacatcagggtctaagggaccaaaagcgtatgcgacttactgaagtgcaagatgataaagaggaggaggaggaggagaatccactgctggtaccactggaggaaaaggcagtactgcaggaagaacaagccaacctgtggttctcaaagggcagctttgctgggatcgaggacgatgccgatgaggccctggagatcagtcaggcccagctgttatttgagaaccggcggaagggacggcagcagcagcagaagcagcagctgccacagacacccccttcctgtttgaagactgagataatgtctcccctgtaccaagatgaagcccctaagggaacagaggcttcttcggggacagaagctgccactggccttgaaggggaagaaaaggatggcatctcagacagtgatagcagtactagcagtgaggaagaagagagctgggaacccctccgtggtaagaagcgaagccgtgggcctaagtcagatgatgacgggtttgagatagtgcctattgaggacccagcgaaacatcggatactggaccccgaaggccttgctctaggtgctgttattgcctcttccaaaaaggccaagagagacctcatagataactccttcaaccggtacacatttaatgaggatgagggggagcttccggagtggtttgtgcaagaggaaaagcagcaccggatacgacagttgcctgttggtaagaaggaggtggagcattaccggaaacgctggcgggaaatcaatgcacgtcccatcaagaaggtggctgaggctaaggctagaaagaaaaggaggatgctgaagaggctggagcagaccaggaagaaggcagaagccgtggtgaacacagtggacatctcagaacgagagaaagtggcacagctgcgaagtctctacaagaaggctgggcttggcaaggagaaacgccatgtcacctacgttgtagccaaaaaaggtgtgggccgcaaagtgcgccggccagctggagtcagaggtcatttcaaggtggtggactcaaggatgaagaaggaccaaagagcacagcaacgtaaggaacaaaagaaaaaacacaaacggaagtaagcagagctgccaggctcccaggagagcatggggactaggaggaagggtgtggcatggctcagtctggcccccttgattaccggcctagcccctgctcacatcacagctgtctgaagaacagtgaggtggagtgcctagaactcccgtggtggtcctgagcagagaggaggatgtcctcctgcctgcctgaaggtctcccatgaaaacactgctgaactgtgttgacactcatgaccctttttttaaaccgttaaagggaagttcggtgttggagcgatactcaatgtagtcagtctacacctggacgtgtgggccacttaagccctccccacccccatcctattcctgaataaaaccaggataatgg

SEQ ID NO: 718 - DNA, 1735 bp, Homo sapiens
actttggccggcccctagcgatctgaacccaaactaaatttcccagcaagcagcgcgccggcctgggaaaaggagcaagatggctgactccaaagagggtgttttgccgctgacggctgcttccactgccccaatttcattcggcttcactcgcacgtccgcacggaggcggctggccgactcgggagacggcgcggggccatctccggaggagaaggatttcttgaaaaccgtggaagggagggagctgcagagtgtgaagccccaggaggcccccaaggaactcgtcatccctttgatccagaatggccatcgcaggcagccaccagcccggccccctgggccatccacagatactggggccttggcggatggggtggtgtcccaggctgtgaaggagctcattgcggaatccaagaagtctctggaagagagagagaatgcgggtgtcgaccccacgctcgctatccccatgatccagaaaggatgcacccccagcggggaaggggcagacagcgaaccccgggcagagacagtgccagaggaggctaattatgaggcggtccccgtggaggcctatgggctggccatgctgcggggcatgggctggaaacctggcgagggcatcggccgcaccttcaatcaagtagtgaagccccgtgtcaactcactgaggcccaaggggttagggctgggtgccaacctgaccgaggcccaggccttgacccccactggcccctcccgcatgccaagaccagatgaggagcaagagaaagataaggaagatcagcctcaagggctggtgcctggaggagctgtggtggttctttctggccctcaccgaggcctctatgggaaggtggaaggccttgatcctgacaatgttcgggccatggttcgtctggctgtggggagccgggtggtgactgttagtgagtactacctgcggcctgtctcccagcaggagtttgacaagaacaccttggatctcaggcaacagaacggaactgcctcatcacggaagaccctctggaatcaagaactctacatccagcaggacaactcagagaggaagcggaaacaccttccagaccgacaggatgggcctgcagccaagagtgagaaagcagcccccagaagtcagcactggttgcacagggacctgcgtgtgcggtttgtggacaacatgtacaaaggaggccaatattacaacaccaagatgataattgaagatgtcctaagcccagatacctgtgtatgtcggacagatgaaggccgagtcctggaaggcctgagggaagacatgctggagaccctggttcccaaggcagagggtgaccgtgtgatggtggtgctgggcccacagactggaagggtgggacatttgctgagccgggacagagcacggagccgggctttggtgcaactgccaagagaaaatcaggtggtggagcttcactacgatgccatctgccagtacatgggccctagtgacacagatgatgactgacccatgggactcctcccatcccccaggctggtaccagttctgtaccatatgagaaagttgccttcagaaggtgggaagatcattgttccatcctctacttctggtgcagtcctgggacaaggacaagggaaagggatgggtgaaccagtagggaagctagaaacaaacccaatatttaccaaaatttagggtataataaaaaccatttcaagtacttaatagaaa

SEQ ID NO: 719 - DNA, 3362 bp, Homo sapiens
caggcatcggtgtcgcctcgcagggaacagttgggtggcttccagcttatgccaggagtctcctcctcacccgcacatcgcggggctaggatgggatgtcgtggctgccaaatcctccgaggcaactcctgcctgggacggcctaccacaggatgggcctgagaatccggagcgcaggctcgggccgctaggacaccttcccccgcccgcggacccagccttccagcatcaccggggttcgcggaggagaaagaggaaaggcgtttggcctgccaaggccgccgtagcgagggggcggggcccggaagagcaggatggcggcgcgggacagtgacagcgaagaagatctggtcagctatgggaccgggctggagcctctggaagaaggtgaaagaccaaagaaaccaatccctcttcaggatcagactgtcagagatgaaaaaggaaggtataaacgattccacggggcctttagtggaggtttctctgctggatacttcaatactgttggctcaaaagaaggatggacaccctctacctttgtgtcttcacgacagaacagagcagacaaatctgttcttggtcctgaagattttatggatgaagaggatcttagtgaatttgggatagcacctaaagcgattgtcaccacagacgattttgcctccaaaaccaaagacagaatacgagaaaaggctaggcagttggccgctgctactgcccctattcctggagccaccctccttgatgacctcataacgccagcaaaattatctgttggtttcgaattgctaagaaaaatgggttggaaagaaggacaaggagttggtcctcgagtaaagagacggccacgccgacagaaacctgatcctggagtcaaaatctatggctgtgcattaccccctggaagctcggaaggatctgagggtgaagatgatgactacttgcctgataatgtgacctttgcacccaaagatgtcacacctgtggatttcacacctaaagataatgtgcatggtctagcttacaagggcctggatccccaccaggcactgtttggaacttcgggagaacattttaatcttttcagtggtggttctgagagagctggcgatcttggagaaattggactgaataaaggaagaaaattgggaatttcaggccaggcttttggtgtaggtgccctggaagaggaagatgatgatatctatgccacagaaactctatccaagtatgacactgttctgaaggacgaggagcctggagacggactctatggctggacagcacccaggcagtataaaaaccagaaagaatcagagaaagaccttcggtacgttggcaaaattttggatggattttccttggcttctaaacctttatcttctaagaaaatctatccacctccagagctgccaagagactatcgaccagtgcattatttcagacccatggtggccgccacctccgagaactcacacttactgcaggtattatcagagtcagctggaaaggcaacgcctgacccagggacacacagtaagcaccaactgaatgcctccaaacgggctgagttgcttggagagacgcctattcaaggttcagctacttcagtgttagaatttctgtcccaaaaagacaaagagagaatcaaagaaatgaagcaggcaactgacctgaaagcagctcagctcaaggccaggagtctggcccagaacgctcagagcagcagagcccagctctcccctgcagcggctgctgggcactgctcttggaacatggcattaggtggtgggacggccaccttaaaagccagcaacttcaagcctttcgccaaagatccggaaaagcaaaagcgatacgacgagttcttagtacacatgaaacagggtcagaaagatgctctggaacgctgtctggaccccagcatgacagagtgggagcgaggccgtgagcgggatgagtttgcccgggcggccctgctgtacgcatcttcccattcgaccttgtcctccaggttcactcacgccaaggaggaggatgactcagatcaggttgaagtccctcgagaccaagagaatgatgtcggggataagcagtcggctgtgaagatgaagatgtttgggaagctcacccgagacacgtttgagtggcaccctgacaagcttctatgtaagagatttaatgtccctgacccttatccagattcaactttagttggcttaccaagagtgaagcgtgacaagtactcagtcttcaactttctgacgctcccagagacagcttccttgcccaccactcaagcatcaagtgaaaaagtatcacagcaccgaggtcccgacaaatcaagaaaaccatccagatgggatacctctaaacacgaaaagaaagaagattccattagtgaatttttaagtttggctagatcaaaagccgagccacctaaacaacagtccagccccttagtaaacaaagaggaagagcatgcaccagaattatccgcaaatcagaccgtcaacaaagatgtggacgcacaggctgaaggagaagggagccgcccatccatggacttattcagggccatctttgccagttcctcagatgaaaagtcctcatcctccgaggatgagcaaggtgacagtgaagatgatcaggcaggctctggggaggccaacttccaaagctcccaagacactgacttgggggaaacatcatctgtggctcacgctcttgtgccagcaccccaggagccgccaccttccttcccgatacaaaagatgcagatagatgaaagagaagagttcggcccgcggctgcctcccgtcttctgccccaatgctcgtcagacacttgaggttcctcaaaaagagaaacataaaaagaacaaagacaagcacaaggccaagaaagagcacaggcggaagaaagagaagaaaaagaaacacaggaagcacaaacacaaaggcaagcaaaagaataaaaaaccagagaaaagtagtagctccgagagttccgacagcagcgacagccagagtgacgaggaaaccgcagacgtgtcgccccaggagctgctgagacggctgaaaagtcttccactaagaaggcagtaattgaatgctgccctggctcgtcctagaatcatttctcctccatgatggaagcccagtgattgttcagttaacgcattgtacagagtgtatttatatgtaaattcctgctgtaaaataatttttaaaaccttgacatttcaaagactgccttgaaaggtcgcagaaattgatttctatttttaatttcagttagtatcgggggaaaaaaatccagactgaacagtttaattaaagtggaatttttctattttc

SEQ ID NO: 720 - DNA, 2349 bp, Homo sapiens
gtggggtcttccacaacggtctcaagatctgcgagaagtttgggcccaatctggacacgtgccctgaaggcaccatcctgggactgcggctggacagctctggggggctgcatcttcatgttaatggggtggaccagggggtagctgtgccagatgtgccccagccctgccatgcgcttgtggacctctatgggcagtgtgagcaggtgacaatcgtgaaccctgagccaggggctgccagtgggaaaagtgctggaacccaaggggacatggagaaagcagacatggtggacggtatcaaagagagtgtgtgctggggtccaccacctgccgctagtcctctaaagagctgcgagtaccatgccctttgctctcgcttccaagaactcctgctgcttcccgaagattatttcatgcctccgccaaagcgaagcctgtgctactgtgagtcttgccggaagctgcgaggagacgaggcccacaggcgcagaggggagcctccccgggaatatgcactgccctttggctggtgcaggttcaacctcagagtgaatccccgcctggaggctgggacactaaccaagaagtggcacatggcatatcacgggagcaatgttgccgctgtacggagagtgctggaccgaggggagctgggagcaggtactgcctccatcctgagctgccgtcctttgaagggagaacctggggtagggttcgaggagcctggcgagaactgtgcacctcctcgggaggagcagccccctcctgtgctgctttccccctcccttcaatatgctggggcggagaccctggcctccaaagtgcaattccgggaccccaaatcccagcggacgcaccaggctcaggtggcgttccaggagccaataaacaccgtctcagagcctccgcctcggcctctctctcgcgcgcccctctccggagcccgcgtcccctggggtgccaccaggtgggcccgcgaaattaaagagagctgaggatgccaaggccagtctgcagccgtcgtcgctcacgttcccggcgacggggtttgtacgccgcgggcacccgtcgcagcgcgcttccgccttctttcacctgtgaggtcggccgccgccgtgactccggaaggactcggccgggccgccggatgtgacgcaggggccagggcgcgtcggagccgctgagaaagcgcagagaaggcgggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctaacatcagctgcataccagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactg

SEQ ID NO: 721 - DNA, 1596 bp, Homo sapiens
aggagtctctccctgtgcccacatgaagctgctttttccggggccaccgggcgggagtggggaagggtgggcgcacggaagatgggggcctctgtacagttgttactgactctgatttctaaggagccaataaacaccgtctcagagcctccgcctcggcctctctctcgcgcgcccctctccggagcccgcgtcccctggggtgccaccaggtgggcccgcgaaattaaagagagctgaggatgccaaggccagtctgcagccgtcgtcgctcacgttcccggcgacggggtttgtacgccgcgggcacccgtcgcagcgcgcttccgccttctttcacctgtgaggtcggccgccgccgtgactccggaaggactcggccgggccgccggatgtgacgcaggggccagggcgcgtcggagccgctgagaaagcgcagagaaggcgggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctaacatcagctgcataccagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactgcc

SEQ ID NO: 722 - DNA, 1152 bp, Homo sapiens
gcaggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctaacatcagctgcataccagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaagtcgggctttgcagctaccagccaacctggccctcggctccccttcatccaacacagccagaacccgcgattctaccacaagtgaccatcagattatatcttcaacaccacaccccccaccccatcgtgggtgagggtatcccctgtgtgtcccaggccaataaaatctacctgccactgcc

SEQ ID NO: 723 - DNA, 1255 bp, Homo sapiens
gagaaagcgcagagaaggcgggccccgtctgaggtctggcagtcagagacagccgggcgcccacggcccgagcgcccacggcagcaccatgcccgcactcctggagcgccccaagctttccaacgccatggccagggcgctgcaccggcacattatgatggagcgggagcgcaagcggcaggaggaagaagaggtggataagatgatggaacagaagatgaaggaagaacaggagagaaggaagaaaaaggagatggaagagagaatgtcattagaggagaccaaggaacaaattctgaagttggaggagaagcttttggctctacaggaagagaagcaccagcttttcctgcagctcaagaaagttttacatgaggaagaaaaacggaggcgaaaggaacagagtgacctgaccaccctaacatcagctgcataccagcagagcctgactgttcacacaggaactcatctcctcagcatgcaggggagccctggaggacacaatcgcccaggcaccctcatggcagctgacagagccaaacaaatgtttggaccccaagtgcttacgacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaagacagcaccgtgatctggagaagcaagagggatagccaagagatgtctgagctcaggaagaaacgtacagaacaaagctgagcacagaagcagggagggaggcaccataccaggatctcttctccacagtcgtacttctgctcaatctccttgccaaggtctccctcagggagacgaaggtcctctcgtacctccccgctgtcctggagcagtgataggtacccatcctggatgccaatcagctgggggcagatagggaaggaggctg

SEQ ID NO: 724 - DNA, 5327 bp, Homo sapiens
acctccccgcgcgtgcgtgctgtgccaaggctgcaaggcgctgaggggagaggcgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaagatcgggaggagtgcacttgtgacctcctcttcatctctgccttccttcccctccacactttcctggtcgagggacgaaagcgcccgaagggcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgtt

SEQ ID NO: 725 - DNA, 5291 bp, Homo sapiens
acctccccgcgcgtgcgtgctgtgccaaggctgcaaggcgctgaggggagaggcgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggacagcctaaaaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacgcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgtt

SEQ ID NO: 726 - DNA, 5387 bp, Homo sapiens
acctccccgcgcgtgcgtgctgtgccaaggctgcaaggcgctgaggggagaggcgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagaaggagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacgcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgtt

SEQ ID NO: 727 - DNA, 5456 bp, Homo sapiens
atgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacatcgggaggagtgcacttgtgacctcctcttcatctctgccttccttcccctccacactttcctggtcgagggacgaaagcgcccgaagggcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgtt

SEQ ID NO: 728 - DNA, 5282 bp, Homo sapiens
acctccccgcgcgtgcgtgctgtgccaaggctgcaaggcgctgaggggagaggcgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaaggcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgtt

SEQ ID NO: 729 - DNA, 5471 bp, Homo sapiens
acctccccgcgcgtgcgtgctgtgccaaggctgcaaggcgctgaggggagaggcgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacatcgggaggagtgcacttgtgacctcctcttcatctctgccttccttcccctccacactttcctggtcgagggacgaaagcgcccgaagggcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtgtt

SEQ ID NO: 730 - DNA, 5444 bp, Homo sapiens
gttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacgcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtg

SEQ ID NO: 731 - DNA, 5291 bp, Homo sapiens
gaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagacggctcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacgcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaacattttcttgagagagttcagttaaaaaagaaaaaatcagcgtcatttgttccctgccaagcatcgtgcaataagtgaatttcctggcctacttcataatctctaagtttggggtatctccaagcatgtatgtagagaaaggactttgccgctttttaaaactagtgtcacagtctctcttgggaggaaacaatgaattggttcatttcttctcagtgttttaccctgttacatgttctgttatttaatgttgttatctcaagctcctatctcttgatgttttcttgtcatcttgaaggctccatggaatgagataaagcattgacccaccacaggacatctcatgaagccatgttcagggtaggagctccacgcacatcaccacccattgtcaggtgctctccctcacccctgtaagccagacagtttgttcaaaacctgcagcaaagagaagcatcagtctaacaagccagaactcattttgtgccacccatttaggtatcactaccatgaactatagggaaaagaaatcacctactccctgacactgtgttgtacccttcatccaaaagtcagcttgcttctctgaccacttacagctttctcacatgagttgcttcacatttttcatcatctttaaggacttcttataaggaaagatgtatcgtatcgcagtcatctgagttagtttctcctccatcacctcatgagtacttaaaaattagacatcaactttcaagagttccttagagagtgtgctctagctggctgcctgctaccccaaagctctgaaagagtaaggttgaagtgctggaacatgctcagattgttttttagttactcaaaagccccttcttgttctgaatgtgaaagctcttcccgttcctgcttactgcagccattctgtgtgtgtggttcagaccctggcctagggccggtgatgtggatgagtgaagggagccaggtacacggcagcagggcagaggagactatggggagcccaccgcctacacagtaggggcagtagcccccagctccacgcctgttgccatgtggaaaagtgggcctagggtggccacagctttgatttttcaagagacaagaaacctagatgttttttggtgccatctctccatttataaatgttggcaaccaatttgaacactttcagagaccatgtgcaggtgagctgtgtcctctaggctgccagctcacagcccccaccccagggccctgtaagctgtgcagtgtgagggcctggcttccccggacacacctggagcagcctctgagtcttacccgtaatggagccggccaaccctgtgtgttatgttgctgtcgctcctgtttttaaccatatgttctgtcccatagcagtcattcacacatgtgaagaagacacaagaatcaaagtacaagttgcctcaatacatgctaataactaagcttctattttcacaggactgatcgatgcacacctttatagcttgaccatatgctgtcatgaaagtagcaccccgacggtgcttgctttactaagtcaccgtgtgtggatgcttttgtcgcattttgcttcactgtgagtagcatgggaaaagggtccacgtctccaaaagactcttccacttgtttgtcccacagccctaagtgccacattgctgttggatgctcccgggatgccttctagaagggggcctcccaccttaagttcaggcgccatctgatagccttttctgcaggcttcatgtccttagctgaccctcctttatcttgcaaacccctgcccctgctgtcccagggaggacgggcttctgtagaggcttctgggaaatgagctgtctgcaggaggtgaagcagtgttttccttggaatgtttgaggacctgcaatagaagatgttgcctttatggccctagagaaagtcaaggaacatggggaccaacaaagcatttccagttgtaagaatatgtcagaagagtgctcggttagcccacggtgccaaaactccaaacaagttccccggtggaatgacgtggccattggagggctgcaggtcgtcctctctgtatgtgccccgcgcatttccttggcctcatctgagatctggtgtcagagttctctgctcctgttggcaaatcgcaccttatctgaacatttgttccagccaccttttgcacatggattccgtaccttgcactagcaatgtctaccttcagtaacgtcgttctttttcaccctgtattctcaatgatcccttcctccccatatgccacccttcccccaaagctgatagggcagaggtgcactttatgaaactggcacttgactgaacagaaggaaacagctgtacctctaagctcctttcacagaaatcgtcatctgccttggaatgcaaatagttcttatttgccaaagaacagtgaattgggcccaaagatcaaacacagcatttcatgtaatcagaattctaaacgcacaactcgggagctgtgcacggcttctcaagtgattcagttgcagaaccaagagcaaaactcgcctgtttttgtcctcaatggcacccatgagctttccaatagtatagttttctttctttccttgtcctggttgaaggtaacgtgttcctagaaaagaaaatgctgcataggaaaactgagatgccttttattccaacgtgtttgatccctgtcactcattattctgtactttttattgtacattctattcctgtaattattgtgccctttaagtgttgtaaaatcgttttggaatttgtgcctgctagttatgcaataaacaggctctacaagtg

SEQ ID NO: 732 - DNA, 1978 bp, Homo sapiens
atgtcgaaacggctccggagcagcgaggtgtgcgctgactgcagcgggccggatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacgcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaagaaacccaagtctgatatggtgaggacttcccttcgtttactgacgtccagtgcctaccgactgcagtcagagtgcaagaagaccctcccaggggaccccggctcacccacagacgttcagctggtcacgcagca

SEQ ID NO: 733 - DNA, 2989 bp, Homo sapiens
ggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaagttgcttggaaaagatgctaattaatgaagaggagcaactactattggtgtatttttcacagattggtgctttctaaataaaaattgaaagtaactcctaacattgaatgggtttgctactgaaaaagtaatgatcttctggtgcaaacagttgcttgtggacttaaaccttggcactggtggggaatttggtcagattttacaatctctgtcaaagagtagacagctgaactcacaccacacccagcttatagaatgtccatggaagatgaaggcgcaccagaagggaaggaccctgcgcagaatggacgtggtgaatggtgtttaaaatgccagatgccaaagagtaacacgattccctgctgaccccttaactctaatccatccagcaccatggagcagcctgcatgtgaggaatggaaggagcattcagggcctccaagtgacagtctctaaaatggggtggtgccaggcagattagcatgttcaaagctgacaccactgaggtcgtgttttttgggtgacaaagccaaaggagagaaaggccaaatattccagccctggccgaaagatgatcactcaccagacggaagcaagcgtgctgcgtggagcatccatgcgaagatgtcaattccatagatcaataggtttccagttttcttcgtgatatgttaatatagcaaacttaccatgatccggttttctcttttttctttttttttttacaaagtgctgaattgtttggaatatcaagagtattatgtaataaaaacttgttgatcataatttttcttgttggctttttggaaagcaataggcgatctgatttttcacaagctgaacttctgtctttcttgctttgcaaagcaaccctagtcatctttgtgctgcttccatggtgtctgctgtcatttttggcctttacaaattgctcagggctcatttgaaaagcaagttacctaaatgatgttttaatgatctcgaactcttgcttgaaacagccttagtaataatccagtgtacagcttgcctgcaaacatttcccagccccaccatgacaaattttaaagtggttagacattttgttttgaggaagtccaaaccacaacttttccacattcagaaatgaagctatttaatttgcttacgtgatgaagggagttgattgtgtttcacccaatccagaagaaagggtccttgtttgtattggctttttactttcagcccggctagctgttactgtccttattgtttaaaactggtagttgtattcatttacttggtgtttgctttttctgcttgctgtaaaaaaacacagtcccactgccaaacatttctttcagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatat

SEQ ID NO: 734 - DNA, 2424 bp, Homo sapiens
acctccccgcgcgtgcgtgctgtgccaaggctgcaaggcgctgaggggagaggcgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggcatccaggctggagaagcagaacagcacacctgagagtgactacgacaacactcccaacgacatggagccagatggcatggggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacagttatattccctgctcagagaggatacacgtagctgttacagaaatggcagcattattccccaaaaaacccaagtctgatatggtgaggacttcccttcgtttactgacgtccagtgcctaccgactgcagtcagagtgcaagaagaccctcccaggggaccccggctcacccacagacgttcagctggtcacgcagcaggtcatccagtgtgcgtacgacatcgccaaggctgccaagcagctggttaccatcaccaccaaagagaacaacaactgacaagggcagggcaccgcctcctctgttttctaggctttataaagtccaatttcaaattcagacgcagaactcttcagatttctacaaaaagaaacatttaatgacggtttaaaactttttaaaagaaaactcagtattatttttgcatgttttctaaccaattttcaactatttaacccacttgccttattttgtgcctatttgctggtttagtttctgatgttcggttgtgttgtcaacaactgttgagttgatcacatacatccaaaagtatagtttcattgtctaaagtttgtgaaaacttttccatcccttaaaactccctgcctatggctgaaactataaatgaaatttttcataaaa

SEQ ID NO: 735 - DNA, 1680 bp, Homo sapiens
ctacctgaaaacttttgttcctatgcataaagatgtctttggtggacttgggaaagaggttgctagaagcagcaagaaaaggccaagatgatgaagtgagaacgttgatggcaaatggcgccccattcaccacagactggcttggaacatcacccctccaccttgcagctcaatatggtcattattccacagcagaagtactccttcgagcaggtgttagcagggatgcccggactaaagtagacaggacccccttgcacatggctgcagccgatggacatgcgcacatcgtggaactgcttgttcggaatggtgcagatgtgaatgccaaggacatgctgaagatgacagctttgcattgggccacagagcgccaccatcgagatgtcgtagagttacttatcaaatatggagctgatgtccatgctttcagcaaatttgataaatcagcctttgacatagctctggagaaaaacaatgctgagattttggtcatcctccaggaagcaatgcagaatcaggtgaatgttaatccagagagagccaaccctgtgactgaccctgtgagtatggctgctccattcatcttcacgtcgggtgaggttgttaacctcgcaagccttatttcttcaaccaacaccaaaacaacctcagccaatacagaggaaattatagaaggaaattccgttgactcatcaatccagcaagtaatggggagtggaggccagagggtcatcaccatagtgactgatggagtccctctgggtaatatccaaacttcaatccctactggaggcattggccagccatttattgtaactgtgcaagatggacagcaagttctaactgtacctgctggtaaggttgcagaggagactgtaattaaagaggaagaagaagagaagttgccactaacaaagaaaccaaggataggagagaagacaaacagtgtggaggaaagcaaggaaggcaatgaaagagagctactacagcaacaactccaggaggccaatcgaagagcccaggaataccgacaccagctcctaaagaaagagcaggaagcagaacagtaccgtcttaagctggaggccatagcccgacagcagcccaatggagttgatttcaccatggttgaagaggtggctgaggtagatgctgtagtagtcacagagggggagttggaagagagagagacaaaagtgactgggtcagcagggaccacagagcctcacactagagtttccatggcaactgtttcatcttaatatgcaagggccacaatttgcactgtgttcatattaatcctcttttaaaaaaggaaatatacagaagacaaacattgtataaaaactaagagtgtctttaagaagaaaactatagcagggtacaatgcttgggctcaggaagtttctctgtgcaactagaaaattcaaagccatatttagggaacattttttctgaggggccaaaagaataaaggaccaaatttcttagctcatatcattgctttaaacatagaagtaaaagaatactgcatgttgtgggttgattttttttttttaaataactgactttctcacaaaagattttaagataacatttctaatatatatgcaccaatatatatgcctttaataattataccatcaagtgacctgaaaatgccccttagatttatga

SEQ ID NO: 736 - DNA, 3228 bp, Homo sapiens
gcacttttccacctcagaagtgcctcagcagaaaggcgatgaacctcgggggtgcatcatctttctgttagaatgggagcatgagttttctgatcattttcccttcacagattcctccgccagaaatcttactcgcggcgccttcatttccgggtccgccattttgttgcctctgtttctccacgagggggggttaaaggcccccaaaacatgcacacatgaaaagggcaaaaagtaaccgtccttgacagggagtcttaactagagaaggaaacgggactaaactggcgggctccgtggaagcgtggccggcagcgtcccggacgaggagatgtctttggtggacttgggaaagaggttgctagaagcagcaagaaaaggccaagatgatgaagtgagaacgttgatggcaaatggcgccccattcaccacagactggcttggaacatcacccctccaccttgcagctcaatatggtcattattccacagcagaagtactccttcgagcaggtgttagcagggatgcccggactaaagtagacaggacccccttgcacatggctgcagccgatggacatgcgcacatcgtggaactgcttgttcggaatggtgcagatgtgaatgccaaggacatgctgaagatgacagctttgcattgggccacagagcgccaccatcgagatgtcgtagagttacttatcaaatatggagctgatgtccatgctttcagcaaatttgataaatcagcctttgacatagctctggagaaaaacaatgctgagattttggtcatcctccaggaagcaatgcagaatcaggtgaatgttaatccagagagagccaaccctgtgactgaccctgtgagtatggctgctccattcatcttcacgtcgggtgaggttgttaacctcgcaagccttatttcttcaaccaacaccaaaacaacctcagccaatacagaggaaattatagaaggaaattccgttgactcatcaatccagcaagtaatggggagtggaggccagagggtcatcaccatagtgactgatggagtccctctgggtaatatccaaacttcaatccctactggaggcattggccagccatttattgtaactgtgcaagatggacagcaagttctaactgtacctgctggtaaggttgcagaggagactgtaattaaagaggaagaagaagagaagttgccactaacaaagaaaccaaggataggagagaagacaaacagtgtggaggaaagcaaggaaggcaatgaaagagagctactacagcaacaactccaggaggccaatcgaagagcccaggaataccgacaccagctcctaaagaaagagcaggaagcagaacagtaccgtcttaagctggaggccatagcccgacagcagcccaatggagttgatttcaccatggttgaagaggtggctgaggtagatgctgtagtagtcacagagggggagttggaagagagagagacaaaagtgactgggtcagcagggaccacagagcctcacactagagtttccatggcaactgtttcatcttaatatgcaagggccacaatttgcactgtgttcatattaatcctcttttaaaaaaggaaatatacagaagacaaacattgtataaaaactaagagtgtctttaagaagaaaactatagcagggtacaatgcttgggctcaggaagtttctctgtgcaactagaaaattcaaagccatatttagggaacattttttctgaggggccaaaagaataaaggaccaaatttcttagctcatatcattgctttaaacatagaagtaaaagaatactgcatgttgtgggttgattttttttttttaaataactgactttctcacaaaagattttaagataacatttctaatatatatgcaccaatatatatgcctttaataattataccatcaagtgacctgaaaatgccccttagatttatgatgcgtatctgttggaaaaaccaattggaagggaagttagacaagctttggggaagagaaaaggaatatagtccatttccaaaggagcaggaactcccaaccttaagttaatttcactgaagagaattttccctttttttttttttttttgagacacggtctgactctgtcacccaggctagagtacagtggtgcaatcttggctcactgcaacctccgcctccagggcgcagcctcctgagtagctgggaggacaggcatatgccaccacatcactgagaagaaatttttgattgtctgacagatacttatccattatgtgtctatagttcagatgcttgtgtaagaaactgaaataagctgcgtgtggtggctcacacctgtaatcccaacactttgggacgttgaaatgggagaattgcttgagtccaggagtttgagatgcgcctgggcaacatagaaacctgtgtctacaaaaaatttaaaaattagccaagtatggtgacaggcacctatggttccagctactcaggaggctgaggtgggaggatcgcttgtgccttggaggtcaaaactgcagtgagccatggttgcaccactgctctccaggcttgagtgacagagcaagactgtatctcaaaggaaaaaggaaactaggccaggcgtggtggctcacgcctgtaatcccaacactttgggaggccgaggcgggcggatcacgaggtcagatcaagaacatcctggctaacacggtgaaactccatctctactaaaaatacaaaaaattggccgggcgcagcggctcacgcctgtaatcccagcactttcggaggcagaggcaggcggatcacaaggtcaagagattaagatcatcctggccaacatggtgacaccccgtctctactaaaaatacaaaaattacccaggcatagtggcacacgcctgtagtcccagttacttgggaggctgaggcaggagaattgcttgaacctgggaggtggaggttgcagtgagccaagatcgtgccactgcactccagcctggcgacacagtgagactctgtctcaaaaaaacaaaacaaacaaacaaaaatacaaaaaattagccgggcgtggtggcacctgcctgtaatcccagctacttgggaggctgaggcaggagaatcgcttgaacccgggaggcggaggttgcagtgagctgagatcgcaccattacactccagcctgggcaacagagccagactctgtctc

SEQ ID NO: 737 - DNA, 8964 bp, Homo sapiens
gcacttttccacctcagaagtgcctcagcagaaaggcgatgaacctcgggggtgcatcatctttctgttagaatgggagcatgagttttctgatcattttcccttcacagattcctccgccagaaatcttactcgcggcgccttcatttccgggtccgccattttgttgcctctgtttctccacgagggggggttaaaggcccccaaaacatgcacacatgaaaagggcaaaaagtaaccgtccttgacagggagtcttaactagagaaggaaacgggactaaactggcgggctccgtggaagcgtggccggcagcgtcccggacgaggagatgtctttggtggacttgggaaagaggttgctagaagcagcaagaaaaggccaagatgatgaagtgagaacgttgatggcaaatggcgccccattcaccacagactggcttggaacatcacccctccaccttgcagctcaatatggtcattattccacagcagaagtactccttcgagcaggtgttagcagggatgcccggactaaagtagacaggacccccttgcacatggctgcagccgatggacatgcgcacatcgtggaactgcttgttcggaatggtgcagatgtgaatgccaaggacatgctgaagatgacagctttgcattgggccacagagcgccaccatcgagatgtcgtagagttacttatcaaatatggagctgatgtccatgctttcagcaaatttgataaatcagcctttgacatagctctggagaaaaacaatgctgagattttggtcatcctccaggaagcaatgcagaatcaggtgaatgttaatccagagagagccaaccctgtgactgaccctgtgagtatggctgctccattcatcttcacgtcgggtgaggttgttaacctcgcaagccttatttcttcaaccaacaccaaaacaacctcaggtgacccccatgcctcaacagtacagttttcaaattctaccacctcagtgctggctacccttgcagctcttgctgaggcatcagtccccctctccaactcacacagagccacagccaatacagaggaaattatagaaggaaattccgttgactcatcaatccagcaagtaatggggagtggaggccagagggtcatcaccatagtgactgatggagtccctctgggtaatatccaaacttcaatccctactggaggcattggccagccatttattgtaactgtgcaagatggacagcaagttctaactgtacctgctggtaaggttgcagaggagactgtaattaaagaggaagaagaagagaagttgccactaacaaagaaaccaaggataggagagaagacaaacagtgtggaggaaagcaaggaaggcaatgaaagagagctactacagcaacaactccaggaggccaatcgaagagcccaggaataccgacaccagctcctaaagaaagagcaggaagcagaacagtaccgtcttaagctggaggccatagcccgacagcagcccaatggagttgatttcaccatggttgaagaggtggctgaggtagatgctgtagtagtcacagagggggagttggaagagagagagacaaaagtgactgggtcagcagggaccacagagcctcacactagagtttccatggcaactgtttcatcttaatatgcaagggccacaatttgcactgtgttcatattaatcctcttttaaaaaaggaaatatacagaagacaaacattgtataaaaactaagagtgtctttaagaagaaaactatagcagggtacaatgcttgggctcaggaagtttctctgtgcaactagaaaattcaaagccatatttagggaacattttttctgaggggccaaaagaataaaggaccaaatttcttagctcatatcattgctttaaacatagaagtaaaagaatactgcatgttgtgggttgattttttttttttaaataactgactttctcacaaaagattttaagataacatttctaatatatatgcaccaatatatatgcctttaataattataccatcaagtgacctgaaaatgccccttagatttatgatgcgtatctgttggaaaaaccaattggaagggaagttagacaagctttggggaagagaaaaggaatatagtccatttccaaaggagcaggaactcccaaccttaagttaatttcactgaagagaattttccctttttttttttttttttgagacacggtctgactctgtcacccaggctagagtacagtggtgcaatcttggctcactgcaacctccgcctccagggcgcagcctcctgagtagctgggaggacaggcatatgccaccacatcactgagaagaaatttttgattgtctgacagatacttatccattatgtgtctatagttcagatgcttgtgtaagaaactgaaataagctgcgtgtggtggctcacacctgtaatcccaacactttgggacgttgaaatgggagaattgcttgagtccaggagtttgagatgcgcctgggcaacatagaaacctgtgtctacaaaaaatttaaaaattagccaagtatggtgacaggcacctatggttccagctactcaggaggctgaggtgggaggatcgcttgtgccttggaggtcaaaactgcagtgagccatggttgcaccactgctctccaggcttgagtgacagagcaagactgtatctcaaaggaaaaaggaaactaggccaggcgtggtggctcacgcctgtaatcccaacactttgggaggccgaggcgggcggatcacgaggtcagatcaagaacatcctggctaacacggtgaaactccatctctactaaaaatacaaaaaattggccgggcgcagcggctcacgcctgtaatcccagcactttcggaggcagaggcaggcggatcacaaggtcaagagattaagatcatcctggccaacatggtgacaccccgtctctactaaaaatacaaaaattacccaggcatagtggcacacgcctgtagtcccagttacttgggaggctgaggcaggagaattgcttgaacctgggaggtggaggttgcagtgagccaagatcgtgccactgcactccagcctggcgacacagtgagactctgtctcaaaaaaacaaaacaaacaaacaaaaatacaaaaaattagccgggcgtggtggcacctgcctgtaatcccagctacttgggaggctgaggcaggagaatcgcttgaacccgggaggcggaggttgcagtgagctgagatcgcaccattacactccagcctgggcaacagagccagactctgtctcaaaaaaaaaaaaaaaggaaattgaaatagagtttttaaaaactgaactggaaagccgaggcgagcggatcacctgaggccaggagttccagaccagcctgaccaacatggagaaaccctgtctctactaaaaatacaaaattagggccagacccggcagctcatgcctgtaatcccagcactttgggaggctgaggtgggtggatcatgaggtcaggagttcaagaccagcctggccgagatggtgaaaccctactaaaaatacaaaaattcacctggcgaggtggcaggcacctggaatcccagctactcgggaggctgaggcggtagaatcacttgaacccaggtgacagaggttgcagtgatccaagatcatgccactgcactccagcctgggcgatagagtgagactctgtctcaaacaaacaaaacaaaacaaaattagctgggtgtggtggcacatgcctgtaatcccagctactcaggaggctgaggcaggagaatcgcttgaacccgggaggcggcagttgcaatgagccgagatggcaccattgcactccaacctgggcaacaagagtgaaactcaattaaaaaaaaaatagaaaagaaagaaaacttgtttatgtgggaggagtatatataaaaccaaaatccaggctgtgtttccacagtgctgggaagtggccagaaaaaggcttataggggctatgaaactctggtcttgacatataaactttgctctgactggatttcataaaattacagtgaggagggtagtctcttgtcagaaaaacttgtttccaaacatttatgtaatgtcaagctcagtctctcttttttttttttttttttttgagacggagtcttgctcttgttgcccaggctggagtgcaatggtgtgatctcaactcaccgcaacttccacctcccggtttcaagctattctcctgcctcagcctcccgagtagctgggattacaggcacgcgccaccacgcccggctaattttgtatattcagtagagacagggtttctctatgttggtcaggctggtctggaactcctggcctcaggtgatccacccgccttggcctcccaaaatgctgagattacaggcgtgagccaccccgcgcacagcctagactctaattttataaaactttgttgaattttctaagtgtcatttaggacatattgtgcttttctgtggagcttatatcttatcctcttatgtgcaacaaaaagggggtcggaggtaaatgctgatgatgttgtttagttttatttccttttgatctggcatgagtaaattgctctgtttccttaagcttgggtctgttacagagctttgtgccttatagggtgctcagtgtgtgttgacaaagggaataagaactgtcagtgccataaagaaccaaagattctggctactttgtcttcttcctttctctcccactatgcctacacttcctctgcccagacacttttggaaagtgtttaactgctgggttttctttttctttttctttttttttttgagacggagtttcactcttgttgcccaggctggagtgcaatggcgtgatcttggctcaccgcaacctctacctcctgggttcaagtgattctcctgcctcagcctcccgagtagctgggactacaggcatgcgccacaatgcctggctaattttgtatttttagtagagatggggtttctccatgttagtcgggctggtcttgaactcctgacctcaggtgatccacctgtctcgacctcccaaagtgctgggattataggcgtgagccactgcgcctgaccacctacctgctgggttttctttgtatgtcagcatggagtttttcccaaagaaagggaatatggatggagagagagaggttatgaacaggttatgttacagaggttattgcctttgaaactgggccctcatcattctagacttgcttgctttgttataaattagaagaaaccagagggagatgtgccaagtaaacattcgaatgactgtttagaatatggttttcttaattagcagtcatggggaaaacatgcatttttaatttggaaaaaacctgacagttaacatggttctgtttaccttgattagtgaagtaatttgctgcagtgttacagaggagcagaatcacttgggtctcaaaatagactgaaaatttaactccccaaaccaaatttaacaaacagaattggttattagagatttataggcaaaaatatcagtttggaaattaaccttggctactggccaccttagctaggttttctccacagatctgttttctccacagatctgagtacttaacacttcccagatgattggagaatattctgggctgttggggatgacaggaaaatgtgagggggagtagcctaggtaagggtgatgatgaaattgttctatctgctgtcaaataatcttttcctgtttgcaatgtttttattttttctgagtccctttgggaaccaggtgctaacaagaagctgttatgtgtgggatttcggagccttactttaacgatagaggaaccaagtatcattttagatatcttttatttatgttctcggtgcatatgttgactttaatccctcttcccccacacctcgcccattaaggggaaggaggttaactctgcagatgatattcaggcccaaccagctcactctctggggtggctactgactaaaggcagagaatgtccatccaacatgcccttctgactatacagtcaccacttttttgggggaattctttagcagatcttattgttctttctgcagaagctatcattcctacctccccaacccccaaaatctctaatacaggccaagtcattttttatgatgggtctctgagatagggcagtttgttagaggagaggctagggtagagagggagagaatggaggtatctgaaaataagtaagaaaaaggcattgatttttatttactcggaacggtcctcttggcatcccagataagggaaataggatttgatctccaattgtattgccatggagagaatggcaggtgaggatgctttgaagtagttagaaattaaatattgaatacattaatggcaataccatttcatgactttgcatatctttctggattagtcatggaagttggggaaatattgcttagatcttctgggttagaggattccaactgtttattggcaaggttggattattaagaatcaaatagcagacaaaaatggctgggcacggtggctcacgcctgtaatcccagcactttgagaggctgaggtgggtagatcacttgaggtgaggagttcgagaccagcctggccgacatggcaaaaccctgtctctaccaaaatacaaaaattagttgggcatgatggcatacgcctgtagtcccagctactctggaggctgaaacaggagaattgcttgaacccaaaaggtggagtttacagtgagctgagattgtgccactgcactccagcctgggcaatagagcgagactctgtctcaaaaaaaaaaaaaaaagaaggaaagaaagaaaaaacagacaaatggatcagaattggtgcttgagcaagagaaacttcgagcttaggatggttgtctactttaaaataaagctgctggccgggcacagtggctcacgcctgtaacctcagcactttgggaggccaaggcaggtggatcacgaggtcaggagattgagaccatcctggctaacacagtgaaaccctggccctactaaaaatacaaaaaattagccgggcgtggtggtgggtgcctgtagtcccagctactcgggaggctgaggcaggagaatgacgtgaacccaggaggcagagcttgcagtgagctgagatcgccccactgcaacagatcgcctgggcaacagaatgagactcggtctcaaaaaataaaataaaataaaataaaataaaataagtaaagctgctggccagacatggtggctcacgcctgtaatcccagcactttgggaggccgagatgggaggatcacttgaggccaggccagcgtggtgaaactcagtctctactaaaaatacaaaaattagccgggggtggtggcgcatcatcatactggtgagaaaaaaaaaaaaaaaaaagaggccgggcgcggtggctcacaaaaaaaaaaaaaagaaagaaaaaggaaaaaaagaaatatcagtttgagaaatgatttttttttcttttttcttttctttttttttttttaaacagagtctctctctgtcacccaggctggagcgcagtggcatgatcttggctcattgcaacctctgtctcccgggttcaagcgattcttctgcctcagcctctgaagtagctgggattacaggcacgcgctaatttttgtatttttagtacagacgggatttcaccatattggccaggctggtctcgaactcctgacctcgtgatccaccctccttggcctcccaaagtgctgggattacaggtgtgagccaccacgcccagcctctttttttttttttttttctcaccagtatgatgatgaccattttaagaaagcttgtgtggctctctcctatcattacagacctccagagctggaaaatttgatgcatttactgaactcttcctgaaagtttaatatggagtgggaatcagtttttgtcctaatttattagagaaggcttcctcttctctactccttgtgcaaacccatctctggatagctagaaaaggaacttcagaatggactatatgtgatgaccacctgtatgcactctaggctcttatctgtctctattttatgtggtgactatatctcagaagtactaccccttctgagtagtactattatttcctatgccaattttttttaagtctctgatgctgccctttttaaatttttgtcttattttttagcctctttagtattagggggtgaggtgacattcctagactctacagtagcagtttggcatgttagtgacaggaaattgtgattccctatctccccctcctcctaccttttctgcttttgtgattccattgttcctatctcattgaggctttcccaggcattcgaatttagttagtaggtcatttctaatctctgggccttgtcttttctctctccgttcccctccttccctaccacatattttttgtttattctgaggtggtttgtttctgaaagttaatctaggtcaccttctatatcctgtgctttctagttggctttagacatcttgttctagcaacaatgatggtagcagctctctccctgaccttgccccatgtgctgtccttctgtcaaggccatttgtgtgtgtactgcggcaggtgtgtgtgtggggggatgcgcccagactgttctcacaatgtcctcagtttttcaggttgtctgacagctttatgtacagcgtatttttagaaaaacttaaatatacttctttatttagggttttattctgatgagcaagtttgtgtgtatatgtgtgtatgagcatttgtatgtatatatacttatacagatctatattatatatacagtttttgtactatcatttaaaataaaaatgtttctcaataaaatgtcaaagccga

SEQ ID NO: 738 - DNA, 1412 bp, Homo sapiens
atgcacacatgaaaagggcaaaaagtaaccgtccttgacagggagtcttaactagagaaggaaacgggactaaactggcgggctccgtggaagcgtggccggcagcgtcccggacgaggagatgtctttggtggacttgggaaagaggttgctagaagcagcaagaaaaggccaagatgatgaagtgagaacgttgatggcaaatggcgccccattcaccacagactggttttccaaattgagagtctcctgtggatatataggtgataattgtaagcttggaacatcacccctccaccttgcagctcaatatggtcattattccacagcagaagtactccttcgagcaggtgttagcagggatgcccggactaaagtagacaggacccccttgcacatggctgcagccgatggacatgcgcacatcgtggaactgcttgttcggaatggtgcagatgtgaatgccaaggacatgctgaagatgacagctttgcattgggccacagagcgccaccatcgagatgtcgtagagttacttatcaaatatggagctgatgtccatgctttcagcaaatttgataaatcagcctttgacatagctctggagaaaaacaatgctgagattttggtcatcctccaggaagcaatgcagaatcaggtgaatgttaatccagagagagccaaccctgtgactgaccctgtgagtatggctgctccattcatcttcacgtcgggtgaggttgttaacctcgcaagccttatttcttcaaccaacaccaaaacaacctcaggtgacccccatgcctcaacagtacagttttcaaattctaccacctcagtgctggctacccttgcagctcttgctgaggcatcagtccccctctccaactcacacagagccacagccaatacagaggagactgtaattaaagaggaagaagaagagaagttgccactaacaaagaaaccaaggataggagagaagacaaacagtgtggaggaaagcaaggaaggcaatgaaagagagctactacagcaacaactccaggaggccaatcgaagagcccaggaataccgacaccagctcctaaagaaagagcaggaagcagaacagtaccgtcttaagctggaggccatagcccgacagcagcccaatggagttgatttcaccatggttgaagaggtggctgaggtagatgctgtagtagtcacagagggggagttggaagagagagagacaaaagtgactgggtcagcagggaccacagagcctcacactagagtttccatggcaactgtttcatcttaatatgcaagggccacaatttgcactgtgttcatattaatcctcttttaaaaaaggaaatatacagaagacaaacattgtataaaaactaagagtgtctttaaga

SEQ ID NO: 739 - DNA, 5596 bp, Homo sapiens
gggcaatttcagtgtgagactgagccgcgagactgagctgcggctccgagcgctgcgcggcggctcctcccgcccagggtcagcgccccggcgcgcgcacgcgcacccccgccgcccgagcgcgccccgcgccgcccgcgcagtcggtcggtcggtcgtctgtcctgtcgccgctgccgccgccgccacagcggccgccgcgggcgccacctgagggagtcgcctccgcgggacgccacaagacctgaccggactgcgccgcccgaggccgtcggccgccgtcagcgagggcgccgagcaacttcgttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaagcccacaggttctgttgggagcaccgtgaccacccctcccccgcttgttcggggcactcagaacattcctgctggcaagccatcactccagacctcttcagctcggatgcccggcagtgtcatacccccgcccctggtccgaggtgggcagcaggcgtcctcgaagctggggccacaggcgagctcacaggtcgtcatgcccccactcgtcaggggggctcagcaaatccacagcattaggcaacattccagcacagggccaccgcccctcctcctggccccccgggcgtcggtgcccagtgtgcagattcagggacagaggatcatccagcagggcctcatccgcgtcgccaatgttcccaacaccagcctgctcgtcaacatcccacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaaggcaggatgtcggccgccactgtgctgtcccgggagccctacatgtgtgcacagtgcaagacggacttcacgtgccgctggcgggaggagaagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagaaaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcttaggctcccagtctttgactgccttcccatggcgatctataagttgaaagattttttttttttttaatcacctcatgatgatggagttaaaagtaaaccgtgcagaccctggggtccctgttgtacgctgcatcatcccgctggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaagctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagactttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaaaatcaagagtatgcaagcatttctattcctcgcatttttctgtgtgcctggcaaataaatacctgtctcctacgaccctgagctgttagccctctctgttccatgacaggggccagatcttccagctcctcccagaaggagcacccaggctggcttcttcccactgaaagccctccccagcgaaccaacctcagttctatgcagtggctggggatcaggcatccagaccgaagtcacctctgcctgctccagcttgggtcagctgggtctgaccagggggccagatccgagccgcacctgccggcccccagccccagctccagctcctgacctctcccagcctggcctggctgttcctccagggctgatggctgtcaacccatccttgtgagttcatatggactgctgcccctcgaaagggagagggtcggccccatgtccccagggagcattccatcagggacaacgtacatactgtgatgtaaactttttttttttccccccagggggcaaaagtgtgagatgccttaatctttccttcatttctgctgtctcgaacactctagcccattatttcctttcagttccttgcagcataacctctacgataagccccaagcgggttgttgtattatgacgtttatgatgttccaggtgaaggcattattaagtacctctctgggtgtggggtttggacgcaccaggatagctattgattaatgttaagggtgttctacccacagcaaagcacaccctcttaaaccaggcactgcctgggtcctggtcccgagagccctaccaggatcaggttcctgcaagccgtcagaatgtgggagcccccagcccaactgattgtaactgtcccctgttacctgtgacatgaacctccaacagcacctggaaacggttccctctgtcagctgctctgtagacagggctggggagatctcagagttcacacctcgcctgttgtaggggaggttgggggtagggtttggaatggccaagtgcccttggaacctcccacagctatggccgtcctgacctcatcccaggaactctacggtgaccaggaaccacccctctgacgaggtctgtagcggcccttctcagagtggaacagcccacagtgctagttgtgcctggtcttacctgtactccacggacctcggtgaagcaaaagcttcagggcagagggaatgaggcaacccagtggcagccccgctgggccccgtggctcctgctctcctattggacgtagaggcaggggagagacttctctatacaaatattctcatcacagaagggatgatccttgctgctctgccgtagggtttttgatgctgagctatgctgcacatgacgttaacctaaagaacttggactgagcttttaaaaaaggacagcaaacaattttataatccttaaagtgtaatagacggttacactagtgcagggtattggggaggctctttgggtgtggaggctgtcacttgtatttattgtgactctaaatctttgatagtaaaacaaatgtaaaaagaaatgtttgccaccagatgggaatagaagttccaataagcaggctggaatgggtggctatacgttgtatcacgaggaagttttagactctgaaggataataaatggatgatgtgtcaactgg

SEQ ID NO: 740 - DNA, 5510 bp, Homo sapiens
gtgcataccaagcccatactgtttgctctacactgaaaatgaagatgaatggtgaaaaaaagtttctgccattgagagcttaacattgagttgcagtgagagatgaagctcctgagtggcacggagattgttgccagggctctggtgagttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaagcccacaggttctgttgggagcaccgtgaccacccctcccccgcttgttcggggcactcagaacattcctgctggcaagccatcactccagacctcttcagctcggatgcccggcagtgtcatacccccgcccctggtccgaggtgggcagcaggcgtcctcgaagctggggccacaggcgagctcacaggtcgtcatgcccccactcgtcaggggggctcagcaaatccacagcattaggcaacattccagcacagggccaccgcccctcctcctggccccccgggcgtcggtgcccagtgtgcagattcagggacagaggatcatccagcagggcctcatccgcgtcgccaatgttcccaacaccagcctgctcgtcaacatcccacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaaggcaggatgtcggccgccactgtgctgtcccgggagccctacatgtgtgcacagtgcaagacggacttcacgtgccgctggcgggaggagaagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggtcataaaaccccggcgtaagttggcgttccgctcaggagaggcccgcgactggagtaacggggctgtgctacaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagaaaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcttaggctcccagtctttgactgccttcccatggcgatctataagttgaaagattttttttttttttaatcacctcatgatgatggagttaaaagtaaaccgtgcagaccctggggtccctgttgtacgctgcatcatcccgctggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaagctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagactttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaaaatcaagagtatgcaagcatttctattcctcgcatttttctgtgtgcctggcaaataaatacctgtctcctacgaccctgagctgttagccctctctgttccatgacaggggccagatcttccagctcctcccagaaggagcacccaggctggcttcttcccactgaaagccctccccagcgaaccaacctcagttctatgcagtggctggggatcaggcatccagaccgaagtcacctctgcctgctccagcttgggtcagctgggtctgaccagggggccagatccgagccgcacctgccggcccccagccccagctccagctcctgacctctcccagcctggcctggctgttcctccagggctgatggctgtcaacccatccttgtgagttcatatggactgctgcccctcgaaagggagagggtcggccccatgtccccagggagcattccatcagggacaacgtacatactgtgatgtaaactttttttttttccccccagggggcaaaagtgtgagatgccttaatctttccttcatttctgctgtctcgaacactctagcccattatttcctttcagttccttgcagcataacctctacgataagccccaagcgggttgttgtattatgacgtttatgatgttccaggtgaaggcattattaagtacctctctgggtgtggggtttggacgcaccaggatagctattgattaatgttaagggtgttctacccacagcaaagcacaccctcttaaaccaggcactgcctgggtcctggtcccgagagccctaccaggatcaggttcctgcaagccgtcagaatgtgggagcccccagcccaactgattgtaactgtcccctgttacctgtgacatgaacctccaacagcacctggaaacggttccctctgtcagctgctctgtagacagggctggggagatctcagagttcacacctcgcctgttgtaggggaggttgggggtagggtttggaatggccaagtgcccttggaacctcccacagctatggccgtcctgacctcatcccaggaactctacggtgaccaggaaccacccctctgacgaggtctgtagcggcccttctcagagtggaacagcccacagtgctagttgtgcctggtcttacctgtactccacggacctcggtgaagcaaaagcttcagggcagagggaatgaggcaacccagtggcagccccgctgggccccgtggctcctgctctcctattggacgtagaggcaggggagagacttctctatacaaatattctcatcacagaagggatgatccttgctgctctgccgtagggtttttgatgctgagctatgctgcacatgacgttaacctaaagaacttggactgagcttttaaaaaaggacagcaaacaattttataatccttaaagtgtaatagacggttacactagtgcagggtattggggaggctctttgggtgtggaggctgtcacttgtatttattgtgactctaaatctttgatagtaaaacaaatgtaaaaagaaatgtttgccaccagatgggaatagaagttccaataagcaggctggaatgggtggctatacgttgtatcacgaggaagttttagactctgaaggataataaatggatgatgtgtcaa

SEQ ID NO: 741 - DNA, 5671 bp, Homo sapiens
gggcaatttcagtgtgagactgagccgcgagactgagctgcggctccgagcgctgcgcggcggctcctcccgcccagggtcagcgccccggcgcgcgcacgcgcacccccgccgcccgagcgcgccccgcgccgcccgcgcagtcggtcggtcggtcgtctgtcctgtcgccgctgccgccgccgccacagcggccgccgcgggcgccacctgagggagtcgcctccgcgggacgccacaagacctgaccggactgcgccgcccgaggccgtcggccgccgtcagcgagggcgccgagcaacttcgttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaagcccacaggttctgttgggagcaccgtgaccacccctcccccgcttgttcggggcactcagaacattcctgctggcaagccatcactccagacctcttcagctcggatgcccggcagtgtcatacccccgcccctggtccgaggtgggcagcaggcgtcctcgaagctggggccacaggcgagctcacaggtcgtcatgcccccactcgtcaggggggctcagcaaatccacagcattaggcaacattccagcacagggccaccgcccctcctcctggccccccgggcgtcggtgcccagtgtgcagattcagggacagaggatcatccagcagggcctcatccgcgtcgccaatgttcccaacaccagcctgctcgtcaacatcccacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaaggcaggatgtcggccgccactgtgctgtcccgggagccctacatgtgtgcacagtgcaagacggacttcacgtgccgctggcgggaggagaagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggtcataaaaccccggcgtaagttggcgttccgctcaggagaggcccgcgactggagtaacggggctgtgctacaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagaaaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcttaggctcccagtctttgactgccttcccatggcgatctataagttgaaagattttttttttttttaatcacctcatgatgatggagttaaaagtaaaccgtgcagaccctggggtccctgttgtacgctgcatcatcccgctggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaagctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagactttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaaaatcaagagtatgcaagcatttctattcctcgcatttttctgtgtgcctggcaaataaatacctgtctcctacgaccctgagctgttagccctctctgttccatgacaggggccagatcttccagctcctcccagaaggagcacccaggctggcttcttcccactgaaagccctccccagcgaaccaacctcagttctatgcagtggctggggatcaggcatccagaccgaagtcacctctgcctgctccagcttgggtcagctgggtctgaccagggggccagatccgagccgcacctgccggcccccagccccagctccagctcctgacctctcccagcctggcctggctgttcctccagggctgatggctgtcaacccatccttgtgagttcatatggactgctgcccctcgaaagggagagggtcggccccatgtccccagggagcattccatcagggacaacgtacatactgtgatgtaaactttttttttttccccccagggggcaaaagtgtgagatgccttaatctttccttcatttctgctgtctcgaacactctagcccattatttcctttcagttccttgcagcataacctctacgataagccccaagcgggttgttgtattatgacgtttatgatgttccaggtgaaggcattattaagtacctctctgggtgtggggtttggacgcaccaggatagctattgattaatgttaagggtgttctacccacagcaaagcacaccctcttaaaccaggcactgcctgggtcctggtcccgagagccctaccaggatcaggttcctgcaagccgtcagaatgtgggagcccccagcccaactgattgtaactgtcccctgttacctgtgacatgaacctccaacagcacctggaaacggttccctctgtcagctgctctgtagacagggctggggagatctcagagttcacacctcgcctgttgtaggggaggttgggggtagggtttggaatggccaagtgcccttggaacctcccacagctatggccgtcctgacctcatcccaggaactctacggtgaccaggaaccacccctctgacgaggtctgtagcggcccttctcagagtggaacagcccacagtgctagttgtgcctggtcttacctgtactccacggacctcggtgaagcaaaagcttcagggcagagggaatgaggcaacccagtggcagccccgctgggccccgtggctcctgctctcctattggacgtagaggcaggggagagacttctctatacaaatattctcatcacagaagggatgatccttgctgctctgccgtagggtttttgatgctgagctatgctgcacatgacgttaacctaaagaacttggactgagcttttaaaaaaggacagcaaacaattttataatccttaaagtgtaatagacggttacactagtgcagggtattggggaggctctttgggtgtggaggctgtcacttgtatttattgtgactctaaatctttgatagtaaaacaaatgtaaaaagaaatgtttgccaccagatgggaatagaagttccaataagcaggctggaatgggtggctatacgttgtatcacgaggaagttttagactctgaaggataataaatggatgatgtgtcaactgg

SEQ ID NO: 742 - DNA, 937 bp, Homo sapiens
agcgggcaatttcagtgtgagactgagccgcgagactgagctgcggctccgagcgctgcgcggcggctcctcccgcccagggtcagcgccccggcgcgcgcacgcgcacccccgccgcccgagcgcgccccgcgccgcccgcgcagtcggtcggtcggtcgtctgtcctgtcgccgctgccgccgccgccacagcggccgccgcgggcgccacctgagggagtcgcctccgcgggacgccacaagacctgaccggactgcgccgcccgaggccgtcggccgccgtcagcgagggcgccgagcaacttcggttggtcagcacattgtctcaagtagccttttgatgtcactgtggccatggccaactggtaggaccagcaccccataccccgaagccagttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaa

SEQ ID NO: 743 - DNA, 507 bp, Homo sapiens
tctgcccacgcatccagtatgtgcagcacacctgctctgtgactgacactcttgcagaagtggggccacttcagggacatggacaaggtgttgtacctgctgtcacagagcctgttatctgttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaagga

SEQ ID NO: 744 - DNA, 1762 bp, Homo sapiens
atgagggtgacacctgagccgggagcaggtccaacccaaggattgctgagggcaacagaggccacggccatggccatgggcagaggcgaagggctggtgggcgatgggcccgtggacatgcgcacctcacacagaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaagacctcttcagctcggatgcccggcagtgtcatacccccgcccctggtccgaggtgggcagcaggcgtcctcgaagctggggccacaggcgagctcacaggtcgtcatgcccccactcgtcaggggggctcagcaaatccacagcattaggcaacattccagcacagggccaccgcccctcctcctggccccccgggcgtcggtgcccagtgtgcagattcagggacagaggatcatccagcagggcctcatccgcgtcgccaatgttcccaacaccagcctgctcgtcaacatcccacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaagcaggcaggatgtcggccgccactgtgctgtcccgggagccctacatgtgtgcacagtgcaagacggacttcacgtgccgctggcgggaggagaagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagaaa

SEQ ID NO: 745 - DNA, 570 bp, Homo sapiens
agagtgcggatattctatgggttttcttcagtccctggacaggtggggtcatcctaggacccctgcaatctttaggggatttagggagaaacagtgtccaggaacatctgaggtctctgttcccgtgcattgcttggggattgaagttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaag

SEQ ID NO: 746 - DNA, 565 bp, Homo sapiens
atgtgtgtgctgcaggtacagggcagtggcacgttgatgggccaggcctcactctactcaaagtgtacctcactggcaaccaaagggttaaatgtgatccccagtccccactccccagaggtgagcagggagtgaggagacctcccttccctgaaggggagaagctggggttaactcgagtcaccacagcatagggctagtcccaggccccgaccctgctcctggaacagtgcagtcaccgccctcctggattccagacattgcaggtgctgaaaatcccaaagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagt

SEQ ID NO: 747 - DNA, 265 bp, Homo sapiens
ggcgggcgggcggaccggcgcagcgagcgccgcgggcccgggcggccccacaggcggaacgagcgcgcgcggcccggcgtccccggcccctccgccgcccggccccgcgggcgaccccggaccagcagcccccgtaacctgcgcgctgccctagggcccggccgacccgcggcccggttggtcagcacattgtctcaagtagccttttgatgtcactgtggccatggccaactggtaggaccagcaccccataccccgaagccag

SEQ ID NO: 748 - DNA, 736 bp, Homo sapiens
gggctccatgtgtgcggccgaggggcgcattatctggccggcggcgcgggcgggcgggcggaccggcgcagcgagcgccgcgggcccgggcggccccacaggcggaacgagcgcgcgcggcccggcgtccccggcccctccgccgcccggccccgcgggcgaccccggaccagcagcccccgtaacctgcgcgctgccctagggcccggccgacccgcggcccgttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtca

SEQ ID NO: 749 - DNA, 1652 bp, Homo sapiens
cgcagtcggtcggtcggtcgtctgtcctgtcgccgctgccgccgccgccacagcggccgccgcgggcgccacctgagggagtcgcctccgcgggacgccacaagacctgaccggactgcgccgcccgaggccgtcggccgccgtcagcgagggcgccgagcaacttcgaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaagcaggcaggatgtcggccgccactgtgctgtcccgggagccctacatgtgtgcacagtgcaagacggacttcacgtgccgctggcgggaggagaagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggtcataaaaccccggcgtaagttggcgttccgctcaggagaggcccgcgactggagtaacggggctgtgctacaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggaccttt

SEQ ID NO: 750 - DNA, 7478 bp, Homo sapiens
agcgtccttgtttgtgtggtgccgccgccgccggtgcagccgtcgccgccgccgctgcccccgtctgtaccgcagtgtctgctccgcccgcccgccccggtccggcccgcccccctcccctacccccgtccctagtcccgtcagcagggtctggatcccctgtgccgtcgcctcttcctttttcgacgcctccgccgccgcctgaggaggcgagctagccgggagttacaccgccaccgccaggatggatagaatgacagaagatgctcttcgcttgaatctgttgaagcggagcttggacccagcagatgagcgagatgatgtcctggcaaagcgactcaaaatggaggggcatgaggccatggaacgtctgaaaatgttggcattgctcaaaaggaaggatttggcaaatcttgaggtgccacatgagttacccaccaaacaggatggcagtggtgtcaagggctatgaagaaaaacttaacgggaatctcaggcctcatggagacaacaggactgctggaaggccaggcaaagaaaacatcaatgatgagcctgtggatatgagtgctagacggagtgagccagagcgaggaaggctaactccctcaccagacatcattgttttgtctgacaatgaggcttccagtccccgttccagttccagaatggaagaaagactcaaagcagccaacttagagatgtttaaggggaaaggcattgaggagcggcagcagcttatcaagcagctgagggatgagctacgattggaagaagcccgactggtcctgttaaagaaactgagacagagtcagctacagaaagagaatgtggtccagaagactccagttgtacagaatgcagcatctattgttcagccatctcctgcccatgtgggacagcagggcctatctaagcttccctctcggcctggggcccaaggggttgaacctcaaaatttgagaacattacagggtcacagtgtcatccgttcagctaccaataccacccttccacacatgttgatgtctcaacgtgttattgcaccaaacccagcccagctacagggtcagcggggcccgcctaagcctggccttgtacgcaccacaacacccaacatgaatcccgccatcaattatcaaccgcagtcaagttcttctgttccatgtcagcgtacaacatcctctgccatctatatgaaccttgcttctcatatccagccagggacggtgaacagagtgtcctcgccacttcctagccccagcgccatgactgatgctgccaactcacaggctgcagccaaattggctcttcgcaaacagctggaaaagacactcctggagatcccaccccctaaacctcctgctcccttacttcatttcttgcctagtgcagccaatagcgagttcatctacatggtaggcttggaagaagtcgtacagagtgtcattgacagccaaggcaaaagctgtgcctcacttctgcgggttgaaccctttgtatgtgcccagtgccgcacagatttcacccctcactggaagcaagaaaagaatggtaagattctatgtgagcagtgtatgacctccaaccagaaaaaggctctaaaagctgaacacaccaaccggctgaaaaatgcatttgtgaaagccctacagcaggaacaggaaattgaacagcgattacagcagcaggcagccctctcccccactacggctccagctgtgtccagtgtcagtaaacaagagaccatcatgagacatcatacgcttcggcaggctccacagccccagagcagcctccagcgtggcatacccacatctgcccgctccatgctttcaaactttgcacaggcaccccagttgtctgtgccaggtggcctccttggtatgccaggtgtcaacattgcatacttgaatactggcatcggaggacacaaaggccccagtttggcagaccgacagcgtgaataccttttagacatgatccctccccggtctatatcgcagtccatcagtggacagaaataacgcctgttccacttgtactgccccatccttgaatcctttatccctttcctctttcattcccccaacttctgtcgcatgcagtgcctgtactggtgcctaccatacacggaaagcaaaacagaaaaacagaagacaaaaaatagagatcagcaagaaaacacacgccctgccctgccacctcccctttatttcacactgctgcgatctgttcttctgccgctctgtcttctctcttcagttttctttaacagtgaggtggatctttacctctgatagaggtcagaatgaggtcctggggagaatctaagccctccgatgtgtgtttctaaagttgttttatgctataattattaccatttttaatgatgttgtgtgtcctccctttgttcagtggacggttaaaccttcccccactcaaccaatctttttctttttccttttcttccttttttttttttttttttgtaaacacaaatgacattcagttcaatgatacgagcattgcagattgcagtaggggtcccagctgccaagtaggacatgactaggagtgttaggggcagaagttttgaatgcacttaaccggaggagggcgcagggtggggggtatcaaagaaggacgaatagcaccctacctgtgggtgtttgggggctggacaatttgggtggcagtgtttggtactgaagttgggctctaagaatgaggggaaagagcctggggaggagcttaaaactcaaccactctggaatttacccatagaagacgggaagaaagaggtatgaagatgggctcaattatgagccagggaggattgaaactaggtcctgcctttctgtatcttggggaaataagaccgatctcctgaccccattgggaacacggaagtctattccaggccaaccagcccaaaattatttcatcttgtattctttgtaaaattctccctcaccccaccctgcttttaaaaattctaatctatcccctctaaccatagccccatctataatacagaggaacggctgttccaaggctgtttgctgggtgtcccacaagttgggtggacataaatgagtcaagtgacaacaggaggaaatagacttagacgaaagaaaggatttctcttccaacagttgagattcgcatatttgcctattctttcaccctctgagtgccaggagatgagaggctgggggtacacaatcaggttggagtcctgtccttactctgctgcaccagctgcagaaccaactgctcaaagccaaacagctcatggcaaaaccagcttaggacctctgctgtacaaatagttgcttcccactgccccccgcccgcccccagaatgatattaattttgccttttttttttttttttttttaagcgctactaatgtagagaatgaattgaattgtgcaatgttgctgttctggggactggggagattagcatcccatttgcccacactgtgggaagacggagtggaccaggctgtttttgaagtaagggaagccccttaaaggtacgggtttctgctcttctcatagtgtacacccacctgcctctctggctccagaagctgccagagtgcactggggggaatgttctcagcagagaagaatgaggagaagtttaatattttgcccttgaaagtcacctgaggaagtttccccacttttattttttaaaattaagtaattttttaaagaaggcacttttaaaattaacacacacatgaactgcacaccttccccataaaatttggaggtggggtgggagaaagagctaaaatcaggctcagttcccctactctggcctctactccccacaccccagtgccactgtgggtgactatactggccctacgggccttcctggcttttttctttcctcccttaccccaaattcattgagcacttaaaggagcagagatgcagccagtgtctgggctcccccagtggtgaaatgatctggaagctagatgctagtaacaggtagtgattgggttttttgagtatttttccggggaatgtggtacccctgactgtaagtggtgggagagggaggggggttaatggaactgggtctgggattattttaaaattatatatatatatataaagatatattcttacatcttttctttgccctctgtgctttgaaagcactggataaattgtttggttttgcttttctctcttccacaaaattggaagctttttttaaaaatgttttccccacaagtcatcttgccttgtggcatgtctgtctagcctcttcctccctccctcatgatgaagtgccatttctgttacgtctccctctccccaagctcagaggtgctcagaggtacgagatgcccaagtttgtcagttgagattaaaagtaaggaacagagaatgtgcaataccgtctggctgggggctgtccctgccctgccctgagctgagtcctttccctgggagccaggccaccttagaatggggtttggaagtaagatgtatagagttggggaatcatggagaaggaaagcctatagtcgagtgcctgcttaggtgctgaggtcacaggggagatggtggaatcttccctgtttttatcccctcagggtcagttacatagaagctgcttcttgactagtatagctcggtgaccctttgttcaaccgctgaggtttgatttcttaccctttcttctccccattttcatactcttcccagggattagtgatggaggtgaggtctccctaatcatggtaaagtgttaaccttccacctcctcccttccctcctccttcctcatccttctgtcttcctcaattctccgtctcttttttttcatcactgattgccttgtgtccctccaagtctacttgttactatccatctccaggctctgggccgtgtagacactaaacctcatgccctaaggacaggaggaaagaccctctgtttggagcattattagtagagtgaggatcccaccagttctgcctggcttcctccatccccagaggcactaaaagcagtattttaaggttggtgtcttactccctggaagcctgaaatgggtggaatagcggtaaggcttgagtaaaactaggggacagaggttcttatttgtcgattttattttataatttgaccacagcatctgaactccctctctccctggaataagtatttttcccacatttttggatatatgtatggtagacaatttttttttaagacacagagataaatgttttcctgctttggttacctttcctttcccctttaaaaggaattagctatagaactgctttgtaaagatgcttcttgatattttacttttgttccttttccctaatcattcccttttctccccactcctccagaaggcataacccttctctccacaccccctacccccacccccgtcctaggctcccatcctttccatcaagaccttcattagcttatgatatttgctgccgagatgttataacaaggactcgttcatgtatataagctatttcttgatccatttaaaaggaattgtacattgtgtagaaaaaaaaaaaaacctgaaaaagagaaaaaaaagccctagccatggatattgtgaaactgtgttatgtcattttgtaatgtgcccgtttgtgtatgatccgtgcaaaagggtttctggggaaggggagggggtagggaggcagggctgtggagggtgggtaggggagtgggccgggcccagcacactgagactggcagctgctccaaccccatccctccttagagatgccacctcccccaccacccacccctaatttgtgccttgcctccccaccctggagtagtccctccgggtcaccagcactgccttggcagagcccactccctaccctaacctgcccaccctccctatcccccagcattaggttgatactgtggggaagtgctgggggctgggaggtagccgaggaatggggcagttcccgggggcatcgaaaccaagtattattatgaattgtaattgtatttgcactgtttttttcctctgattgcatcagcatatatacaatatacctatataacaaaattcagtgtcaagctttcttatgcaagggatttcccccaccccacctcctcaaaaaagaaagaacctagtcttatgggcctttgagggtggattgtcaggggatgatagaaaggattttaataagtcatcctgaggaaatttcacctagtgagagccacatccatctgcacagccttaggctgcgtgaaccgaggtgaggctgagctcctgtgaaagccaagacctcctggtccaggactttgtagagtaaaaagaaccaccaacacaaaaggggttgagggggctacaatctggagacctggggtctcctactaacttgctatatgatctttggtagagttaattttctgagtatcaattttcttatctgtgaagtgaagagggggatcatctggccaccaagtttaaaattctatacttctcacctgccaaaaccaaaaaacaacttgaggtgaggaaagtgttgggcccagaaaccagggaggaactgaaagtgactcgcgttgaagtggttatgtgtatgacaatgctcttggagaactgccagtcctctatggttacccttgatttgggagaggcagcagagtcatgtccagggcatcagaccagtgacatctttgcctttatgcctctagtcatctgagggcggggactaggcctcaagccccatctcacagccaaccacagagcccttaagggtggttgacaattgaatgccccaggttggtgctttagttatttactccctttgtgagctacaggatgtgtaacttttcccccatcttggtgataaaataggagagcgcagacacagcccacattttgtctcctttcctcagatttcatctgaaccccgctaaaggcagctgtttcacagtctgtctccttcaggggcccaatttccccacagcctgggctgagtactcctactctcttctttaggttctgggctgataaagcctggagagggtacagggtgatgggtgaagccctggtgaaggtgaaaggatagattggggttggggggtggggagcagggaggtgggatggggaatggccttccctgaatagggtgggtgggaggggaacaagacccttttgcacaactctctttaagtttcctttatttcttttttaactcattctgattttctgcattgtgtttgggaaataaaatgaaaaaactaagaccaatagaaactggttttcaaaaaggcaaatacactcccatctgtttcagatgctgctgagcatttcagcagtgacagattcaaataataagctaatttttggagaaaggattaaaagaaaaaaaaactttgtaatatttatcacttgcaagctatgtttaataaagaaaggaatggtttctaaaa

SEQ ID NO: 751 - DNA, 3599 bp, Homo sapiens
cgggcagccattttgggaagagctttgttatggttgtggactagccgcctctgccgggtcgacaagctggggacgcgtcctcagacgcagcgtctagtccctggccatagctccgccgctgcccgagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaacaaagacaagatttatgtccctagattttgaaggttaaggcaaatataaatacatatctgcacactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccccttccccttttcccctttccccttttggaaacgtgtcaggaaccaaatagtttaagatgagcagttgaggggactgagagagtgatcgacacagaacctggcttcttcgtgcttcatcataagtcgtgctgccggccaggttacttaagcacccttttaacaaggaaaccttgtgggagatccagctggccgactcgagttcagaaacaggaccacagaggttacactctgggatcctggccatgaggttggatgcctcaccttactgaaaggagacactggacctaaatggcgcagcatgattttgttcctgcttggctaaatttctcaacaccacagtcagctaagtcacctactgccaccttcgaaaaacacggagagcacctacccagaggagaaggtagatttggagtaagccgccgtcgacataattcctctgatggtttttttaacaatggtcccctacgaactgcaggagattcttggcaccagccctccctgttccgccatgattctgtggactctggtgtctctaagggagcatatgctggaatcacagggaacccatctggttggcatagctcttcccgaggtcatgatggcatgagccaacgtagtggaggtggcacagggaaccatcgccattggaatggcagcttccactcccggaaagggtgtgcttttcaggaaaagccacctatggagattagggaagaaaagaaagaagacaaggtggaaaagttgcagtttgaagaggaggactttccttccttgaatccagaagctggcaaacagcatcagccatgcagacctattgggacaccttctggagtatgggaaaacccgcctagtgccaagcaaccctccaagatgctagttatcaaaaaagtttccaaagaggatcctgctgctgccttctctgctgcattcacctcaccaggatctcaccatgcaaatgggaacaaattgtcatccgtggttccaagtgtctataagaacctggttcctaagcctgtaccacctccttccaagcctaatgcatggaaagctaacaggatggagcacaagtcaggatccctttcctctagccgggagtctgcttttaccagtccaatctctgttaccaaaccagtggtactggctagtggtgcagctctgagttctcccaaagagagtccctccagcaccacccctccaattgagatcagctcctctcgtctgaccaagttgacccgccgaaccaccgacaggaagagtgagttcctgaaaactctgaaggatgaccggaatggagacttctcagagaatagagactgtgacaagctggaagatttggaggacaacagcacacctgaaccaaaggaaaatggggaggaaggctgtcatcaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcacacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttggattgtcttgtgtaagaagtatattttctttaaaattagatgagtggattcttttttaggggaaatatttttagaagttggggggaaatgtgaattcagacacaactgtttctctattttagcagatacttttttgatgcagaaaaacctgtgcaataaattaccagtaataaagtcagaaaccaa

SEQ ID NO: 752 - DNA, 3736 bp, Homo sapiens
gtgtgtaaggcggggtcggacgggggatgggagggccgtgctgctggtcgctcctcctcctccacccgctctgcccctcctggaccttgtgggccgggcagccattttgggaagagctttgttatggttgtggactagccgcctctgccgggtcgacaagctggggacgcgtcctcagacgcagcgtctagtccctggccatagctccgccgctgcccgttggtgtctcacctttaactctccttatgctgggtgaaaacaaagagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaacaaagacaagatttatgtccctagattttgaaggttaaggcaaatataaatacatatctgcacactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccccttccccttttcccctttccccttttggaaacgtgtcaggaaccaaatagtttaagatgagcagttgaggggactgagagagtgatcgacacagaacctggcttcttcgtgcttcatcataagtcgtgctgccggccaggttacttaagcacccttttaacaaggaaaccttgtgggagatccagctggccgactcgagttcagaaacaggaccacagaggttacactctgggatcctggccatgaggttggatgcctcaccttactgaaaggagacactggacctaaatggcgcagcatgattttgttcctgcttggctaaatttctcaacaccacagtcagctaagtcacctactgccaccttcgaaaaacacggagagcacctacccagaggagaaggtagatttggagtaagccgccgtcgacataattcctctgatggtttttttaacaatggtcccctacgaactgcaggagattcttggcaccagccctccctgttccgccatgattctgtggactctggtgtctctaagggagcatatgctggaatcacagggaacccatctggttggcatagctcttcccgaggtcatgatggcatgagccaacgtagtggaggtggcacagggaaccatcgccattggaatggcagcttccactcccggaaagggtgtgcttttcaggaaaagccacctatggagattagggaagaaaagaaagaagacaaggtggaaaagttgcagtttgaagaggaggactttccttccttgaatccagaagctggcaaacagcatcagccatgcagacctattgggacaccttctggagtatgggaaaacccgcctagtgccaagcaaccctccaagatgctagttatcaaaaaagtttccaaagaggatcctgctgctgccttctctgctgcattcacctcaccaggatctcaccatgcaaatgggaacaaattgtcatccgtggttccaagtgtctataagaacctggttcctaagcctgtaccacctccttccaagcctaatgcatggaaagctaacaggatggagcacaagtcaggatccctttcctctagccgggagtctgcttttaccagtccaatctctgttaccaaaccagtggtactggctagtggtgcagctctgagttctcccaaagagagtccctccagcaccacccctccaattgagatcagctcctctcgtctgaccaagttgacccgccgaaccaccgacaggaagagtgagttcctgaaaactctgaaggatgaccggaatggagacttctcagagaatagagactgtgacaagctggaagatttggaggacaacagcacacctgaaccaaaggaaaatggggaggaaggctgtcatcaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcacacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttggattgtcttgtgtaagaagtatattttctttaaaattagatgagtggattcttttttaggggaaatatttttagaagttggggggaaatgtgaattcagacacaactgtttctctattttagcagatacttttttgatgcagaaaaacctgtgcaataaattaccagtaataaagtcagaaacc

SEQ ID NO: 753 - DNA, 2564 bp, Homo sapiens
atgttccgaaaggcccggcgggtgaacgtgcgcaagcggaacgactccgaagaggaagagcgggaacgcgatgaggagcaggagccgccgccgttgttgccgccgccgggcacgggcgaagaggcgggccccggtggcggcgacagggcccctggcggggagtcgctgctgggcccggggccgtcgccgccttccgcgctgaccccgggcctcggggctgaggccgggggcggcttccccggcggcgcggagcccggcaacgggctgaagccgcgcaagaggcctcgcgagaacaaagaggtgccccgggccagcctgctcagcttccaggacgaggaggaagaaaatgaagaagttttcaaagtgaagaaatcaagttatagcaaaaagatagtaaaattgctcaagaaggaatataaagaagatcttgaaaaatcgaagattaagacagaactcaactcatcagctgaaagtgaacaacctttggacaaaacaggacatgttaaggatacaaatcaagaagatggagttatcatcagtgaacatggtgaagatgaaatggatatggaaagtgaaaaagaggaagaaaagccaaagactggtggagctttttcaaatgctttatcttcattgaatgttcttcgtccaggagaaattccagatgcagcttttatacatgctgcaaggaaaaagcgccaaatggcccgagaattgggagatttcactcctcatgataatgagcctggtaaaggccgccttgttagagaagatgagaatgatgccagtgatgatgaagatgacgatgagaaacgccggatagttttttctgtgaaagaaaagtcacaaagacaaaaaattgctgaggaaataggaattgaggggagtgatgatgatgctttagtaactggagaacaggatgaagagctcagccgatgggaacaggagcagataaggaaaggaattaatatccctcaggttcaagccagtcaacccgcagaagtgaatatgtactaccagaacacttaccagacaatgccttacggctcatcctatggcattccttatagttatacggcctatggatcatcagatgccaaatctcaaaaaacagataatacagtccctttcaaaactcccagtaatgagatgactcccgttactattgatttggtaaagaaacagcttaaagacaggttggactccatgaaagaattgcacaaaacaaatcgacagcagcatgagaaacatctgcaaagccgagtggactctaccagggctattgaaagattagaagggtcttctgggggtattggtgaacggtataaatttttgcaagaaatgcgagggtatgtccaagacttgcttgagtgtttcagtgaaaaggtgccactgattaatgaacttgaatcagcaatacatcagctgtacaaacagcgagcttcccgccttgtccaaagacgacaagatgatattaaagatgaatcttcggagttttcaagccattcaaacaaagctctgatggcaccaaatcttgactcctttggacgcgatcgggcactgtatcaagagcatgcaaaacgtcgcattgcagagcgggaggccaggaggactcgtcgtagacaagccagagaacaaaccggtaagatggcagatcaccttgaaggcctttccagtgatgatgaagaaacttctacagatattactaatttcaatctggaaaaagatcgaatttcaaaagaatccggcaaagtttttgaagatgtccttgaaagtttctattcaattgactgtattaaatcacagtttgaagcatggcgttcaaaatactacacatcctacaaagatgcttacattggcctttgtttgccaaaattattcaaccccctcatacgacttcagctcctcacttggactcctcttgaggcaaaatgtcgtgactttgagaatatgctgtggtttgaatctttgctgttttatggttgtgaagaacgagagcaagaaaaagatgatgtagatgttgccctactacctaccattgtggaaaaggtgattcttcctaaactaacagtgatagctgaaaatatgtgggaccctttttctacaacacagacttcaagaatggtgggaattacactaaaattaatcaatggatatccttcagtagtgaatgcagaaaataaaaatacacaggtatacctaaaggcacttttattgagaatgagaagaactttagatgatgatgtatttatgcccttatatcccaaaaatgtcttagaaaataaaaattctgggccttacttgttttttcaacgacagttttggtcttcagttaaggtcataaaacccccattccagagagggtcctgccccatacccagaaggaaagaatgctgctcagagaggccaagaagaatctggacggacaggccttgtgttgtcttctcttgagcagtagatcatacctttttgtccagtcatgtttctgcatgcctgtacatatttcgttaaacctaaacatagtagacaatttctcctccatctttgggtcttcattctgaaggctg

SEQ ID NO: 754 - DNA, 3995 bp, Homo sapiens
ctctctctctttctccaagtattgagagcgcgtgggagcataggcgcatgcgcgctcgtggggtgcgcggtagcaacagaggactcgacccggctggagctccggagagcgcgcgtgcgccgtcacgagctcggcgctgccggggccgcggtgtggaagcgagtattcgaccgccgtgcgggccgcggggatgttccgaaaggcccggcgggtgaacgtgcgcaagcggaacgactccgaagaggaagagcgggaacgcgatgaggagcaggagccgccgccgttgttgccgccgccgggcacgggcgaagaggcgggccccggtggcggcgacagggcccctggcggggagtcgctgctgggcccggggccgtcgccgccttccgcgctgaccccgggcctcggggctgaggccgggggcggcttccccggcggcgcggagcccggcaacgggctgaagccgcgcaagaggcctcgcgagaacaaagaggtgccccgggccagcctgctcagcttccaggacgaggaggaagaaaatgaagaagttttcaaagtgaagaaatcaagttatagcaaaaagatagtaaaattgctcaagaaggaatataaagaagatcttgaaaaatcgaagattaagacagaactcaactcatcagctgaaagtgaacaacctttggacaaaacaggacatgttaaggatacaaatcaagaagatggagttatcatcagtgaacatggtgaagatgaaatggatatggaaagtgaaaaagaggaagaaaagccaaagactggtggagctttttcaaatgctttatcttcattgaatgttcttcgtccaggagaaattccagatgcagcttttatacatgctgcaaggaaaaagcgccaaatggcccgagaattgggagatttcactcctcatgataatgagcctggtaaaggccgccttgttagagaagatgagaatgatgccagtgatgatgaagatgacgatgagaaacgccggatagttttttctgtgaaagaaaagtcacaaagacaaaaaattgctgaggaaataggaattgaggggagtgatgatgatgctttagtaactggagaacaggatgaagagctcagccgatgggaacaggagcagataaggaaaggaattaatatccctcaggttcaagccagtcaacccgcagaagtgaatatgtactaccagaacacttaccagacaatgccttacggctcatcctatggcattccttatagttatacggcctatggatcatcagatgccaaatctcaaaaaacagataatacagtccctttcaaaactcccagtaatgagatgactcccgttactattgatttggtaaagaaacagcttaaagacaggttggactccatgaaagaattgcacaaaacaaatcgacagcagcatgagaaacatctgcaaagccgagtggactctaccagggctattgaaagattagaagggtcttctgggggtattggtgaacggtataaatttttgcaagaaatgcgagggtatgtccaagacttgcttgagtgtttcagtgaaaaggtgccactgattaatgaacttgaatcagcaatacatcagctgtacaaacagcgagcttcccgccttgtccaaagacgacaagatgatattaaagatgaatcttcggagttttcaagccattcaaacaaagctctgatggcaccaaatcttgactcctttggacgcgatcgggcactgtatcaagagcatgcaaaacgtcgcattgcagagcgggaggccaggaggactcgtcgtagacaagccagagaacaaaccggtaagatggcagatcaccttgaaggcctttccagtgatgatgaagaaacttctacagatattactaatttcaatctggaaaaagatcgaatttcaaaagaatccggcaaagtttttgaagatgtccttgaaagtttctattcaattgactgtattaaatcacagtttgaagcatggcgttcaaaatactacacatcctacaaagatgcttacattggcctttgtttgccaaaattattcaaccccctcatacgacttcagctcctcacttggactcctcttgaggcaaaatgtcgtgactttgagaatatgctgtggtttgaatctttgctgttttatggttgtgaagaacgagagcaagaaaaagatgatgtagatgttgccctactacctaccattgtggaaaaggtgattcttcctaaactaacagtgatagctgaaaatatgtgggaccctttttctacaacacagacttcaagaatggtgggaattacactaaaattaatcaatggatatccttcagtagtgaatgcagaaaataaaaatacacaggtatacctaaaggcacttttattgagaatgagaagaactttagatgatgatgtatttatgcccttatatcccaaaaatgtcttagaaaataaaaattctgggccttacttgttttttcaacgacagttttggtcttcagttaagctgttaggcaattttcttcagtggtatggcattttctcaaataaaactctgcaagagttatcaatagatggtttattaaatcgatatattctcatggcttttcagaattcagaatatggagatgacagcatcaaaaaagcccaaaatgtaatcaattgtttccccaaacaatggttcatgaatctgaaaggagaaaggactatttctcagttagaaaacttttgccgataccttgtacacttagcggatacaatttatagaaatagtatcgggtgttctgatgtggaaaaaagaaatgcaagggaaaacataaaacagatagtaaaactccttgcaagtgttcgagctttggatcatgctatgtctgttgcaagtgaccacaatgtgaaagaatttaagtctttgatcgaaggaaaatagatctatgagactgaaaaacctatttgcttgattaccattcccaatgtgtaaattttgtatatatgtaaagtttcttaaactgtaaaatagcaattcttgttttaatacaaaaaacattatattcaatactgtgtccttaaatgatatttcttcagaatgaaaggaattcagattatttctaggagtctatgaatgttttctttactgcctgtcatactttgtttactgaagtattttgtatggtcatttaaattaaccctctcagttaattgtcccctgtaaacgatgtgtgcagtgtaaattgtgtaattatgcatatatatatttataccaccatggacttactttcacactggaaatttgtggtgtttttccacagaggaagccttttaacagcagaaaattatccggtagcaaattgtcttagggaaattactacactgttgtaacaaaagggctggcaagtgactaaatgttcattaccttttggttagcgttgctatcactgtagctgtgctgccttaacattgagagttgagttgtggacttagtcattgagtgaatgttgaactttcttccttgaatcagcgttagagtcaaatgtgggtttaatgtgaatgctaaatgaatatgcaacatagtttcaaatggaacatagaaatttcacttttgaaaataataaacccacaacctaattgcatggttttgggctgaccgtcctgtctcattcatgattttactccctgcccagcttgcagatacatgcatttgaattttagtagtctgtcatatttaaaatcccacatatgtgagttaaatatgcaataaagaatacgccttgctgattagccacacccaggcaatttaatatccatggtcttctataatgtttataccacattgtaaatattcagagaacttgttttaaagtttatgctttctgattctgtgattttcaaaagaggaatttttttggaaattaaggactatcgtttgataattatatatgtaattaagatttagccaagcattaaattaatttttaaatata

SEQ ID NO: 755 - DNA, 4440 bp, Homo sapiens
gagcagaaggcaggcgggacgggcgcgcgcactcggcggccaggcgcggcgggagcgcgccctagggggcgggcactgaagctgcggcttgcggttcagcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgccccaccgggttcggggccctcgtggccggggccgggtctgggcgagctcccggcgtgccaccaaagcggctccccgcgcggacgaaggctcagaatccagaacccttgatgtgtccacagatgaagaggataaaatacatcactcctcagaaagtaaggatgatcagggtttgtcttctgacagttctagctctcttggagaaaaagaactttcatcaacagttaagatcccagatgcagcttttattcaggcagcccgcagaaaacgtgaattggccagggcccaagatgactatatttctttggatgtacaacatacctcctccatctctggtatgaagagagagagcgaagatgaccctgagagtgagcctgatgaccatgaaaagagaataccatttactctaagacctcaaacacttagacaaaggatggctgaggaatcaataagcagaaatgaagaaacaagtgaagaaagtcaggaagatgaaaagcaagatacttgggaacaacagcaaatgaggaaagcagttaaaatcatagaggaaagagacatagatctttcctgtggcaatggatcttcaaaagtgaagaaatttgatacttccatttcatttccgccagtaaatttagaaattataaagaagcaattaaatactagattaacattactacaggaaactcaccgctcacacctgagggagtatgaaaaatacgtacaagatgtcaaaagctcaaagagtaccatccagaacctagagagttcatcaaatcaagctctaaattgtaaattctataaaagcatgaaaatttatgtggaaaatttaattgactgccttaatgaaaagattatcaacatccaagaaatagaatcatccatgcatgcactccttttaaaacaagctatgacctttatgaaacgcaggcaagatgaattaaaacatgaatcaacgtatttacaacagttatcacgcaaagatgagacatccacaagtggaaacttctcagtagatgaaaaaactcagtggattttagaagagattgaatctcgaaggacaaaaagaagacaagcaagggtgctttctgggaattgtaaccatcaggaaggaacatctagtgatgatgaactgccttcagcagagatgattgacttccaaaaaagccaaggtgacattttacagaaacagaagaaagtttttgaagaagtgcaagatgatttttgtaacatccagaatattttgttgaaatttcagcaatggcgagaaaagtttcctgactcctattatgaagctttcattagtttatgcataccaaagcttttaaatcccctaatacgagttcagttgattgattggaatcctcttaagttggaatccacaggtttaaaagagatgccatggttcaaatctgtagaagaatttatggatagcagtgtggaagattcaaagaaggaaagtagttcagataaaaaagtcttgtctgcaatcatcaacaaaacaattattccccgacttacagactttgtagaattcctttgggatcctttgtcaacctcacagacaacaagtttaataacacattgcagagtgattcttgaagaacattccacttgtgaaaatgaagttagtaaaagcagacaggatttacttaaatccattgtttcaagaatgaaaaaggcagtagaagatgatgtttttattcctctgtatccaaagagtgctgtagaaaacaaaacatcacctcattcaaagttccaagaaagacagttctggtcaggcctaaagctcttccgcaatattcttctttggaatggactccttacagatgacaccttgcaagaactaggactagggaagctgctaaatcgttaccttattatagcacttctcaatgccacacctgggccagatgtggttaaaaagtgcaaccaggtagcagcatgtctaccagaaaaatggtttgaaaattctgccatgaggacatctattccacagctagaaaacttcattcagtttttattgcagtctgcacataaattatctagaagtgaattcagggatgaagtcgaagaaataattcttattttggtgaaaataaaagctttgaatcaagcagaatccttcataggagagcatcacctagaccatcttaaatcactaattaaagaagattgaataaactttattggaaaatgctaaaattttaatatagttacactcagttcctttgtttgagaagaagctggtgcctctctcttctttattccctgtaatagaaggtaggatttgaaaaaaagcaggactccacctctgtattcccccgtgctttaccttctggcatcatgaaaagctgccatgattctgtggtgttctaaggaattaaatgcactggagctttaagagctcaacgtgtttccctttgattcttttggctggtctttcaattttcttaagaggggaactggagaaaccttgctaaaggttttagcttaagtgagcatgctactaagtcttctgtcctgaaccacaataatatcttttagttctctttaactacctttatttaaaaataagtcaatatgaaaatctcagttggagtgaattatttgctaagtattaaatgattaaggcatgtgccgattgtcaaattatccttcagaaatctgtaccaatttaatgtaccaacataagcataagtgagtgccaatgaatccctaccagcagtagttattatcctttttaaaaatgcattgaaaatttgaaaggtaaaaatcttattttaatagcgtattttgtgttggctattagagagtaaacatattggttttggccatttgtaattatttctgaaatatccatctttttcttatggactttaagacctttatatttttaaagatattgattttttgcccatgcttgtggcagaagttttccttatttgccatttttcttttattttttttttaattgtattttttgagacagggtctggctctgtcacccaggctggagagtagtggcacaatctcggctcactgcaacctctgccttctgggctcaagcaatcctcccacttcaacctcccaagtagctgggactataggcatgcgccaccatgcccagctgatttttgtaattttttgtagagatggggtttcgtgacattgcccaggctggtctcgaactcttgagctcaagcagtctacccaccttgacctcccaaagtgctgggattacaggcttgagcaaccatgtttggcctttcttttaaatttgttgatgttttttgaagcattaagtcattacttattagcaagttactattttgtttttttgtcattggtggtaggactaagaaggaaacagatattttaaatactcacaacatgtgattcattttctgataaaatatttgtctaataaaacagaggcaagataatttaatcaaaagaaattaagaaaattttccaaaaatgttagtttactagtaatttttctaagtctacttattaaataacttaagggaaactgtaaatatattttgcaaattgttgttcaaaagataattggaaaaaattgaatatattgtaggatttgaatatacagcctacttttatgtcacctctaccttcaaaactacatataatttattttaggagttggatttgttatgtctgttgcagtgaggacttgtgattcactggtatgaagaattttttgatgtttatattagtaacaaaattatacaaggatagaatctcatctagaaaatgcaaactattgttgaaaagcagttagcatttccacacaaccgctgtccccagagataactgctgttttcattttaatgttatccttttagaccttttctctatttacaaaaatgttacgtgtttctatgtgtacatagttttgggttttttttttttttttacgtaagtggcagacactttattgcacatgaaatttgtaatttttttctatttaagtacacatttggaaattatcctctgacttttggatttttaactaaatatgttggacgtgttcctttatatatttaagttcagcacagaaactttcctacctttttgtggaagataaaatattaaaactgctttcaaaactacaa

SEQ ID NO: 756 - DNA, 2516 bp, Homo sapiens
agcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgccccaccgggttcggggccctcgtggccggggccgggtctgggcgagctcccggcgtgccaccaaagcggctccccgcgcggacgaaggctcagaatccagaacccttgatgtgtccacagatgaagaggataaaatacatcactcctcagaaagtaaggatgatcagggtttgtcttctgacagttctagctctcttggagaaaaagaactttcatcaacagttaagatcccagatgcagcttttattcaggcagcccgcagaaaacgtgaattggccagggcccaagatgactatatttctttggatgtacaacatacctcctccatctctgtaagcagaaatgaagaaacaagtgaagaaagtcaggaagatgaaaagcaagatacttgggaacaacagcaaatgaggaaagcagttaaaatcatagaggaaagagacatagatctttcctgtggcaatggatcttcaaaagtgaagaaatttgatacttccatttcatttccgccagtaaatttagaaattataaagaagcaattaaatactagattaacattactacaggaaactcaccgctcacacctgagggagtatgaaaaatacgtacaagatgtcaaaagctcaaagagtaccatccagaacctagagagttcatcaaatcaagctctaaattgtaaattctataaaagcatgaaaatttatgtggaaaatttaattgactgccttaatgaaaagattatcaacatccaagaaatagaatcatccatgcatgcactccttttaaaacaagctatgacctttatgaaacgcaggcaagatgaattaaaacatgaatcaacgtatttacaacagttatcacgcaaagatgagacatccacaagtggaaacttctcagtagatgaaaaaactcagtggattttagaagagattgaatctcgaaggacaaaaagaagacaagcaagggtgctttctgggaattgtaaccatcaggaaggaacatctagtgatgatgaactgccttcagcagagatgattgacttccaaaaaagccaaggtgacattttacagaaacagaagaaagtttttgaagaagtgcaagatgatttttgtaacatccagaatattttgttgaaatttcagcaatggcgagaaaagtttcctgactcctattatgaagctttcattagtttatgcataccaaagcttttaaatcccctaatacgagttcagttgattgattggaatcctcttaagttggaatccacaggtttaaaagagatgccatggttcaaatctgtagaagaatttatggatagcagtgtggaagattcaaagaaggaaagtagttcagataaaaaagtcttgtctgcaatcatcaacaaaacaattattccccgacttacagactttgtagaattcctttgggatcctttgtcaacctcacagacaacaagtttaataacacattgcagagtgattcttgaagaacattccacttgtgaaaatgaagttagtaaaagcagacaggatttacttaaatccattgtttcaagaatgaaaaaggcagtagaagatgatgtttttattcctctgtatccaaagagtgctgtagaaaacaaaacatcacctcattcaaagttccaagaaagacagttctggtcaggcctaaagctcttccgcaatattcttctttggaatggactccttacagatgacaccttgcaagaactaggactagggaagctgctaaatcgttaccttattatagcacttctcaatgccacacctgggccagatgtggttaaaaagtgcaaccaggtagcagcatgtctaccagaaaaatggtttgaaaattctgccatgaggacatctattccacagctagaaaacttcattcagtttttattgcagtctgcacataaattatctagaagtgaattcagggatgaagtcgaagaaataattcttattttggtgaaaataaaagctttgaatcaagcagaatccttcataggagagcatcacctagaccatcttaaatcactaattaaagaagattgaataaactttattggaaaatgctaaaattttaatatagttacactcagttcctttgtttgagaagaagctggtgcctctctcttctttattccctgtaatagaaggtaggatttgaaaaaaagcaggactccacctctgtattcccccgtgctttaccttctggcatcatgaaaagctgccatgattctgtggtgttctaaggaattaaatgcactggagctttaagagctcaacgtgtttccctttg

SEQ ID NO: 757 - DNA, 4250 bp, Homo sapiens
actgaagctgcggcttgcggttcagcgggttctagggcgccgggcgctcgggcctcggccatggctcacaggccgaaaaggacttttcggcagcgcgcggctgattccagcgacagcgatggcgccgaggagtcgcctgctgagcctggggcgccgagggaacttccggtcccgggttctgcggaggaagagccgccctctggaggaggccgcgcgcaggtggcgggactgccccaccgggttcggggccctcgtggccggggccgggtctgggcgagctcccggcgtgccaccaaagcggctccccgcgcggacgaaggctcagaatccagaacccttgatgtgtccacagatgaagaggataaaatacatcactcctcagaaagtaaggatgatcagggtttgtcttctgacagttctagctctcttggagaaaaagaactttcatcaacagttaagatcccagatgcagcttttattcaggcagcccgcagaaaacgtgaattggccagggcccaagatgactatatttctttggatgtacaacatacctcctccatctctggtatgaagagagagagcgaagatgaccctgagagtgagcctgatgaccatgaaaagagaataccatttactctaagacctcaaacacttagacaaaggatggctgaggaatcaataagcagaaatgaagaaacaagtgaagaaagtcaggaagatgaaaagcaagatacttgggaacaacagcaaatgaggaaagcagttaaaatcatagagattaacattactacaggaaactcaccgctcacacctgagggagtatgaaaaatacgtacaagatgtcaaaagctcaaagagtaccatccagaacctagagagttcatcaaatcaagctctaaattgtaaattctataaaagcatgaaaatttatgtggaaaatttaattgactgccttaatgaaaagattatcaacatccaagaaatagaatcatccatgcatgcactccttttaaaacaagctatgacctttatgaaacgcaggcaagatgaattaaaacatgaatcaacgtatttacaacagttatcacgcaaagatgagacatccacaagtggaaacttctcagtagatgaaaaaactcagtggattttagaagagattgaatctcgaaggacaaaaagaagacaagcaagggtgctttctgggaattgtaaccatcaggaaggaacatctagtgatgatgaactgccttcagcagagatgattgacttccaaaaaagccaaggtgacattttacagaaacagaagaaagtttttgaagaagtgcaagatgatttttgtaacatccagaatattttgttgaaatttcagcaatggcgagaaaagtttcctgactcctattatgaagctttcattagtttatgcataccaaagcttttaaatcccctaatacgagttcagttgattgattggaatcctcttaagttggaatccacaggtttaaaagagatgccatggttcaaatctgtagaagaatttatggatagcagtgtggaagattcaaagaaggaaagtagttcagataaaaaagtcttgtctgcaatcatcaacaaaacaattattccccgacttacagactttgtagaattcctttgggatcctttgtcaacctcacagacaacaagtttaataacacattgcagagtgattcttgaagaacattccacttgtgaaaatgaagttagtaaaagcagacaggatttacttaaatccattgtttcaagaatgaaaaaggcagtagaagatgatgtttttattcctctgtatccaaagagtgctgtagaaaacaaaacatcacctcattcaaagttccaagaaagacagttctggtcaggcctaaagctcttccgcaatattcttctttggaatggactccttacagatgacaccttgcaagaactaggactagggaagctgctaaatcgttaccttattatagcacttctcaatgccacacctgggccagatgtggttaaaaagtgcaaccaggtagcagcatgtctaccagaaaaatggtttgaaaattctgccatgaggacatctattccacagctagaaaacttcattcagtttttattgcagtctgcacataaattatctagaagtgaattcagggatgaagtcgaagaaataattcttattttggtgaaaataaaagctttgaatcaagcagaatccttcataggagagcatcacctagaccatcttaaatcactaattaaagaagattgaataaactttattggaaaatgctaaaattttaatatagttacactcagttcctttgtttgagaagaagctggtgcctctctcttctttattccctgtaatagaaggtaggatttgaaaaaaagcaggactccacctctgtattcccccgtgctttaccttctggcatcatgaaaagctgccatgattctgtggtgttctaaggaattaaatgcactggagctttaagagctcaacgtgtttccctttgattcttttggctggtctttcaattttcttaagaggggaactggagaaaccttgctaaaggttttagcttaagtgagcatgctactaagtcttctgtcctgaaccacaataatatcttttagttctctttaactacctttatttaaaaataagtcaatatgaaaatctcagttggagtgaattatttgctaagtattaaatgattaaggcatgtgccgattgtcaaattatccttcagaaatctgtaccaatttaatgtaccaacataagcataagtgagtgccaatgaatccctaccagcagtagttattatcctttttaaaaatgcattgaaaatttgaaaggtaaaaatcttattttaatagcgtattttgtgttggctattagagagtaaacatattggttttggccatttgtaattatttctgaaatatccatctttttcttatggactttaagacctttatatttttaaagatattgattttttgcccatgcttgtggcagaagttttccttatttgccatttttcttttattttttttttaattgtattttttgagacagggtctggctctgtcacccaggctggagagtagtggcacaatctcggctcactgcaacctctgccttctgggctcaagcaatcctcccacttcaacctcccaagtagctgggactataggcatgcgccaccatgcccagctgatttttgtaattttttgtagagatggggtttcgtgacattgcccaggctggtctcgaactcttgagctcaagcagtctacccaccttgacctcccaaagtgctgggattacaggcttgagcaaccatgtttggcctttcttttaaatttgttgatgttttttgaagcattaagtcattacttattagcaagttactattttgtttttttgtcattggtggtaggactaagaaggaaacagatattttaaatactcacaacatgtgattcattttctgataaaatatttgtctaataaaacagaggcaagataatttaatcaaaagaaattaagaaaattttccaaaaatgttagtttactagtaatttttctaagtctacttattaaataacttaagggaaactgtaaatatattttgcaaattgttgttcaaaagataattggaaaaaattgaatatattgtaggatttgaatatacagcctacttttatgtcacctctaccttcaaaactacatataatttattttaggagttggatttgttatgtctgttgcagtgaggacttgtgattcactggtatgaagaattttttgatgtttatattagtaacaaaattatacaaggatagaatctcatctagaaaatgcaaactattgttgaaaagcagttagcatttccacacaaccgctgtccccagagataactgctgttttcattttaatgttatccttttagaccttttctctatttacaaaaatgttacgtgtttctatgtgtacatagttttgggttttttttttttttttacgtaagtggcagacactttattgcacatgaaatttgtaatttttttctatttaagtacacatttggaaattatcctctgacttttggatttttaactaaatatgttggacgtgttcctttatatatttaagttcagcacagaaactttcctacctttttgtggaagataaaatattaaaactgctttcaaaactacaa

SEQ ID NO: 758 - DNA, 1184 bp, Homo sapiens
ggcgcaaagcatgctggtctcaggcggtctccgctcaacgatccttcctcaaagcatggttgctgagtacccagagttgcgaggagttttttaactgatttagccaggtggcaatcatgagtgaatggatgaagaaaggccccttagaatggcaagattacatttacaaagaggtccgagtgacagccagtgagaagaatgagtataaaggatgggttttaactacagacccagtctctgccaatattgtccttgtgaacttccttgaagatggcagcatgtctgtgaccggaattatgggacatgctgtgcagactgttgaaactatgaatgaaggggaccatagagtgagggagaagctgatgcatttgttcacgtctggagactgcaaagcatacagcccagaggatctggaagagagaaagaacagcctaaagaaatggcttgagaagaaccacatccccatcactgaacagggagacgctccaaggactctctgtgtggctggggtcctgactatagacccaccatatggtccagaaaattgcagcagctctaatgagattattctgtcgcgtgttcaggatcttattgaaggacatcttacagcttcccaatgagaggccaggaagtgtgaacatactgatagaaaaagactatattttatccctcataaaatgttttaaatgtaaatgtacatgactgtgtgtgtgtatgtgtgtgtgtgtataattctttgttgttttggtaaaatcagaggagtgggttataagtgctaatttccttgggaaattaatgaactagggcaagtatagcatcccatgcataaaattagcacagggacatcagaattgtatgggtcttcttttttctttttttcttttttttttgagatggagtctcgctctgttgccaggtttgagtgcagtggcgcaatctcagctcagtgcaacctccgcctcccaggttcaaccgattcccctgcctcagcctctcgagtagctgggactacaggtgcacgccaccactcccagctaattttttgtattttagtagagatggggtttcacctgtatgggtcttttcttgtgatggggttacacccccatttttgttaggcaagaaaagcatttggaaaaaaatgtaacatgttagattcaatataaaatattatggtaagatca

SEQ ID NO: 759 - DNA, 834 bp, Homo sapiens
ggtctccgctcaacgatccttcctcaaagcatggttgctgagtacccagagttgcgaggagttttttaactgatttagccaggtggcaatcatgagtgaatggatgaagaaaggccccttagaatggcaagattacatttacaaagaggtccgagtgacagccagtgagaagaatgagtataaaggatgggttttaactacagacccagtctctgccaaggttctactgtcacccaggctggaatgcagtggcgagatctcggctctttgtaacctccacctcgcaggttcaagcgattctcctgccttagcctcccgagtagctgggactacaggcatttgccaccacgtctggctaatttttgtattttttgtggagacggggcttcgccatgttgcccagtattgtccttgtgaacttccttgaagatggcagcatgtctgtgaccggaattatgggacatgctgtgcagactgttgaaactatgaatgaaggggaccatagagtgagggagaagctgatgcatttgttcacgtctggagactgcaaagcatacagcccagaggatctggaagagagaaagaacagcctaaagaaatggcttgagaagaaccacatccccatcactgaacagggagacgctccaaggactctctgtgtggctggggtcctgactatagacccaccatatggtccagaaaattgcagcagctctaatgagattattctgtcgcgtgttcaggatcttattgaaggacatcttacagcttcccaatgagaggccaggaagtgtgaacatactgatagaaaaagactatattttatccctcata

SEQ ID NO: 760 - DNA, 1582 bp, Homo sapiens
gagcacttccgggtcgtcagctcagttctgcggtttctgcggcggctggagaggtggtcggagaagtaggaacctcctgccgggctcgtggcggcttctgtccgctccgcggagggaagcgccttccccacaggacatcaatgcaagcttgaataagaaaaacaaattcttcctcctaagccatggcatatcagttatacagaaatactactttgggaaacagtcttcaggagagcctagatgagctcatacagtctcaacagatcaccccccaacttgcccttcaagttctacttcagtttgataaggctataaatgcagcactggctcagagggtcaggaacagagtcaatttcaggggctctctaaatacgtacagattctgcgataatgtgtggacttttgtactgaatgatgttgaattcagagaggtgacagaacttattaaagtggataaagtgaaaattgtagcctgtgatggtaaaaatactggctccaatactacagaatgaatagaaaaaatatgacttttttacaccatcttctgttattcattgcttttgaagagaagcatagaagagactttttatttattctagaattgcagaaatgactacactgtgctataccagagaattccagtagaaagaaacttgtaactctgtagcctcttacatcacctttattatacagcatgaaaaaccataacttttttttaaggacaaaagttgttgccttcctaagaaccttctttaataaactcattttaaaactctgagtaataactggtgaagctattaaggtagcaatatgaagatattagataatgcattttcccatttcctttgcaaggaacatgatgccctttcagaatgcttatttcaataaagtcatgttttgtcagttgtaactttacctgatgaaagcatcagcaggggcaaaaccaaactctggatggaattttttaagaaaatcccttgctttttaaaatacaaaaccaaagttaatcattggtataaaaaaacccaagtacaacttgattaggaaaagttagacaatcatagcaaaaacaaaaccaaaaaactttccttcttagaccaggtaacatgaggaagggggaaaaaaacccaaacaaaatagtccccccacatgacaggtgtcttcagcttgccatattgatccaaagttcatacattttatcatgtacaagatacattagacttacaataaagtctaattattagacttttatgtcagtggattgtgcttgcagaaatacagaagtaacatactgaccctaggtgaggagtttcttacatggttaactggattgacccaattggagtaaaagatttttgctgttacctcgatgctcctgcagttgttacctcagcatgccactgtagtccttgactctcacattaaaactaactttggctaggtactggtggctcacacctgtaagtaatcccagtactttaggaggctgagactggaggattacttgagtccaggagttggagaccagcctggccaatatagactgtccctacaaagaaaataaaattgtttcatcttccaa

SEQ ID NO: 761 - DNA, 758 bp, Homo sapiens
ggagaagtaggaacctcctgccgggctcgtggcggcttctgtccgctccgcggagggaagcgccttccccacaggtagtgggttagggagggcagggttagggagggaagcagggccgcgctccctgccgcccccccggagtcggagtgcgttggtggggtagtctctgagggcccttcgctcctgggatctgcccgttaccgaccgttgccggcaaggccccgcggccggcaccggagaagggcggcgaggcggcggtgatggtcgcgtcccgtggcgggaggctcgtcgttcacggggcgcccacagaacccacctaggggaggtcttcagcccaccaccgtattttcagccaggacatcaatgcaagcttgaataagaaaaacaaattcttcctcctaagccatggcatatcagttatacagaaatactactttgggaaacagtcttcaggagagcctagatgagctcatacagtctcaacagatcaccccccaacttgcccttcaagttctacttcagtttgataaggctataaatgcagcactggctcagagggtcaggaacagagtcaatttcaggggctctctaaatacgtacagattctgcgataatgtgtggacttttgtactgaatgatgttgaattcagagaggtgacagaacttattaaagtggataaagtgaaaattgtagcctgtgatggtaaaaatactggctccaatactacagaatgaatagaaaaaatatgactttttta

SEQ ID NO: 762 - DNA, 970 bp, Homo sapiens
gttctgcggtttctgcggcggctggagaggtggtcggagaagtaggaacctcctgccgggctcgtggcggcttctgtccgctccgcggagggaagcgccttccccacagcttgttgtttgaagtctgccttccaactttcttcgtgcgaactccgacaaaaggaacgaattttaaacttggtggtttaatcaaaaaatgctaggacgagttacttccgaatttgacttctaattttctgaactgcaaaacaagaagggaacaataaatttctgtggctgataccacatctaaaagattagaacacttaacaaggaatttttaaagaatgacatcaatgcaagcttgaataagaaaaacaaattcttcctcctaagccatggcatatcagttatacagaaatactactttgggaaacagtcttcaggagagcctagatgagctcatacagtctcaacagatcaccccccaacttgcccttcaagttctacttcagtttgataaggctataaatgcagcactggctcagagggtcaggaacagagtcaatttcaggggctctctaaatacgtacagattctgcgataatgtgtggacttttgtactgaatgatgttgaattcagagaggtgacagaacttattaaagtggataaagtgaaaattgtagcctgtgatggtaaaaatactggctccaatactacagaatgaatagaaaaaatatgacttttttacaccatcttctgttattcattgcttttgaagagaagcatagaagagactttttatttattctagaattgcagaaatgactacactgtgctataccagagaattccagtagaaagaaacttgtaactctgtagcctcttacatcacctttattatacagcatgaaaaaccataacttttttttaaggacaaaagttgttgccttcctaagaaccttctttaataaactcattttaaaactc

SEQ ID NO: 763 - DNA, 3012 bp, Homo sapiens
atttaagccggtagttgaagcgctgggggcagctgtagtgggagtgttccaggattcgccttgtatatttaaagttggagttcgttgctaaagatggcagacccagatgtcctcactgaagttccagcagcattgaagcggttagccaagtatgtgatccggggattttatggcattgagcatgccttggccttggacatcttgatcaggaactcctgtgtgaaagaggaggatatgctggagctgctcaagtttgatcggaagcaacttcgatcagttttgaataatttaaagggagacaagtttatcaaatgcagaatgagggtagagactgctgcagacgggaaaaccactcgccataactactacttcatcaattatcgtactcttgttaatgtggtaaaatataaactggaccacatgagaagaagaattgagaccgatgagagagattcgaccaaccgggcttccttcaaatgtcctgtctgtagtagtactttcacagacttagaagctaatcagctctttgatcctatgacaggaactttccgctgtactttttgccatacagaggtagaagaggatgaatcagcaatgcccaaaaaagatgcacgcacacttttggcaaggtttaatgaacaaattgagcccatttatgcattgcttcgggagacagaggatgtgaacttggcctatgaaatacttgagccagaacccacagaaatcccagccctgaaacagagcaaggaccatgcagcaactactgctggagctgctagcctagcaggtgggcaccaccgggaagcatgggccaccaaaggtccttcctatgaagacttatacactcagaatgttgtcattaacatggatgaccaagaagatcttcatcgagcctcactggaagggaaatctgccaaagagaggcctatttggttgagagaaagcactgtccaaggggcatatggttctgaagatatgaaagaagggggcatagatatggacgcatttcaggagcgtgaggaaggccatgctgggcctgatgacaacgaagaggtcatgcgagcactgctcattcacgagaaaaagacttcctctgccatggctggttcagtgggggcagctgctccagtgaccgctgccaatggcagtgactcagaaagcgagaccagtgagtcagatgatgattctccaccccgtccggcagctgtggctgtgcataaacgagaagaggatgaagaggaagatgacgagtttgaagaagtagcagatgaccccattgtcatggtggctggccgtccgttctcctacagtgaagtgagccaacggccagagctagtggcccagatgacaccagaagaaaaggaagcatatatagcaatgggacaacgcatgtttgaggacctctttgagtgagctttccctaattctttctcctttctctaatgctcagttcaaaaaggaatgtctcatctttgaagaaaagtatttaagtggctttctgcccctcttgatgtaagcaactgtccatccttgtgcaaagattgatggtagagagtttgacttttatgccagaaactttcccagcaaggtagggtgctgagaatcctacccttccttgctgtcactacagtattaatattttactgtattttcttttcttttttttttttttttggagatgaagtctcactcttgtaccccaggctggagtgcaatggcgtgatctcggctcactgcaacctctgcctcctgggttcaagcgattctcctgcctcagcctcccgagtagctgggattacaggtgcctgccaccatgcctggctaatttttgtatttttagtagaggcagggtttcaccatgttagccaggatgatctcgatctcctgacctcatgatccacccgcctcggcctcccaaagtgctgtattttcttatctgatttttttcttgccttattaagacataattttctcccttctgaaatgagtgagggaagttcataaggtaaatccttcccatccatctgtttactacaataggttacaataattcactgatcacatccattttatctgttctagccaggcattccaaacaatttcttatactgctgcccaccaaagcagcttgccaacagtcaaatcactgattgggggaaaaaatcctgaaattttgcttagaatttgagcatttcctcaaaattgagatggatcaatatgtaaggggaggtgggagcgtgtgtggaagggggagagatatacttgagtcttatgattaatgtctaaaccagaatttgtgtctttagaactgaccagactggtagattttattgtattgcttaatgtcttttggtttggatttaggatgatagaaaacagaagtataattggtaaacccttaggaagaaattagaaaaacatggacgtaagacaagaagtctctgtgaagggttgaagagtgacaagcattggtaacagtgccttagaactgtgtcagttagtctgatttggaaatcctttatgtaaagctgagactggtcctggttttgttccctttgggtacagacctcttgtcagtgctataaattgtttaatgaggccattccagcagaaatcaacagaataattgattactcttctctctctctgtcactctccctctttctaaacatcattgaaggctgtctctcttttaatttttgtcagacacagtattttagggtgcatccagtataccattgagcattgtaacctcaggaaacagtttattttgggttctgatatgtagcatggtattttccctaaggcagaactttaaaaataaagaactttcacacaagggtctgtaacaattgtatatcttacaatatttttccttgcattgtaatttttaagtatttatcattttatagtacacatgtaaagaatatatgagccttgtatggagtgatgtttcatttacctgggttgtgttaatgactgaatgttgacaataaatctgttttatactga

SEQ ID NO: 764 - DNA, 543 bp, Homo sapiens
gaactcattggctggtctggtaaaaggtagcggggtgcttccccagctggtcgcaggaatagtgcgttttctttgtcgcgcaaggggcgtggttcatttaagccggtagttgaagcgctgggggcagctgtagtgggagtgttccaggattcgccttgcccaggtttttaaagtaaactatatgccaatgtgggctttgagaagacagctttctgggtcatggtacggaaatgagatacacttagtttctgctttgtcaagggatccagtatttaagaatattttgggctgctctccctccctcattttctacctttttaaggactggatggtctttccttgattatcagattcaatttttcaagtatatttaaagttggagttcgttgctaaagatggcagacccagatgtcctcactgaagttccagcagcattgaagcggttagccaagtatgtgatccggggattttatggcattgagcatgccttggccttggacatcttgatcaggaactcctgtgtgaaagaggaggatatgctgg

SEQ ID NO: 765 - DNA, 551 bp, Homo sapiens
agttgaagcgctgggggcagctgtagtgggagtgttccaggattcgccttgggatccagtatttaagaatattttgggctgctctccctccctcattttctacctttttaaggactggatggtctttccttgattatcagattcaatttttcaagtatatttaaagttggagttcgttgctaaagatggcagacccagatgtcctcactgaagttccagcagcattgaagcggttagccaagtatgtgatccggggattttatggcattgagcatgccttggccttggacatcttgatcaggaactcctgtgtgaaagaggaggatatgctggagctgctcaagtttgatcggaagcaacttcgatcagttttgaataatttaaagggagacaagtttatcaaatgcagaatgagggtagagactgctgcagacgggaaaaccactcgccataactactacttcatcaattatcgtactcttgttaatgtggtaaaatataaactggaccacatgagaagaagaattgagaccgatgagagagattcgacc

SEQ ID NO: 766 - DNA, 1803 bp, Homo sapiens
gtccgcgtgtggaagtctgtgaggcgcagaggtggggcaggccgtctgactagctaggcggctgggagcgttttcgtggcggggaacggaggttgaattgccctgcctgggctcatagggaaggaggatgtgaaggagcttgtgaaggcagaggaaggctggagtgcagtggcacaaccttggctcgctccagtgtctacctcccaggttcaagtgattctcctgcctcagcctcccgagtagctgggattacagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaaggaagctgtggatatgacctgccatggagagccatctctttataattccctaagcatggctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatcttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatcttta

SEQ ID NO: 767 - DNA, 1956 bp, Homo sapiens
gactagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaaggaagctgtggatatgacctgccatggagagccatctctttataattccctaagcatggctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatcttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaatttagtgtaagaagaaagttaagtctgaatgtaaattcagtgtaagatgaaaatttatcaatacttatgaaattaggctgggcgctgtggctcacacctgtaatcccaacactttgggaggctgaggtgggcagatcacttgaggtcaggagttcgagaccagcctggccaacatggtgaaaccccgtcactactaaaaatacaaaaaataattagccgggcatggtggttcacgcctggagtcccagctacttgggaggctgaggcaggagaatcgcttgaacccaggaggcggaggttgcagtgagccgaga

SEQ ID NO: 768 - DNA, 2952 bp, Homo sapiens
ggtgagtccgcgtgtggaagtctgtgaggcgcagaggtggggcaggccgtctgactagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaatagactgacgtgtactttaaagttgttggaatactttgtagaggaatattttgatcaaaatcctattagtcagattggaataattgtaactaagagtaaaagagctgaaaaattgactgaactttcaggaaacccaagaaaacatataacgtctttgaaggaagctgtggatatgacctgccatggagagccatctctttataattccctaagcatggctatgcagactctaaaacacatgcctggacatacaagtcgagaagtactaatcatctttagcagccttacaacttgcgatccatctaatatttatgatctaatcaagaccctaaaggcagctaaaattagagtatctgttattggattgtctgcagaagttcgcgtttgcactgtacttgctcgtgaaactggtggcacgtaccatgttattttagatgaaagccattacaaagagttgctcacacatcatcttagtcctcctcctgctagctcaagttctgaatgctcacttattcgtatgggatttcctcagcacaccattgcttctttatctgaccaggatgcaaaaccctctttcagcatggcgcatttggatggcaatactgagccagggcttacattaggaggctatttctgcccacagtgtcgggcaaagtactgtgagctacctgttgaatgtaaaatctgtggtcttactttggtgtctgctccccacttggcacggtcttaccatcatttgtttcctttggatgcttttcaagaaattcccctagaagaatataatggagaaagattttgttatggatgtcagggggaattgaaagaccaacatgtttatgtttgtgctgtgtgccaaaatgttttctgtgtggactgtgatgtttttgttcatgattctctacactgttgccctggctgtattcataagattccagctccttcaggtgtttgattccagcatgtagtatacattgtatgtgttaaaaagaaatttgcaactgtgaataaaaggacttctttagaagaagcttcatttaaaacatgaaaggataatctgacttaagaaactttttgctaagaaaaggtaatattttattaaattttaaatttgtgttgtcacagaaatacctgaaattcagtagtacttcattcaattaattttgttttctattattttgagttatactgttttcaaagtcattatgcagtatgtataaacttataagaattaaattgatgtgataattttatgtttttataattaaatatagaatctttatgatttatgttaattcattaatttagtgtaagaagaaagttaagtctgaatgtaaattcagtgtaagatgaaaatttatcaatacttatgaaattaggctgggcgctgtggctcacacctgtaatcccaacactttgggaggctgaggtgggcagatcacttgaggtcaggagttcgagaccagcctggccaacatggtgaaaccccgtcactactaaaaatacaaaaaataattagccgggcatggtggttcacgcctggagtcccagctacttgggaggctgaggcaggagaatcgcttgaacccaggaggcggaggttgcagtgagccgagattgtgccactgcactccaccctagagtaagactccctctcaaaaaaaaaaaaagttatgaaattaatacatatgaaatgatgtactgctacatccaccagagaggtctttttaggtttaaccaaacatctggaatatgtttatcaagttagtacatctgaaattatttgtggctatgaccaacagaagtcactttacattaaacattcaaactcacaagactgccatggccatacttggtacccgcttactcagaaggatattaaacagaaacaacagcctgccagcacagcatcaagcagtcctcattagcagtggaagtccttgtagcagtccactagtacaatttgggtgcaaggagataagatcctccacaggcatcaaggaaccaatatctcttaacaattccataaacacagcttccaggtatccacaagggatgtgtcaatttcaagagtcactacactcaggaaagcctaaagcttgaagactccatttatttatagtgcatcccaatccagatacgtaacaattaacgagttatttttactataagcaaagttgcctaaaatcatagttgatactaaccatggttaacagagctctaaagtttgacagaaagtgagattcaaatcctttcactctcatatgctaaaccttttgccttactctgggtcatcagagaaatttaggtgagaatgtatgatgaagtctgtgttttagattcaatgcagatatatcattgtgggcagaactctttctggttatatccagttaagagtaaatcaggctttcagccgggcgcggtggctcacgcctgtaatcctagcactttgggaggccgaggcgggcagatcacgaggtcaggagatcgagaccatcctggctaacacggtgaaaccccgtct

SEQ ID NO: 769 - DNA, 1472 bp, Homo sapiens
acttgctctgcgctgaggtgctgggacagccatggtttcagacgttcactttatccaaatgcatagatgccgtgatggtgctgggaaattcgcatttattcatgaatcgttccaacaaacttgctgtgatagcaagtcacattcaagaaagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtgacataaagggtcaacatacagaaactttgctggcaggatccctggccaaagccctttgctacattcatagaatgaacaaggaagttaaagacaatcaggaaatgaaatcaaggatattggtgattaaggctgcagaagacagtgcgttgcagtatatgaacttcatgaatgtcatctttgcagcacagaaacagaatattttgattgatgcctgtgttttagactccgactcagggctcctccaacaggcttgtgacatcacgggaggactgtacctgaaggtgcctcagatgccttctcttctgcagtatttgctgtgggtgtttcttcccgatcaagatcagagatctcagttaatcctcccacccccagttcatgttgactacagggctgcttgcttctgtcatcgaaatctcattgaaattggttatgtctgttctgtgtgtttgtcaatattctgcaatttcagccccatttgtactacgtgcgagacagcctttaaaatttctctgcctccagtgctgaaagccaagaaaaagaaactgaaagtgtctgcctgaggataaaatattttccccatcttttagagctgttaatagaaattatatagcagattctttgttgggaagactgaaaaaaataaagataggtataggataatttttaatatggtgaccttacagaaaatatttcccaaacatccttttcatcctgtgcttctggaggactgatttgtttgagggaatcattctatgcattatatcctaaaatattctatgactggtttctgtccatgtttgtggctttcatttttttaatgggatgactattagtcaaagtcagcttgtcatgactcatcataggctttctaacctactccctgaatccgggtcctcattgtgaaatgcatgccatacgaaatttgaacgtagctttggaaaaagggactatttgtggagtaatggcattaatcaacatagaacatcttatttgaatcaacagttaacttcagtagtcatgtgaataaaattcttattgtctaaattgagacagcctcagatatttgcagatatttactttttgtctgatatcagtacatatttggacaaagtcatctaaataatagtttgtcaccaaataactacaaaatctca

SEQ ID NO: 770 - DNA, 2319 bp, Homo sapiens
aagatgaattgaatcttctggttattgtagttgatgccaacccaatttggtggggaaagcaagcattaaaggaatctcagttcactttatccaaatgcatagatgccgtgatggtgctgggaaattcgcatttattcatgaatcgttccaacaaacttgctgtgatagcaagtcacattcaagaaagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtgacataaagggtcaacatacagaaactttgctggcaggatccctggccaaagccctttgctacattcatagaatgaacaaggaagttaaagacaatcaggaaatgaaatcaaggatattggtgattaaggctgcagaagacagtgcgttgcagtatatgaacttcatgaatgtcatctttgcagcacagaaacagaatattttgattgatgcctgtgttttagactccgactcagggctcctccaacaggcttgtgacatcacgggaggactgtacctgaaggtgcctcagatgccttctcttctgcagtatttgctgtgggtgtttcttcccgatcaagatcagagatctcagttaatcctcccacccccagttcatgttgactacagggctgcttgcttctgtcatcgaaatctcattgaaattggttatgtctgttctgtgtgtttgtcaatattctgcaatttcagccccatttgtactacgtgcgagacagcctttaaaatttctctgcctccagtgctgaaagccaagaaaaagaaactgaaagtgtctgcctgaggataaaatattttccccatcttttagagctgttaatagaaattatatagcagattctttgttgggaagactgaaaaaaataaagataggtataggataatttttaatatggtgaccttacagaaaatatttcccaaacatccttttcatcctgtgcttctggaggactgatttgtttgagggaatcattctatgcattatatcctaaaatattctatgactggtttctgtccatgtttgtggctttcatttttttaatgggatgactattagtcaaagtcagcttgtcatgactcatcataggctttctaacctactccctgaatccgggtcctcattgtgaaatgcatgccatacgaaatttgaacgtagctttggaaaaagggactatttgtggagtaatggcattaatcaacatagaacatcttatttgaatcaacagttaacttcagtagtcatgtgaataaaattcttattgtctaaattgagacagcctcagatatttgcagatatttactttttgtctgatatcagtacatatttggacaaagtcatctaaataatagtttgtcaccaaataactacaaaatctcattttaaatgagtaaggagaacgtgtacagaagcaaattttcttcaaaatagttgtgggaagagcttatatgtgaaagcttatgactggttttgagggagaacttactggagaaaatggactctatgttaagtatggttttcagatagaattctttccttttttaatgaggaaaaaaaatccacattaatattgaaactgcacctgtaatcccagcactttgggaggctgaggacagaggattgcttgagcccaggagttcgagagcagcctgggcagcaaagtgagaccccatctctactaaaaatttaaatgtatttattaaaactgttctctagaagctttggactgaatcccaaaagtgtttataagttcaaaagcaaaagtatttgtaatttcaacaacaaaaaatgtatttctttatgtaatcttgaaattattaaaagtccttttagcttctagcacatatttgtacaaagagtttaaggaatggtggctggtttggtttgttttttaaaaatgtttactgacgaggccgggcgtggtggctcacccctgcaatcccagcactttgggaggccgaggcaggcagatcacaaggtcaggagttcaagatcagcctggccagtatggtgaaaccctgtctctactaaaaatagaaaaattagccatgcgaagtagcaggtgcctgtagttccagctactcgggaggctgaggcaagagaattgcttgaatccaggaggcagaggttgcagtgagccaagatagcgcctctgtactccagcctgggtgacagagcgagactctgtatc

SEQ ID NO: 771 - DNA, 2655 bp, Homo sapiens
acttgctctgcgctgaggtgctgggacagccatggtttcagacgaagatgaattgaatcttctggttattgtagttgatgccaacccaatttggtggggaaagcaagcattaaaggaatctcagttcactttatccaaatgcatagatgccgtgatggtgctgggaaattcgcatttattcatgaatcgttccaacaaacttgctgtgatagcaagtcacattcaagaaagccgattcttatatcctggaaagaatggcagacttggagacttcttcggagaccctggcaaccctcctgaatttaatccctctgggagtaaagatggaaaatacgaacttttaacctcagcaaatgaagttattgttgaagagattaaagatctaatgaccaaaagtgacataaagggtcaacatacagaaactttgctggcaggatccctggccaaagccctttgctacattcatagaatgaacaaggaagttaaagacaatcaggaaatgaaatcaaggatattggtgattaaggctgcagaagacagtgcgttgcagtatatgaacttcatgaatgtcatctttgcagcacagaaacagaatattttgattgatgcctgtgttttagactccgactcagggctcctccaacaggcttgtgacatcacgggaggactgtacctgaaggtgcctcagatgccttctcttctgcagtatttgctgtgggtgtttcttcccgatcaagatcagagatctcagttaatcctcccacccccagttcatgttgactacagggctgcttgcttctgtcatcgaaatctcattgaaattggttatgtctgttctgtgtgtttgtcaatattctgcaatttcagccccatttgtactacgtgcgagacagcctttaaaatttctctgcctccagtgctgaaagccaagaaaaagaaactgaaagtgtctgcctgaggataaaatattttccccatcttttagagctgttaatagaaattatatagcagattctttgttgggaagactgaaaaaaataaagataggtataggataatttttaatatggtgaccttacagaaaatatttcccaaacatccttttcatcctgtgcttctggaggactgatttgtttgagggaatcattctatgcattatatcctaaaatattctatgactggtttctgtccatgtttgtggctttcatttttttaatgggatgactattagtcaaagtcagcttgtcatgactcatcataggctttctaacctactccctgaatccgggtcctcattgtgaaatgcatgccatacgaaatttgaacgtagctttggaaaaagggactatttgtggagtaatggcattaatcaacatagaacatcttatttgaatcaacagttaacttcagtagtcatgtgaataaaattcttattgtctaaattgagacagcctcagatatttgcagatatttactttttgtctgatatcagtacatatttggacaaagtcatctaaataatagtttgtcaccaaataactacaaaatctcattttaaatgagtaaggagaacgtgtacagaagcaaattttcttcaaaatagttgtgggaagagcttatatgtgaaagcttatgactggttttgagggagaacttactggagaaaatggactctatgttaagtatggttttcagatagaattctttccttttttaatgaggaaaaaaaatccacattaatattgaaactgcacctgtaatcccagcactttgggaggctgaggacagaggattgcttgagcccaggagttcgagagcagcctgggcagcaaagtgagaccccatctctactaaaaatttaaatgtatttattaaaactgttctctagaagctttggactgaatcccaaaagtgtttataagttcaaaagcaaaagtatttgtaatttcaacaacaaaaaatgtatttctttatgtaatcttgaaattattaaaagtccttttagcttctagcacatatttgtacaaagagtttaaggaatggtggctggtttggtttgttttttaaaaatgtttactgacgaggccgggcgtggtggctcacccctgcaatcccagcactttgggaggccgaggcaggcagatcacaaggtcaggagttcaagatcagcctggccagtatggtgaaaccctgtctctactaaaaatagaaaaattagccatgcgaagtagcaggtgcctgtagttccagctactcgggaggctgaggcaagagaattgcttgaatccaggaggcagaggttgcagtgagccaagatagcgcctctgtactccagcctgggtgacagagcgagactctgtatcaaaaaaaaaaaagatcgggcacgttggctcacgcctgtaatcccagcactttgggaggccaaggtgggtggatcacgaggtcaggagtgatcaggctgggtttctgttttgttttgttttgtgagacagagtctcgctctgttgcccaggctggggtgcagtggtgcaagctcggctctctgcaagctctgtctcctgggttcacgccattctcctgcctcagcctcccaagtagctgggattactactctactgaacccatgaggcagaaatttgagaccatcctgcccaa

SEQ ID NO: 772 - DNA, 7106 bp, Homo sapiens
cgttgcgcatgcgccccgggcgccgccgactgaagtagcaatggacgcgctggagtcgttgttggacgaagtcgctctggaggggctcgatggcctgtgtctgccagcgctgtggagccggctggagacgcgagtgccgcccttcccgctgcctttggaaccctgcacgcaggagtttctctggcgggccctcgccacgcacccgggcatcagcttctatgaggagcctcgggagcgacccgacctacagctccaggaccggtatgaagaaattgatttggaaactggaattttggagtctaggagggacccggtggctttggaggatgtctaccccattcatatgatcttagagaataaggatggcatccagggctcatgccgctactttaaggagaggaaaaacattaccaatgacatcagaaccaagtccttgcagcctcgctgtacaatggtggaagcctttgacaggtgggggaagaaactgatcatcgttgcctcccaggccatgcggtacagggccttgataggccaggagggggatcccgacctgaagctgcccgacttctcctactgcatcctggaacggctaggccggtccaggtggcaaggggagctccagcgagaccttcacaccactgctttcaaggttgatgctgggaagctgcactatcacagaaaaattttgaacaaaaacgggctgattacaatgcagtcccatgtgatccgattacccactggagcccagcaacactcaatcctcctcctactgaaccggtttcatgtggacaggaggagcaaatacgacatcctcatggagaagctttcggtcatgctgagcacacggactaaccacatagagacgctgggaaagctgagggaagagctggggctgtgcgaaaggacgtttaagcgtctgtaccagtatatgctgaacgccgggctagccaaggtggtgtctcttcgcttgcaagagatccaccctgaatgtggaccttgtaagacaaagaaagggaccgacgtcatggttcggtgcctcaagctgctgaaggaatttaaacggaatgaccatgatgatgacgaggacgaggaggtcatctccaagacagtgcctccagtggacattgtgttcgagcgggatatgctcacacagacctacgacctcattgagcgcagaggcacgaaaggaatttcccaagctgaaatccgagtggctatgaatgtgggaaaactagaagcaagaatgctgtgccgacttcttcaaagattcaaagttgtcaagggattcatggaagacgaaggtcggcagcgaaccaccaagtacatttcctgcgtgtttgcagaggagagcgacctaagccggcagtaccaaagagagaaggcccgcagcgagctcttgaccaccgtgagcctggcgtctatgcaggaggagtcgcttctgcctgaaggcgaggacaccttcctctctgagtcggacagtgaggaggagaggagcagcagcaagcggagaggcagagggtcccagaaagacacaagagcctctgcaaacctccggcccaagacccagcctcatcactccaccccaaccaagggtgggtggaaagttgtaaacctacacccattgaaaaagcagccgccctccttcccaggagctgctgaagagagagcctgccagagccttgccagcagggacagcctcttagataccagcagcgtctcagaacccaacgtgtcctttgtctcccactgtgcggacagcaacagtggtgacatagctgtgatcgaggaggtccggatggaaaacccaaaggagagtagcagttccctgaagactgggaggcacagctcaggccaagacaaaccacacgaaacttaccgactgctgaaacgcaggaatctgatcatagaagctgtcaccaatcttcgcttaatcgagagtttattcacgattcagaagatgatcatggatcaggagaagcaggaaggcgtgtccaccaagtgctgcaagaagtccattgtccgcttggtgcggaacctgtctgaggaaggtctcttgcgattgtatcggaccactgtcattcaagatggcatcaagaagaaggtggatctggtggtgcacccgtccatggaccagaacgaccctctagtgagaagtgccatcgagcaggtccgcttccggatctccaattcaagcacagccaacagggttaaaacttcccagcctccagtgccccaaggggaggcagaagaagacagtcaaggaaaagagggcccaagtggatcaggggactctcagctgagtgcttcctctagatcagaaagtggacggatgaaaaaaagtgataataaaatgggcataaccccgcttagaaattatcaccccattgtagttcccggactggggcgttctctaggatttctgcccaaaatgcctcgcctgcgggtggtccacatgtttctgtggtacctcatctacgggcaccctgccagcaacaccgtggagaagccaagcttcatcagtgaacggagaacgataaagcaggagtcaggcagggcaggcgtccggccgtcctcctctggaagtgcctgggaggcctgctctgaagccccatctaaaggcagccaagatggtgtcacctgggaggctgaagtggagcttgccacggagacagtgtatgtcgacgatgcctcgtggatgcgctacatccccccaatcccagtccacagggacttcggctttggctgggctctcgtcagcgacatcctcctctgccttcccctctccatcttcatccagattgtgcaagtcagctacaaggtggacaacctggaggaatttctgaacgacccgctgaagaagcacacgctgatccgctttctccccaggcccattcggcagcagcttctgtacaagaggcgttacattttttcggtggtggagaaccttcagaggctgtgctacatggggctgctacagtttggtcccacggaaaagtttcaggataaagatcaggtctttatcttcttgaagaagaatgcagtcattgttgacactaccatctgcgacccacattacaacctggcccgcagcagccggcccttcgagaggcgcctctatgtcctgaactcaatgcaggatgtggaaaactactggtttgacctgcagtgcgtctgcctcaacaccccactaggcgtggtgcgctgcccgcgcgtcaggaagaacagcagcacagaccagggcagcgacgaggagggcagcctgcagaaggagcaggagagcgccatggacaagcacaacctggagcgcaagtgcgccatgctggagtacaccactggaagccgtgaggtggtggatgaaggcttgatccctggagatgggctgggtgccgcagggctcgattccagcttctacggacacctcaagcgcaactggatctggaccagctacatcatcaaccaggccaaaaaggagaacactgccgcagagaatggactcacagtgaggctccagacatttctgtccaagcgcccaatgcccctcagtgccagaggcaacagcaggttgaatatttggggggaagcaagagtaggctccgagctctgtgctggctgggaagagcagtttgaggtggaccgagagccctcgctggaccgaaaccggagagtgaggggtgggaaaagccagaagcggaagcggctgaagaaggaccctgggaagaagatcaagagaaagaagaaaggagagttcccaggagaaaaaagcaaaaggctgcgctaccatgatgaagccgaccagagtgccctgcagcggatgacgcggcttcgtgtcacctggtctatgcaggaggatgggctgcttgtgctgtgccgcattgccagcaatgtcctcaacaccaaggtgaagggcccatttgtcacctggcaggtggtacgggacattttgcatgccacgtttgaagagtctttggataaaacatctcattccgttggacgaagagctcgctacatagtcaaaaacccacaggcctatctcaactataaagtgtgcctggccgaggtgtaccaggataaagcacttgttggagatttcatgaatcgaagaggtgactatgatgacccaaaggtttgtgccaacgagtttaaagaatttgtggagaagcttaaagaaaagttcagttcagccctaaggaattctaaccttgaaatcccagacacactccaggagctgttcgccaggtaccgagttttggcaattggggatgaaaaagatcaaaccaggaaagaggatgaacttaacagcgtggatgacatccactttctggtgcttcagaacctgatccagagcacgctggccctctcagacagtcagatgaagtcctaccagtcattccagactttccgcctctatcgggagtacaaggaccacgttcttgtgaaggccttcatggagtgccagaagaggagcttggtcaaccggcgccgggtcaaccacacgctgggccccaagaagaaccgggccctccccttcgtgccaatgtcctaccagctatcccagacctactacaggatttttacgtggcgatttccaagcaccatctgcacggagtcattccagtttttggacagaatgcgggctgccggcaagttggaccagcctgatcgtttctctttcaaagaccaggataataacgagcccacaaacgacatggtggccttttcactggacggccctggaggaaattgtgtggccgtcctgaccctcttctctctgggcctcatttctgtggatgtcaggatcccggagcagatcatcgtggtagacagctcaatggtggagaatgaggtcatcaaaagcttggggaaggacggcagcctggaggatgacgaggatgaagaggatgacttggacgaaggtgtagggggcaagcgccggagcatggaggtgaaacctgcgcaagcctcccacaccaactacctgctgatgaggggctactactcccccggcatcgtcagcacccgcaacctcaaccccaacgacagcattgtggtcaactcctgccagatgaagttccagctccgctgcacccctgtgcccgcccggctcaggcccgctgccgctcctctggaagagctaacaatgggaacctcctgcctccctgatacgttcaccaagctgataaacccccaggaaaacacctgcagcttggaggagtttgtcctccagctggagctgtctgggtatagtcccgaagacctgactgctgccttggagatcttggaagccattatagccacgggttgttttgggattgacaaggaggagctgcgcagacggttctcggccttggagaaggcaggtggtgggcgcaccaggacattcgcagattgcatccaggccctcctggagcagcatcaggtgctggaggtcggtggcaacactgcgcgcctggtagccatgggctctgcctggccttggctcctgcactccgtgcggctgaaagacagagaagacgccgacatccagagagaagacccccaggccagacccctggaggggtcttccagtgaggacagcccccccgaggggcaggcacctccttctcacagcccccggggcaccaagaggcgcgccagctgggccagtgagaatggggagaccgacgccgagggcacccagatgacccctgccaagaggccagcgctccaggactcaaatttggcccccagccttgggcccggagctgaagatggggcagaagcccaggccccatctccacccccagctcttgaagacaccgctgcagcgggagcagcacaggaagaccaagagggtgtcggtgagttcagttccccaggccaagagcagctgagcggccaggcgcagcctccagagggctctgaagaccccagagggttcacagagagtttcggagctgccaacatctcccaggcagcacgggaaagggactgtgagagtgtctgcttcatcggccggccgtggcgtgtcgtggatggccacctgaaccttcctgtatgcaagggtatgatggaggccatgctgtaccacatcatgaccaggcctggcatccccgagagctccctgctgcgccactaccagggggtcctgcagcccgtcgccgtgctggagttgctccagggcctggagtccctcggctgcatccggaagcgctggctgagaaagccaaggcctgtctcgctcttctctacacccgtggtggaagaggtggaagtgccctccagcctggacgagagccccatggctttctatgagcccaccttggactgtaccctccggctgggccgtgtgttcccccacgaggtcaactggaacaagtggatccacctctaggacccctgtgggcgtcccctccctcccagccaccgcctgccacaccactcctgcctggtgctcggcagaccccactgtgccctggccttgggtctgccgagcctcctgcagcaggggacgggtgctttggccagagtcacagactgacacgtttcccactgtactggaactctggaaagaggggctccccgacctgcccatcccccaggctcttctgggccttccccttgggaactggcctcatcacactgggagttggtgcttcttgtctctgggtctccagagtttgccccgcctgtgcacacctcacattccagactctagccatctcggcaggatctcctggctccttgagtgcccaggtgccaccaagaggaagggccttgtgggatacaccttgcagaatagggatcggtgtgccccgctgcgaggggccccccatgggggctgtggcccctccgcaggcaggacatcccaacccctggctgggactgaaccacccagagcggagcggctcccttttcagccttgtgagtcacctggcaggccccagctgggctggctgtccgtgtccctcagcctggctggtgattccttgcaggccagaaatgaagagtccctgtaggttttggttttgtttgttttattttgttctttcaccttttttcctcattaaaaaaaaaaagtccctgtggagtgtacttatttattttttgattaaagggaagtaaaatgc

SEQ ID NO: 773 - DNA, 7094 bp, Homo sapiens
cgttgcgcatgcgccccgggcgccgccgactgaagtagcaatggacgcgctggagtcgttgttggacgaagtcgctctggaggggctcgatggcctgtgtctgccagcgctgtggagccggctggagacgcgagtgccgcccttcccgctgcctttggaaccctgcacgcaggagtttctctggcgggccctcgccacgcacccgggcatcagcttctatgaggagcctcgggagcgacccgacctacagctccaggaccggtatgaagaaattgatttggaaactggaattttggagtctaggagggacccggtggctttggaggatgtctaccccattcatatgatcttagagaataaggatggcatccagggctcatgccgctactttaaggagaggaaaaacattaccaatgacatcagaaccaagtccttgcagcctcgctgtacaatggtggaagcctttgacaggtgggggaagaaactgatcatctgcctcccaggccatgcggtacagggccttgataggccaggagggggatcccgacctgaagctgcccgacttctcctactgcatcctggaacggctaggccggtccagcaaggggagctccagcgagaccttcacaccactgctttcaaggttgatgctgggaagctgcactatcacagaaaaattttgaacaaaaacgggctgattacaatgcagtcccatgtgatccgattacccactggagcccagcaacactcaatcctcctcctactgaaccggtttcatgtggacaggaggagcaaatacgacatcctcatggagaagctttcggtcatgctgagcacacggactaaccacatagagacgctgggaaagctgagggaagagctggggctgtgcgaaaggacgtttaagcgtctgtaccagtatatgctgaacgccgggctagccaaggtggtgtctcttcgcttgcaagagatccaccctgaatgtggaccttgtaagacaaagaaagggaccgacgtcatggttcggtgcctcaagctgctgaaggaatttaaacggaatgaccatgatgatgacgaggacgaggaggtcatctccaagacagtgcctccagtggacattgtgttcgagcgggatatgctcacacagacctacgacctcattgagcgcagaggcacgaaaggaatttcccaagctgaaatccgagtggctatgaatgtgggaaaactagaagcaagaatgctgtgccgacttcttcaaagattcaaagttgtcaagggattcatggaagacgaaggtcggcagcgaaccaccaagtacatttcctgcgtgtttgcagaggagagcgacctaagccggcagtaccaaagagagaaggcccgcagcgagctcttgaccaccgtgagcctggcgtctatgcaggaggagtcgcttctgcctgaaggcgaggacaccttcctctctgagtcggacagtgaggaggagaggagcagcagcaagcggagaggcagagggtcccagaaagacacaagagcctctgcaaacctccggcccaagacccagcctcatcactccaccccaaccaagggtgggtggaaagttgtaaacctacacccattgaaaaagcagccgccctccttcccaggagctgctgaagagagagcctgccagagccttgccagcagggacagcctcttagataccagcagcgtctcagaacccaacgtgtcctttgtctcccactgtgcggacagcaacagtggtgacatagctgtgatcgaggaggtccggatggaaaacccaaaggagagtagcagttccctgaagactgggaggcacagctcaggccaagacaaaccacacgaaacttaccgactgctgaaacgcaggaatctgatcatagaagctgtcaccaatcttcgcttaatcgagagtttattcacgattcagaagatgatcatggatcaggagaagcaggaaggcgtgtccaccaagtgctgcaagaagtccattgtccgcttggtgcggaacctgtctgaggaaggtctcttgcgattgtatcggaccactgtcattcaagatggcatcaagaagaaggtggatctggtggtgcacccgtccatggaccagaacgaccctctagtgagaagtgccatcgagcaggtccgcttccggatctccaattcaagcacagccaacagggttaaaacttcccagcctccagtgccccaaggggaggcagaagaagacagtcaaggaaaagagggcccaagtggatcaggggactctcagctgagtgcttcctctagatcagaaagtggacggatgaaaaaaagtgataataaaatgggcataaccccgcttagaaattatcaccccattgtagttcccggactggggcgttctctaggatttctgcccaaaatgcctcgcctgcgggtggtccacatgtttctgtggtacctcatctacgggcaccctgccagcaacaccgtggagaagccaagcttcatcagtgaacggagaacgataaagcaggagtcaggcagggcaggcgtccggccgtcctcctctggaagtgcctgggaggcctgctctgaagccccatctaaaggcagccaagatggtgtcacctgggaggctgaagtggagcttgccacggagacagtgtatgtcgacgatgcctcgtggatgcgctacatccccccaatcccagtccacagggacttcggctttggctgggctctcgtcagcgacatcctcctctgccttcccctctccatcttcatccagattgtgcaagtcagctacaaggtggacaacctggaggaatttctgaacgacccgctgaagaagcacacgctgatccgctttctccccaggcccattcggcagcagcttctgtacaagaggcgttacattttttcggtggtggagaaccttcagaggctgtgctacatggggctgctacagtttggtcccacggaaaagtttcaggataaagatcaggtctttatcttcttgaagaagaatgcagtcattgttgacactaccatctgcgacccacattacaacctggcccgcagcagccggcccttcgagaggcgcctctatgtcctgaactcaatgcaggatgtggaaaactactggtttgacctgcagtgcgtctgcctcaacaccccactaggcgtggtgcgctgcccgcgcgtcaggaagaacagcagcacagaccagggcagcgacgaggagggcagcctgcagaaggagcaggagagcgccatggacaagcacaacctggagcgcaagtgcgccatgctggagtacaccactggaagccgtgaggtggtggatgaaggcttgatccctggagatgggctgggtgccggctcgattccagcttctacggacacctcaagcgcaactggatctggaccagctacatcatcaaccaggccaaaaaggagaacactgccgcagagaatggacacagtgaggctccagacatttctgtccaagcgcccaatgcccctcagtgccagaggcaacagcaggttgaatatttggggggaagcaagagtaggctccgagctctgtgctggctgggaagagcagtttgaggtggaccgagagccctcgctggaccgaaaccggagagtgaggggtgggaaaagccagaagcggaagcggctgaagaaggaccctgggaagaagatcaagagaaagaagaaaggagagttcccaggagaaaaaagcaaaaggctgcgctaccatgatgaagccgaccagagtgccctgcagcggatgacgcggcttcgtgtcacctggtctatgcaggaggatgggctgcttgtgctgtgccgcattgccagcaatgtcctcaacaccaaggtgaagggcccatttgtcacctggcaggtggtacgggacattttgcatgccacgtttgaagagtctttggataaaacatctcattccgttggacgaagagctcgctacatagtcaaaaacccacaggcctatctcaactataaagtgtgcctggccgaggtgtaccaggataaagcacttgttggagatttcatgaatcgaagaggtgactatgatgacccaaaggtttgtgccaacgagtttaaagaatttgtggagaagcttaaagaaaagttcagttcagccctaaggaattctaaccttgaaatcccagacacactccaggagctgttcgccaggtaccgagttttggcaattggggatgaaaaagatcaaaccaggaaagaggatgaacttaacagcgtggatgacatccactttctggtgcttcagaacctgatccagagcacgctggccctctcagacagtcagatgaagtcctaccagtcattccagactttccgcctctatcgggagtacaaggaccacgttcttgtgaaggccttcatggagtgccagaagaggagcttggtcaaccggcgccgggtcaaccacacgctgggccccaagaagaaccgggccctccccttcgtgccaatgtcctaccagctatcccagacctactacaggatttttacgtggcgatttccaagcaccatctgcacggagtcattccagtttttggacagaatgcgggctgccggcaagttggaccagcctgatcgtttctctttcaaagaccaggataataacgagcccacaaacgacatggtggccttttcactggacggccctggaggaaattgtgtggccgtcctgaccctcttctctctgggcctcatttctgtggatgtcaggatcccggagcagatcatcgtggtagacagctcaatggtggagaatgaggtcatcaaaagcttggggaaggacggcagcctggaggatgacgaggatgaagaggatgacttggacgaaggtgtagggggcaagcgccggagcatggaggtgaaacctgcgcaagcctcccacaccaactacctgctgatgaggggctactactcccccggcatcgtcagcacccgcaacctcaaccccaacgacagcattgtggtcaactcctgccagatgaagttccagctccgctgcacccctgtgcccgcccggctcaggcccgctgccgctcctctggaagagctaacaatgggaacctcctgcctccctgatacgttcaccaagctgataaacccccaggaaaacacctgcagcttggaggagtttgtcctccagctggagctgtctgggtatagtcccgaagacctgactgctgccttggagatcttggaagccattatagccacgggttgttttgggattgacaaggaggagctgcgcagacggttctcggccttggagaaggcaggtggtgggcgcaccaggacattcgcagattgcatccaggccctcctggagcagcatcaggtgctggaggtcggtggcaacactgcgcgcctggtagccatgggctctgcctggccttggctcctgcactccgtgcggctgaaagacagagaagacgccgacatccagagagaagacccccaggccagacccctggaggggtcttccagtgaggacagcccccccgaggggcaggcacctccttctcacagcccccggggcaccaagaggcgcgccagctgggccagtgagaatggggagaccgacgccgagggcacccagatgacccctgccaagaggccagcgctccaggactcaaatttggcccccagccttgggcccggagctgaagatggggcagaagcccaggccccatctccacccccagctcttgaagacaccgctgcagcgggagcagcacaggaagaccaagagggtgtcggtgagttcagttccccaggccaagagcagctgagcggccaggcgcagcctccagagggctctgaagaccccagagggttcacagagagtttcggagctgccaacatctcccaggcagcacgggaaagggactgtgagagtgtctgcttcatcggccggccgtggcgtgtcgtggatggccacctgaaccttcctgtatgcaagggtatgatggaggccatgctgtaccacatcatgaccaggcctggcatccccgagagctccctgctgcgccactaccagggggtcctgcagcccgtcgccgtgctggagttgctccagggcctggagtccctcggctgcatccggaagcgctggctgagaaagccaaggcctgtctcgctcttctctacacccgtggtggaagaggtggaagtgccctccagcctggacgagagccccatggctttctatgagcccaccttggactgtaccctccggctgggccgtgtgttcccccacgaggtcaactggaacaagtggatccacctctaggacccctgtgggcgtcccctccctcccagccaccgcctgccacaccactcctgcctggtgctcggcagaccccactgtgccctggccttgggtctgccgagcctcctgcagcaggggacgggtgctttggccagagtcacagactgacacgtttcccactgtactggaactctggaaagaggggctccccgacctgcccatcccccaggctcttctgggccttccccttgggaactggcctcatcacactgggagttggtgcttcttgtctctgggtctccagagtttgccccgcctgtgcacacctcacattccagactctagccatctcggcaggatctcctggctccttgagtgcccaggtgccaccaagaggaagggccttgtgggatacaccttgcagaatagggatcggtgtgccccgctgcgaggggccccccatgggggctgtggcccctccgcaggcaggacatcccaacccctggctgggactgaaccacccagagcggagcggctcccttttcagccttgtgagtcacctggcaggccccagctgggctggctgtccgtgtccctcagcctggctggtgattccttgcaggccagaaatgaagagtccctgtaggttttggttttgtttgttttattttgttctttcaccttttttcctcattaaaaaaaaaaagtccctgtggagtgtacttatttattttttgattaaagggaagtaaaatgc

SEQ ID NO: 774 - DNA, 3842 bp, Homo sapiens
gcagcgtccctggcgccgctgaagacgccctggaactcggctggcttcggagggctcggtgactctggccgcgctgcattatggaatacagagtctaagagaaaactagcccggcaccgactccggaccaagcacacgtgtttaccttgtgcactggggtgggggcgtcagtgaagagcagctaacaagatttcgtcataagaccgcgaccagacaggcggcgccatcttcgaacttagacttccggaaggactttggcgagggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtggcacttctgtatcttcaggaactggctgaagagctctcaacagccctgcctgcccctgtgtcctgtcctgagggccccaaggtgagcagccccaccaaaccgaagaagatccggcagccagcagcctgtccaggtggagaagaggtggatggtgctccacgggatgaagacttttttctccaggttgaggctgaagatgtggaagaaagtgagggcccaagtgagagctcatctgaacctgagcctgtagtgccccgaagcaccccacgaggatctacttcagggaaacagaaaccacactgccgaggaatggctcccaatggcttaccaaatcatatcatggctcctgtttggaagtgcctccatctcaccaaggacttccgagagcagaaacattcatactgggagtttgctgagtggattcctttagcctggaagtggcacttgttatctgagcttgaggccgctccctacctgccccaggaggagaagtctccattgttttctgtacaacgtgaagggctacctgaagatggcaccctctaccgaataaacagatttagctcgatcacagcacatccagagcgctgggatgtgtccttcttcacggggggaccgctctgggctctggactggtgcccagtgccagagggggcaggagcctcgcaatatgtggctcttttctccagccctgacatgaatgagacacacccactgagccagcttcattcgggtcctgggctgctccagctctggggccttgggaccttgcagcaagaaagctgtcctggcaacagggcccactttgtctatgggattgcttgtgacaacggctgcatctgggacctcaagttctgccccagtggagcatgggaacttccaggcacccctcggaaggctcctctcctgccccggttgggtctcttggctctggcctgctcagacgggaaagtactgctattcagtctaccccatccggaggccctgctggctcagcaacccccagatgcagtgaagcctgccatatataaggtacaatgtgtggcaactctgcaggtggggtctatgcaagctacagacccctctgagtgtggtcagtgccttagcctggcctggatgcctaccaggccccaccaacacctagctgctggatattataatggcatggtggttttctggaaccttcccactaactcacccctgcagcggatacggctctctgatggctccttaaagctctaccccttccagtgtttcctagcccatgaccaggctgtgcgtacccttcaatggtgcaaagctaacagccatttccttgtctctgcggggagtgaccggaaaatcaaattctgggaccttcgacgtccttacgaacccataaactctatcaagcgcttcttgagtacagaactggcctggctgcttccctacaatggtgtcactgtggctcaggacaactgctatgcctcttatggactctgtgggattcattatattgacgctggttaccttggtttcaaggcctacttcactgctcctcgaaaaggcaccgtttggagtctttcaggatccgactggcttgggacaatagctgcaggagatatatccggggagctcattgctgctatattaccagatatggcactgaatccaataaatgtcaagcgacctgtagagcgaagatttcctatatataaagcagatctgataccgtatcaggacagtcctgaaggtccagaccattcttctgcttcatctggggtccccaaccctcctaaggctcgaacttacactgaaactgtcaaccatcactacttgctctttcaagacacagatttgggttcattccatgatctgctccgtagagaaccaatgctgcgcatgcaggagggagaggggcattctcaactctgcctggacaggctgcagctggaggctattcataaggtacgtttcagcccaaacctggactcctatggatggctggtatctggggggcagtcagggctggttcgaatccattttgtccgtggactcgcctccccactgggccaccgtatgcagcttgaaagccgagcccacttcaatgctatgttccaaccatcctcccccactagacggcctggcttctctccaaccagccatcgccttctgcccactccctagccttggcccacaccagatccttggagtgaagtcggtcaagaacaaatggcccctatgcacagagccataggaactgggggccttccctggacagtgatcatgccaggcctggacctttaggcctgcctccccaggactccttagatcccactctttctacagacttctgtgatcacagccccctgcgggcaggggggctctccctccaccaactctcaaggctcctcagcctaagactatggctcatgagaaacactcaggcctgacctaggcttgggagtcaaactgctcatattgagcatattgttaagtgggtaaagccaagtaaaggtactgggtgtttttgtgaccacttgtgaatgggtgtatggagaactgaaaagggtatctgcatgaaggctcctgtctgactattccaggatccaatattactgccttctgaaacttcctctttagggtaaccatcatgtatgcccacgagggtgatagtaattcgtgagactgaagttgcttagagtacttctttgaccaaggaataccacagacaccctaccgatagaacagtggctcagatcttacttgctcctgcttacgaagtattcccaatcactggtcatctgaccctacttgaacactcctgaacagtcatgttttttaaaatcttcctttatatcaagtcagagagtatacttctataaatttcactcatggatgttaggaaatctagtcatcttccctgtgattgccctgttaagtatttaaccatagctatcatgtgtttcccaaatcttctctagattaaatatcttcagttacttc

SEQ ID NO: 775 - DNA, 3992 bp, Homo sapiens
ggtaacgcggaagcctgtgtccgggcgtaggcgctgcatacgtagcgtccctcgaactcggcgaacctacagtagtccttgttagaaaaaccagggctcctctcccgcacaggctaggggagaaatctaccttcacgcccaggactgaagaagggcaggtgatggcccctagagtggttgtgggtcaatctctttcagctgtgtcccagcctcttcctcgaggaggctctttaaccccgagggttgtgccccgcgcgctgcaacgccattggcgtaaccaagggccagttgtgtttccctgtctagtccttttgtcccgtggcaagttggctgcctgttggggaagtcagaggtggcgacttcaactccgtcggaggcaactcactttgttggagggatgtatagggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtggcacttctgtatcttcaggaactggctgaagagctctcaacagccctgcctgcccctgtgtcctgtcctgagggccccaaggtgagcagccccaccaaaccgaagaagatccggcagccagcagcctgtccaggtggagaagaggtggatggtgctccacgggatgaagacttttttctccaggttgaggctgaagatgtggaagaaagtgagggcccaagtgagagctcatctgaacctgagcctgtagtgccccgaagcaccccacgaggatctacttcagggaaacagaaaccacactgccgaggaatggctcccaatggcttaccaaatcatatcatggctcctgtttggaagtgcctccatctcaccaaggacttccgagagcagaaacattcatactgggagtttgctgagtggattcctttagcctggaagtggcacttgttatctgagcttgaggccgctccctacctgccccaggaggagaagtctccattgttttctgtacaacgtgaagggctacctgaagatggcaccctctaccgaataaacagatttagctcgatcacagcacatccagagcgctgggatgtgtccttcttcacggggggaccgctctgggctctggactggtgcccagtgccagagggggcaggagcctcgcaatatgtggctcttttctccagccctgacatgaatgagacacacccactgagccagcttcattcgggtcctgggctgctccagctctggggccttgggaccttgcagcaagaaagctgtcctggcaacagggcccactttgtctatgggattgcttgtgacaacggctgcatctgggacctcaagttctgccccagtggagcatgggaacttccaggcacccctcggaaggctcctctcctgccccggttgggtctcttggctctggcctgctcagacgggaaagtactgctattcagtctaccccatccggaggccctgctggctcagcaacccccagatgcagtgaagcctgccatatataaggtacaatgtgtggcaactctgcaggtggggtctatgcaagctacagacccctctgagtgtggtcagtgccttagcctggcctggatgcctaccaggccccaccaacacctagctgctggatattataatggcatggtggttttctggaaccttcccactaactcacccctgcagcggatacggctctctgatggctccttaaagctctaccccttccagtgtttcctagcccatgaccaggctgtgcgtacccttcaatggtgcaaagctaacagccatttccttgtctctgcggggagtgaccggaaaatcaaattctgggaccttcgacgtccttacgaacccataaactctatcaagcgcttcttgagtacagaactggcctggctgcttccctacaatggtgtcactgtggctcaggacaactgctatgcctcttatggactctgtgggattcattatattgacgctggttaccttggtttcaaggcctacttcactgctcctcgaaaaggcaccgtttggagtctttcaggatccgactggcttgggacaatagctgcaggagatatatccggggagctcattgctgctatattaccagatatggcactgaatccaataaatgtcaagcgacctgtagagcgaagatttcctatatataaagcagatctgataccgtatcaggacagtcctgaaggtccagaccattcttctgcttcatctggggtccccaaccctcctaaggctcgaacttacactgaaactgtcaaccatcactacttgctctttcaagacacagatttgggttcattccatgatctgctccgtagagaaccaatgctgcgcatgcaggagggagaggggcattctcaactctgcctggacaggctgcagctggaggctattcataaggtacgtttcagcccaaacctggactcctatggatggctggtatctggggggcagtcagggctggttcgaatccattttgtccgtggactcgcctccccactgggccaccgtatgcagcttgaaagccgagcccacttcaatgctatgttccaaccatcctcccccactagacggcctggcttctctccaaccagccatcgccttctgcccactccctagccttggcccacaccagatccttggagtgaagtcggtcaagaacaaatggcccctatgcacagagccataggaactgggggccttccctggacagtgatcatgccaggcctggacctttaggcctgcctccccaggactccttagatcccactctttctacagacttctgtgatcacagccccctgcgggcaggggggctctccctccaccaactctcaaggctcctcagcctaagactatggctcatgagaaacactcaggcctgacctaggcttgggagtcaaactgctcatattgagcatattgttaagtgggtaaagccaagtaaaggtactgggtgtttttgtgaccacttgtgaatgggtgtatggagaactgaaaagggtatctgcatgaaggctcctgtctgactattccaggatccaatattactgccttctgaaacttcctctttagggtaaccatcatgtatgcccacgagggtgatagtaattcgtgagactgaagttgcttagagtacttctttgaccaaggaataccacagacaccctaccgatagaacagtggctcagatcttacttgctcctgcttacgaagtattcccaatcactggtcatctgaccctacttgaacactcctgaacagtcatgttttttaaaatcttcctttatatcaagtcagagagtatacttctataaatttcactcatggatgttaggaaatctagtcatcttccctgtgattgccctgttaagtatttaaccatagctatcatgtgtttcccaaatcttctctagattaaatatcttcagttacttcaaccatt

SEQ ID NO: 776 - DNA, 828 bp, Homo sapiens
agcgtccctggcgccgctgaagacgccctggaactcggctggcttcggagggctcggtgactctggccgcgctgcattatggaatacagagtctaagagaaaactagcccggcaccgactccggaccaagcacacgtgtttaccttgtgcactggggtgggggcgtcagtgaagagcagctaacaagatttcgtcataagaccgcgaccagacaggcggcgccatcttcgaacttagacttccggaaggactttggcgaggagacaaagtcttgctgtgttgcccaggctgatcttgaactcctggcctcaagcgatcctcccaccttggcctcccaaagtgttgagattacaggcatgagccactgcgcccagcccagcacatgattcttgagccagcagctgtaaataagagcaccttcccagtttgataagcacttgttcctaccaactgtttttccctcaaccctcatcgtgatcatttatttatgcaagtgtttttcagcttgagtgtgcgtcagaatcccctgaagagcttgttaaaacacaaggtgctggccccatccagaattgctgattcggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaag

SEQ ID NO: 777 - DNA, 557 bp, Homo sapiens
cttagacttccggaaggactttggcgaggtccttttgtcccgtggcaagttggctgcctgttggggaagtcagaggtggcgacttcaactccgtcggaggcaactcactttgttggagggatgtatagggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctct

SEQ ID NO: 778 - DNA, 4282 bp, Homo sapiens
tgctggccccggcgaggtagcttctggaaggcgctgctcttccggttctctgtcccggttcctggggttgcacagacagaccctgtaaacatgtcagggttcagtccggaactcatcgactacttggaagggaaaatctcctttgaggagttcgaacggcggagagaagagagaaaaacccgcgagaagaaaagtcttcaggaaaaaggcaagttatcagctgaagaaaatcccgatgactctgaagttccatcatcatcaggaattaactctaccaaatcccaagacaaagatgtcaatgaaggagaaacatcagatggagtgaggaagtcagttcacaaggtctttgcttccatgcttggagagaatgaagatgatgaggaggaagaggaagaagaggaggaggaggaggaggaggaagaaacacctgagcaacccactgcgggcgatgtatttgtattggagatggttctcaatcgtgaaaccaagaaaatgatgaaagagaaaaggcctcggagtaaacttcccagagctctgagaggtctcatgggtgaagccaacattcgttttgctcgaggagaacgtgaagaggcgatattgatgtgcatggaaatcataagacaagctcctctggcttatgagccattctctactctagccatgatatatgaggaccaaggtgacatggaaaaatcattgcagtttgagttgattgctgcgcatttaaatcccagtgacacagaagaatgggttagactggcagaaatgtctctggaacaagacaatattaagcaggctattttttgctatacaaaagctcttaaatatgaacctactaatgtccgttatctgtgggagcgatcaagcctttatgaacagatgggtgatcataaaatggccatggatggttataggcgtattttaaaccttttgtctccatctgatggcgaacgttttatgcagctggctagagatatggcaaagagttactatgaagccaatgatgttacttctgctattaacataattgatgaagctttctcaaaacaccagggcctagtctccatggaagatgttaacatagcagctgaactatatatttctaacaaacagtatgacaaagctttggagataattacagatttttctggaattgtgctggaaaaaaaaacttcagaagaaggcacctcagaagagaataaagctcctgagaatgttacctgcactatacctgatggcgtgccaatagatatcacagtgaagttgatggtctgccttgtacatctcaacattcttgaaccacttaatcctctcttgacaacactagtagaacagaatcctgaagatatgggagacctatacctagatgttgctgaagcttttctggatgttggtgaatataattctgcacttcccctcctcagtgctcttgtttgctctgaaagatacaaccttgcagtagtttggcttcgtcatgcagaatgtttaaaggccttaggctatatggagcgagctgctgaaagctatggcaaggtggttgatctggccccactccatttggatgcaaggatttcactttctacccttcagcagcagctgggccagcctgagaaagctctggaagctctggaaccaatgtatgatccagatactttagcacaggatgcaaatgctgcacagcaggaactgaagttattgcttcatcgttctactctgttgttttcacaaggcaaaatgtatggttatgtggataccttacttactatgttagccatgcttttaaaggtagcaatgaatcgagcccaagtttgtttgatatccagttccaagtctggagagaggcatctttatcttattaaagtatcgagagacaaaatatcagacagcaatgaccaagagtcagcaaattgtgatgcaaaagcaatatttgctgtgctcacaagcgtcttgacaaaggatgactggtggaatcttctgttgaaggccatatactccttatgtgacctatcccgatttcaagaggctgagttgcttgtagattcctcattggaatattactcattttatgatgacaggcaaaaacgcaaagaactagaatactttggtctgtctgctgcaattctggacaaaaatttcagaaaggcatacaactatatcaggataatggtaatggaaaatgtcaataaaccccagctctggaacattttcaatcaagttaccatgcactcccaagatgtacgacatcatcgcttctgtctccgtttgatgctgaaaaacccagaaaatcatgccctatgtgtcttaaatggacacaatgcatttgtatctggtagttttaagcatgcgcttggacagtatgtgcaagcctttcgcactcaccctgacgaacctctctatagcttctgtataggcctaacctttattcatatggcatctcagaagtatgtgttacggagacatgctcttattgtacagggcttttcctttcttaatcgatacctcagtttacgtgggccctgccaggaatcattctacaatttgggccgtggccttcatcagttggggctgattcatcttgcaatccactattatcagaaggccctggagctccctccacttgtggtagagggtatagaacttgaccagttagacttacgaagagatattgcctacaacttgtctctcatctatcagagcagtgggaataccggaatggctcaaacgcttttgtatacctattgttctatataaagcaccgcaactgagaacagagcaatggcagctgctgtgtgaggaccagtgtcttctgtctcagggcttattatttgtaactccaaaatagaaatgacaatttcagaattacctaacaaacagtgtatttatttttaatatgtgataatgatcttgtggtatatatgcaaaattattcctacaaaaatttgtatattggtctgtcattttcctttcacattctatagtgaattgttcccaatgttgaaatggacgtgtaagcctttgagctagcttggagtcgaatacactatttttcactcacaccatttattcatctttgtatttaatactatagctctgtcaatatcacatgaggcagtttttcaaatacgtataaacagaggttgcttattattaaaggaaagacaaagtgggactctttatgatgtcatgaccatgataactaagcacctaagaaaattatttaaaatagttatgtggtaggcagaaagacaaataatttagttttttacttttcaccagcatgtatcttagctacctaaactgaaacatgggaggctgggcttaattcaaaatatattgctccaaggcaaataaaaaaatgctttatctatatttgtggctttctgatgaaaaaatagagaagagcttgttcaataacaggacatggtttccatttcaagatcacaagtaatataagactgggcaagtagtacgtatggaataaaggacatactgctgattgataaagtaaaaaactttttttttgtttgtttactcatctccactatttattatatgttcttgaatttaagttaacagtactttttagatgatatactgttagcttaataacaactttttagggaaaaataaatgctgtaattaatgtgcacatgggttagtaacacccagcccaattgtgggagggaaacaagtagaggcttaggatcaaagaaataaaattgggacttattagaaattcttaccactgtttctactgtacacaaaactttctagttgagcagaatttgtatgcaataagtaaatatattgtatactccatgtgtataatttaaatgcattttatttttataattgaggttaactgtttcacatgcttaatttttactttatgccatttataggtaatggtagaggtaactgagatacagtaataagttagacttgtgtgttggaattctgtggaactgagcattctgtgctccgagtttctctcttaaattagctcactggactgtggctccagtgtctactaaatagccgtggaggaaataagtctccctaagggaaaaaaaaaccagctgatattgtatagttttgtttagcttttaaaatcatagcttccatttgctgagtttttactctgctactgtatgctaagtatggtgctaaacactttggatatgttatctctgattctctcagggaactgcaaggtagttattattgatattgtcatcaccactttgtatctagagattaaatagcatgttcaagatcacta

SEQ ID NO: 779 - DNA, 1736 bp, Homo sapiens
cggttctctgtcccggttcctggggttgcacagacagaccctgtaaacatgtcagggttcagtccggaactcatcgactacttggaagggaaaatctcctttgaggagttcgaacggcggagagaagagagaaaaacccgcgagaagaaaagtcttcaggaaaaaggcaagttatcagctgaagaaaatcccgatgactctgaagttccatcatcatcaggaattaactctaccaaatcccaagacaaagatgtcaatgaaggagaaacatcagatggagtgaggaagtcagttcacaaggtctttgcttccatgcttggagagaatgaagatgatgaggaggaagaggaagaagaggaggaggaggaggaggaggaagaaacacctgagcaacccactgcgggcgatgtatttgtattggagatggttctcaatcgtgaaaccaagaaaatgatgaaagagaaaaggcctcggagtaaacttcccagagctctgagaggtctcatgggtgaagccaacattcgttttgctcgaggagaacgtgaagaggcgatattgatgtgcatggaaatcataagacaagctcctctggcttatgagccattctctactctagccatgatatatgaggaccaaggtgacatggaaaaatcattgcagtttgagttgattgctgcgcatttaaatcccagtgacacagaagaatgggttagactggcagaaatgtctctggaacaagacaatattaagcaggctattttttgctatacaaaagctcttaaatatgaacctactaatgtccgttatctgtgggagcgatcaagcctttatgaacagatgggtgatcataaaatggccatggatggttataggcgtattttaaaccttttgtctccatctgatggcgaacgttttatgcagctggctagagatatggcaaagagttactatgaagccaatgatgttacttctgctattaacataattgatgaagctttctcaaaacaccagggcctagtctccatggaagatgttaacatagcagctgaactatatatttctaacaaacagtatgacaaagctttggagataattacagatttttctggaattgtgctggaaaaaaaaacttcagaagaaggcacctcagaagagaataaagctcctgagaatgttacctgcactatacctgatggcgtgccaatagatatcacagtgaagttgatggtctgccttgtacatctcaacattcttgaaccacttaatgtatgtaacaagatctgcacttgagatacttcagatcaaatgcaccatctcttttctttagatgtcaagaaattataacttgaccctagagtttcacatttcttaataaccaaggaggtaacaataagcatcaaataattttgtatgaatatcttataaaaactaaaattgttttgcaattgggcttacagtaatttatttttcttttaaaataacaatctaaagatcataatttgagattgtctttagaccatttgagattgtcattagataattggtaataattctgacagctattcttttttgcggactttggaccaagtatattattgaaaaaaaaaaagtacttagcatctactttgtaaaccttaggataagatattgagtaaaatatacaaatccataccctcatgggttgggatgcttttttgttttaatgggattagataataaaataaatacataacata

SEQ ID NO: 780 - DNA, 9043 bp, Homo sapiens
cttccgggtccggaacggctccagctgtacggactcgtcccgaggggagccggggacggcggcaccgggcgggtagggacaagactaccgcgcgtgcccccgcctggtggcagcccctctctgcgtccctcgcggcctggcaaaattacattcggccgagagttcacgctggggaagctctctgaatgcctctgagaagcgagatccggcgccatctcaccgacgagcctcccctttaccgccccgtgcgtttcctcagcactttaggaactaaagcctgtctgggtagctccctaacaggctctggagctcaatccctgggcagggaaaagggggtcctcggggctccccgctcgctgtcctttttctggacaggcagttccttggccacctggtagggccgcgttgcctggcaacggcggggtccttcttggctcggcggcgctcggggcctgaggggagaaaaccgccgcggagggcgctgggggtggcggcggcggtccgggaggtggtcgcgcgactgcgtggagcgccagggcgtccgacctctgcacctgagagaagatgaacacggccgaccaggcccgggtggggcccgcggacgacgggcctgcgccgtctggggaggaggagggagaggggggcggcgaggcgggcgggaaggagccagcagcggacgcggccccggggcccagcgctgcattccgcctcatggtgactcggcgggagccggccgtgaagctgcagtatgcggtgagcggcctggaaccgctggcttggtccgaggaccaccgcgtgtctgtgtccacggcccgcagcatcgctgtgctggagctcatctgcgacgtgcacaacccgggccaggacctggttatccaccgcacctcggtgcccgcaccgctcaacagctgtctcctcaaagttggctcaaaaacagaagttgctgagtgcaaggagaaattcgccgcctccaaggaccccacggtcagtcagactttcatgttggatagggtgttcaaccctgaggggaaggctttaccaccaatgagaggattcaagtacaccagctggtctcccatgggttgcgatgctaatggcaggtgcctcttggcagcactgaccatggacaatcgcctgaccatccaggcaaatctcaacagactgcagtgggtccagctggttgacctgactgagatctatggagaacgtctttatgagaccagttacaggctctctaaaaatgaggccccggaaggaaatctcggggattttgctgagtttcagaggagacacagcatgcagaccccagtcagaatggagtggtcgggcatctgtaccacccagcaggtcaagcataacaacgaatgccgggacgttggcagtgtgctcctggctgtcctctttgaaaacggtaatatcgccgtgtggcagtttcagctgccgtttgtaggaaaagaatccatctcttcatgcaacacaattgagtcaggaatcacctctcccagtgtattgttttggtgggaatatgagcacaataatcgaaaaatgagtggccttattgtggggagtgcttttggacccataaaaattcttcctgtcaatctcaaagcagtcaaaggctatttcactttaaggcagcctgttatcttgtggaaagaaatggaccagttacctgtgcacagtatcaaatgtgtgccactttatcatccttaccagaagtgtagttgcagcttagtagtggctgcaagaggctcttatgtattttggtgtcttcttctgatctccaaagcagggctgaatgttcacaattcccatgtcacaggccttcactcactgccaattgtctccatgactgcagacaaacagaatggaacagtctatacttgctccagtgacggaaaggtgaggcagctgattcccattttcacagatgttgcattgaagtttgaacaccagttgattaaactctcagatgtgtttggctcagtgaggactcacgggatagcagtgagcccctgcggtgcatacctggccatcatcaccactgagggcatgatcaacggcctccaccctgttaacaaaaactaccaggtccaatttgttactctcaaaacctttgaagaggcagctgctcagctcctggaatcttcagttcaaaacctttttaagcaggtagatttaatagacctagtacgctggaagattttaaaagataaacatatccctcaatttttacaagaagctttggaaaaaaagattgaaagcagtggagtcacctatttttggcgttttaagcttttcctcctgaggattttatatcagtcaatgcagaaaaccccttcagaagccttgtggaaacccacccatgaggactcaaaaatcttactagtggattcgcctgggatgggcaatgctgacgatgaacagcaggaagaaggcacttcttccaaacaggtggtgaagcaaggcctgcaggagaggagcaaggaaggagatgtagaggagcccactgatgactcgctccccacgactggagatgctggaggccgtgagccaatggaagagaaactcctggaaatccaagggaaaatcgaagctgtggagatgcacttgaccagggaacacatgaagcgagtcttaggagaagtgtatctgcacacctggatcacagaaaacactagcatccccacccgcggactctgtaactttttaatgtctgatgaagagtatgatgacagaactgcacgggtgctgattggacatatctcaaagaagatgaacaaacagactttccctgagcactgtagtttgtgtaaagagatcttgccattcacagatcgcaaacaggcagtctgttccaatggccacatttggctccggtgcttcttaacctaccagtcctgccagagtttgatatatagaaggtgtttgctccatgacagcattgcccggcatccagctccagaagatcccgactggattaagaggttactgcaaagcccctgccctttctgtgattctcctgtcttctaaataatcagtgacgggaagatggaagggcatgatgaactctgccatagaaaacttcctccagcctgaagagaaggatgcactggaggaagccggaccctcacgagtggagagaagtccttggtgattgtaaagagggcccctggagctcatttctgaatcgcactctccatttccagagactaaaggatgtcctttgaaatggctggactcagagagttggagtcgttttgagatgagcattagccccagctttgtaaccaatgaggaacacttacttatttttaagtatcttgacagaagcaatttgaacacagtgtcccgtcatttctagaaacagaatggtctcttctagagagcttggataaggaccttgctgggttgagttaggttttaatccttgctttggtttggaactgccttcgggctccagaacttaaattgcttggtccgtggcatctgatgtaccaacagagattaaaagtgtaaagcaacacatgggctgatgttttgttctcagaaaatagctgctggtctgcatccctccattcttgttttttatgcatatggaaaacattttcctaaaactctatattcttaagttgaagccaagactaaaatttaatgtgtcaaatgatctggtgactattataatgaataattgtgacttatttttcattctctcctgggtcatcaggtttcctgacccaactccttaatccgtataaagatgtcaaatactgtagttcacccacgccacagccctgcttcagacttaactgtggtagcctagatgagctatttgtacacagaggaaaaaaagatattttcctcttttagtaataagactttcagtatttttaatgttgacatttccagatgtttcatttagtatccaggggtctgtctggagacttctagagagggacagctcagaagtgagacccttgagctctggtgctgtaagcttgtgcaattaagttgaacagagcctgggaatttctttcctctgcacagtcccttgatatttggaatccaggttctgcccccaacccctacccacccagtggtctgttaagatgtctcagatggggctgggcttggtggctcatgcctgtactctcaacactttgggaagcaaaggcaggcagatcacaaggtcaggagttcagcctaaccaacatggtgaaaccgtgtctctactaaaaatacaaaaattagccaggcgtggtggtgcacacctgtaatcccagcactttgggaggccgaggcagacgggtcacttgaggccaggagttcgagaccagcctgggcaatatggcgagactccgtctctactacaaatacaaaagttagcctggcatggtggcgcatgcctgtaatctcagttactcaggaggctgaggcaggagcatcacttcaacccaggaggcagaagctgcagtcagccgaggtggcaccactgcacttcagcctgggcaagactggagactgcctcaaaaaaaaaagaaaaaaaatgttggtacttagatgataccatgacggcaacctccccacccccaccccgcattgataggtagtgcagaccagcccttggaggcacttctaaacagtctgctcagaaatgttttctgtttcctattcaaattgctgttttgtctcctatgtttaatcatgtatttgctattctgcttatttttctcatttggtggtaatttcaagaagagcgtttatccactattgattttcaagaaagaaaccaagcagcattgaaatcatgagtaacagaattcagaacattgtatggtggaagtcatttgtgtctgcagctgttttttcactttacaataaataagagtaaaaattgagatcatgtcaaaaaattattgcagttttaatcattatggcatagtttcacttcccctccccccattagaatcagtggagatttgttcttactagggaattttggactgctgccatttaaaacttaggtttttatttaaagcagttgtgcatttttgagaaaatgtattgggagtaactagagaggatctcccaaatttttttgtatgtctctctaggagtaaacatggcaacagtttttctagaacgtggactcactgcagggactggacccaatggcattgttaagaccctaaaatctagccaccacctgcctcccccaggtttccacacacccagttggaaggcctttccctgcccttgtccctgtctcacacccatggaggttaagctacagagctggggaaacaggagattttgagttaatggcagcctcacaaatagtgcttctgaatttctctgagggtcagcatacctcatgggagtgtgttgctcagtgcaaccttggaaaagtgggaatggcaccagacgtttttcaggtgcctcttgcaattcaaacttacatcctctataccgtcctaaaatttgcctgatcttatttggtagatttcaagttgctttcagctgtgaccgtaataactgtttcaggaactggagaaatagtggaagtgctattgccgcgctgcatgtaaagcacaggagcaaagattcgatacaattagaccctttaagctacaacgtggttgcatttggggagtctgatacccacataggtatcacattttctctgcctggggttaatttgttcttattattctaggtaagaaattgatagcttgttatgcttggtactcattctgaaatccctgtgtgtccaccaggcagacttcaagcaatctctacctactattatatctgccaaaactaccaattatttttcaatgtcagaagttattagagccactggcaaagctcatggttgaatatgacatttttctgcttttccctctaagaagtttttgagaatgttaatgttgaagtatgcaggctggacctaccagcaagtttaacacgttaattaggttaaaaagaatattaaaaggcaataattaaatatttcaattattttgtaattataatggtatcaaataagatgcaaaagaagttgatgcttattggtgcttaagagaattacaatactggttttatgagcatcttttctctgcaacagttaaactgcctcagagtttgtgaattgctgcaattcctggaatggaaacaggaattagggtcactggttgattggcacaggatctttccatcgtttctgctcctgacctctctctcttgcctttccttcccccagacaccctcttggtttccattcctttagttccctctgctttagaacacagattacatgttggaaagaaaaatggattaatggtaaaatttctaaaagctaaattgtacagtggggtctcacttcctagaagaaactattggtaatatttctttctaaaggtaatagtattaattgtatctggttttcttcaaaacttaactataatttccttgtcagggtgctcagtagctcttggtttgactttgggctaagggatgtgaaattttagctccttcccaccacctgtttcccctcactcccacccccagccaatattcttcataagcaaaaattatggttaagctaagctgaatgggttatattcaaagtaagtacagacggcaaataggcagacaaatacaggaatgtctttacaattagcccaccatggactgttttgagtctctgcatggtttccataattcattatgatgtatctttatgctctttcactgctcttctgtgcgttggagtttagcaattcagtgagactggggagtgtctcaagaatggaacctttgccttcaaggttgggtcatcaaaaatccctctaaaggatctaactgtaatgaactgtttttatttttgccattagtgcaagtatcaactggcagcctcaaacagctttagactatgtctcaggtctctcatagttatacttagaactgctctttcttgaagctaaaagaggtttttggagtaaagatctgcttcatgtctgctagcatggtatctgctgttcaacctagtatagagcatgtgaaatgcaactgtcctttaatggaattcagccaaactccaaaaatactgagttgcttctagttatctaaagtagtacagaatcactatcccgatgaagaagtggggtttttcagaagattgtaaactcatttccatggcacagatacaaatcatcgtcaggacttgttagccagtccatgtctcattgataggatgtagcctgccatctgcatagatggtttaacatggtgctgtttttgaaaacttgctgtggaaataaatttgacagacgagtagttatttgtaaagctgtcctagaaagaggttaattcttttggtatatgaatatttctcctccaatccttttaattaggtggttcagcttatcttgtattttctgagtcataactatactctagggccaagacctactataaaatctggggtcctaaccagagagttgtttagatcaatatgatatgctttgccaacatgatctaagaaggtattcattctttctgggtttgagaagagttgacgaaagtgtaagattatactctcatgctaaaataaggtataggctaagtgaaatactgtaaatgggttggttagaattaaagtttagaactctaaatcttatgcttatttttaaagtaaaaagttgcctcactgtcatgaaatcctgttactttcattaaaaaaaaaaatcctgtaaaatggtcaaattggataatgtaagagataatgatggctttgaggcatttcatactttaccagtttacatttggctagcagactggtaaggtttagggttctctccactaatggaaaattaaatgctaaacgtcctaagaattatgttgttttcaaggctttgactcagatttgtactttgatgtatgaaagtgaatatcaaacttgtttatagaaaagactatatagaaaaataagtctgtgttgtgtatagtgatacatgttttatgtttacccaatgcctgtactaaatcttgtgcttggctttgaattatatatgtgtttacctatgacttttttttgaaataaacagaacagtcatctaaaaacataaggttttggaaaggagatgctttttcaattcttaccatctgattaggtggaatgttttatagacttttggtgttgaaaaaaaaaagtttgataacaatgcattttgcttggaataccccccaatccagaaaagttggtgacttctctccattgtatatatgtacatagttttcattactagattgtaagctcctcaagggcaggaattgttttatctttgttgttcctgcagcacctaatgtaaagtgccttgcacagggtaggtgctcatgacgtgtagaatgagtgagtaacttcctgcctcatcaggatgaaatgtggttcacttcccctgtgttcaacactacaaagctactcctgccagaagagggcagagttctttcttgggtttgaactggcttttttgggttgaaccagatcatcccacatccttagcactacttaaccttcttttcctgaagattacatatcagtgtcctgcgtttttatctaatattagagctgaggttcctaggaaaattttgaagtggggaagattatggagaaaatgaaatggaaatttggggagggtggtttgtcagtataaggccctgtggggtaatcatattttagttattacttgttaaaagggtaacagaacctctgtttctttaccaagtcgctggttggccatttctccaattgatgaactaccattggttttagctctttctcatttgggattcccctcaattgcttacatgattctggtacttagagtctaatagagttgctgtgaatatgtagtgctgtacataatggcagttttgtaaatgtgagataaccttgaatatgttgtggtttgtatacagagccattagtattgttattttggccacttttttattcaaaataaataacataattatttgtata

SEQ ID NO: 781 - DNA, 1903 bp, Homo sapiens
gcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcaggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcacctatggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggtcagccttcagacactgagggactctgtctacatcttccgggaaggggccttgccaccctatcggcagatgttctaccagttatgcgacttgaatgtggaagagttgcagaagatcattcaccgcaatgacggggcagagaattcctgcacagaacgggatgggtggtgcctccccaagaccagcgacgagctcagggacaccatgtccctcatgatccggcagaccatccgctccaagaggcctgctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagcgtggggagcctcgcccatggtctcacgtggcaagaagtgcctttagctctggatcccaaccgtttggcacagctttggccacagccaggcccctctggaattgtccttattaaaccagtttcccgag

SEQ ID NO: 782 - DNA, 1263 bp, Homo sapiens
agacgcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcaggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggtcagccttcagacaacatctggcgaagaggtggtgacaagtctcagggaagtctggcaccagcagctgcatgtggttgtccttctcgagccctttgggagcctgggcccccactga

SEQ ID NO: 783 - DNA, 1777 bp, Homo sapiens
agacgcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggtcagccttcagacactgagggtgagaactcgggtgcaaagccccagggctgtgtgtgttggggacatctggcgaagaggtggtgacaagtctcagggaagtctggcaccagcagctgcatgtggttgtccttctcgagccctttgggagcctgggcccccactgagccacgtgaccactccgggaatgatcggaattgggcacacacaggaggacagagccagagcaggccatgtgggctgcagctgtggcaggagcctcactggctcacgtttccgtcagtgcggttgcccagcgggggttggcggtttccagagctgttcccacattcaggctcccgcaagccgctccacagccctgggggaggccgagaagggggcatcccgcacggtggaatcacctgctgagggagtgggtggcagagatgagtgcagcagagacgggtgatgcgagggacttgctgtcccccagtgtctggggccctgcctattttctaggttttttagacctttgctgccttcccagtgaggggcgatcatgccacagcctgtgcggccttccttctcgaggcctctcctaggaggccgttatccttactctagaactacatggctgggtacggaaaggagagagcaaacactcactaagccctgcttttcccagaaaagatgtcagggcagcccatagggggacatagggtgacaaattagcagcagtgggtgagggataaggtcagagtgcaggagggcacagagagcagagcccggcacaaggctagtgccagccccatgccatgggcgccatggcctgctgcacgg

SEQ ID NO: 784 - DNA, 2404 bp, Homo sapiens
gaagtcgagggaggtttgtgtcttattatcctccgggtccctcgctggctagtaggagagactggtgcttgccccgcccggtggactaactcgcttaattttaaataaaaagtcgaggacacggcggtcgttttcccgaagacatgggccctcccatgggccatttgctccctggaggccctcgcgtcttgctgagcccggggagttaggatgacgcgagcggtgagggagcccggaacgattccttcgcggaacaattgaggcgaggcctttgggagtactttgtgggacggaccctggcgggccctgccagacgcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcaggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggactctgtctacatcttccgggaaggggccttgccaccctatcggcagatgttctaccagttatgcgacttgaatgtggaagagttgcagaagatcattcaccgcaatgacggggcagagaattcctgcacagaacgggatgggtggtgcctccccaagaccagcgacgagctcagggacaccatgtccctcatgatccggcagaccatccgctccaagaggcctgctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagcgtggggagcctcgcccatggtctcacgtggcaagaagtgcctttagctctggatcccaaccgtttggcacagctttggccacagccaggcccctctggaattgtccttattaaaccagtttcccgag

SEQ ID NO: 785 - DNA, 2066 bp, Homo sapiens
agacgcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggatctacgcagacccccccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcaggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggactctgtctacatcttccgggaaggggccttgccaccctatcggcagatgttctaccagttatgcgacttgaatgtggaagagttgcagaagatcattcaccgcaatgacggggcagagaattcctgcacagaacgggatgggtggtgcctccccaagaccagcgacgagctcagggacaccatgtccctcatgatccggcagaccatccgctccaagaggcctgctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagcgtggggagcctcgcccatggtctcacgtggcaagaagtgcctttagctctggatcccaaccgtttggcacagctttggccacagccaggcccctctggaattgtccttattaaaccagtttcccgag

SEQ ID NO: 786 - DNA, 2110 bp, Homo sapiens
gcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcaggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggtcagccttcagacactgagggactctgtctacatcttccgggaaggggccttgccaccctatcggcagatgttctaccagttatgcgacttgaatgtggaagagttgcagaagatcattcaccgcaatgacggggcagagaattcctgcacagaacgggatgggtggtgcctccccaagaccagcgacgagctcagggacaccatgtccctcatgatccggcagaccatccgctccaagaggcctgctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagcgtggggagcctcgcccatggtctcacgtggcaagaagtgcctttagctctggatcccaaccgtttggcacagctttggccacagccaggcccctctggaattgtccttattaaaccagtttcccgag

SEQ ID NO: 787 - DNA, 622 bp, Homo sapiens
agccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggtcagccttcagacatctggcgaagaggtggtgacaagtctcagggaagtctggcaccagcagctgcatgtggttgtccttctcgagccctttgggagcctgggcccccactgagccacgtgaccactccgggaatgatc

SEQ ID NO: 788 - DNA, 736 bp, Homo sapiens
gaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggtgggcgcccctggaggccaggaatggaggggaggacttccctcttggggccgggcaccttgtgggtgacacctggggggctgtgattagggcagctctgcccaccggggcctcggcaccttgcttccttttaggtcagccttcagacactgagggtgagaactcgggtgcaaagccccagggctgtgtgtgttggggacatctggcgaagaggtggtgacaagtctcagggaagtctggcaccagcagctgcatgtggttgtccttctcgagccctttgggagcctgggcccccactgagccacgtgaccactccgggaatgatcggaattgggcacacacaggaggacagagccagagcaggccatgtgggctgcagctgtggcaggagcctcactggctcacgtttccgtcagtgcggttgcccagcgggggttggcggtttccagagctgttcccacattcaggctcccgcaagccgctccacagccctgggggaggccgagaagggggcatcccgcacggtggaatca

SEQ ID NO: 789 - DNA, 823 bp, Homo sapiens
ggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctcc

SEQ ID NO: 790 - DNA, 920 bp, Homo sapiens
ttattatcctccgggtccctcgctggctagtaggagagactggtgcttgccccgcccggtggactaactcgcttaattttaaataaaaagtcgaggacacggcggtcgttttcccgaagacatgggccctcccatgggccatttgctccctggaggccctcgcgtcttgctgagcccggggagttaggatgacgcgagcgatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcaggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatg

SEQ ID NO: 791 - DNA, 4191 bp, Homo sapiens
atgcgccctccgtcccgcgctttgttgcgaaagcgagggggcgaggtgctgcggtgctagagcgcggcgcgaccggacgctgcgggcggggaagaggatggagactgtggcgtccgctgcaacggttggggctgcgcgtgagaaggtggcggtgtaggcacctgcgctcggggaaggctggcggcggcggccgagccatggcgggagacccccttctctgggctccctgaagtctcggggagccgtgacccatgggatcgttgagcagccgggtgctgcgccagccaagaccagcccttgcccagcaggcgcagggtgccagggcggggggctcggcccggaggccggacactggagacgatgcggcgggccacggattctgttactgtgcgggcagccacaagcgcaagcggagcagcgggtccttctgctactgtcaccctgactcggagacggacgaggatgaggaggagggggacgagcagcagcggctcctcaacacccctcgaaggaaaaaattaaagagtacatctaaatatatttatcaaacattatttttgaatggtgaaaacagtgacattaagatttgtgctctaggagaagaatggagcttacacaaaatatatttatgtcaatctggctacttttctagtatgttcagtggttcttggaaagaatccagcatgaatattattgaactggagattcctgaccagaacattgatgtagaagcactgcaggttgcatttggttcactgtatcgagatgatgtcttgataaagcccagtcgagttgttgccattttggcagcagcttgtttgctgcagttggacggtttaatacagcagtgtggtgagacaatgaaggaaacagttaatgtgaaaactgtatgtggctattacacatcagcagggacctatggattagattctgtaaagaaaaagtgccttgaatggcttctaaacaatttgatgactcaccagaatgttgaactttttaaagaactcagtataaatgtcatgaaacagctcattggttcatctaacttatttgtgatgcaagtggagatggatatatacactgctctaaaaaagtggatgttccttcaacttgtgccttcttggaatggatctttaaaacagcttttgacagaaacagatgtctggttttctaaacagaggaaagattttgaaggtatggcctttcttgaaactgaacaaggaaaaccatttgtgtcagtattcagacatttaaggttacaatatattatcagtgatctggcttctgcaagaattattgaacaagatgctgtagtaccttcagaatggctctcttctgtgtataaacagcagtggtttgctatgctgcgggcagaacaggacagtgaggtggggcctcaagaaatcaataaagaagaactagagggaaacagcatgaggtgtggtagaaagcttgccaaagatggtgaatactgctggcgttggacaggttttaacttcggcttcgacctacttgtaacttacaccaatcgatacatcattttcaaacgcaatacactgaatcagccatgtagcggatctgtcagtttacagcctcgaaggagcatagcatttagattacgtttggcttcttttgatagtagtggaaaactaatatgtagtagaacaactggctatcaaatacttacacttgaaaaggatcaggaacaagtggtgatgaacttggacagcaggcttctgatcttccctttatatatctgctgtaacttcttgtatatatcaccagaaaaaaagaattgaaaataatcgtcacccagaaaatccagaaaactgaagatttcatcagttggaaacagtagcactttgaaaactttttaggccagctttaatttaatggccctactgatattcacatcgaaggtgactaacaatgacaaaggccttatgaactgtacagacaatacagaagattattcttatcctcattgcatttctatgcatatgcgtaagaacattttaaagccaagaaaatatctgtcaaaccatttctgttagaacgatgtcaattcatgcttttaatttagcatcaatagaaaattgctgtaggtaaatctcacatttatctgcaacaaaatatagatttaatttttagcttaaactttgtttctaccttatgttagtggacctcagttatccatctgtaaatttctttttatttggctaaaataatctaaaagaataatttggttggccaattagaaatgcctttttcagttggtgtattgaaagctttcctttaacattttcacctgctcattgtgattcctccttttagtctaatatctttccaggtcatacttgtttttaatcattaaatattttcttcctggttttggagactaagctgataaactttttttaaaacttaagcattgtcattgctattttttttaatttgactttcctaggagtttaagaacagtgaaagttagctttgcaccttcaaatgatcttgaatgagggaaaaatcagtttgattccaaggatatttcttgccttacatggtcttttctttgacagtctgtacacctttattattaggttttgaattatttatgtaccagatattatagttttaaacattttaatattctctgatctttagaattatttatgttcaaattttagttgggaactttgtttcctacttaagctcaggactttttaccctctgaattgagtgcctttgagtgacacatgctaatagaaatttcatagtaaatgtaaataaggtcagaggatgtaatatggagcctgatgatgaagcattaatgtaaaaatggaacttatttttgtcaaaaatgagatgtacacttgtcatgatttatgtatgttgaccttttgtgtttattactgttttgaaaatagccatgttcattttctttccagttagagtaagtacttctgtggttaatgtatatttttattatggtttttaaaatgggaatcatttttatgtatctgtgcaaataataaatgcccatttggaaaaagagtaagctcttacataaaatggaccaaaaaatcccccttaattgaaaccaaaattttttctttctagttaggtttttttcccaactccttttaacttttggaatttattaataatttttttcttttttaatgatatgcccataggttcataaattgcttttgttcttttaaaattcatccatttggtttaacttaaaggaaccttttaaatgcctcacccttgaccctcagagctggaatttaaatgtttctaatacagtgatttggctgttatcaagaggttacatttcagctgggtgtcagccaggtgtggtggctcacacttgtaagcccagcactttgggaggccgaggcaggcagatcatctgaggtcaggagtttaagatcagccatgaccaacatggtgaaaccccatctctattaaatacacaaaataaaaattagccaggcatggtggcacacgcctgtcatctcagctactcaggaggctgaggcaggagaatcacttgaacccaggaggcagaggttgcagtgagtggagattgcgccattgcactccaacctaggcgacagagtgagactccgtctcaaaaaaaaaaaaaaaaaaaaagaggctactgtacttatttttatatttgactacattaggtctttttcacgggaagctgttgttttctttccgtctcattactgtataagagtttccttaccctttatgtattgaaaaatatataaattccaaacttaaattatttggataattaagtttttgcagatcttggaagtaaagataatgttttgatcatattaatgaataaagttaactgtttcatttcacttacataagttaactggccaaattggatttatatgtggtttcatccattggttctgtcctggccaagttgcttatgtcatccatagacaggataattctttcttcaatcacaagtaggttaatgttcttatttgagaagttgataattgtcaggtagtaattcacactggtagtaaagatgtgcttttgttttcttaccaaatatttttatgtgtttccagagttcttttcaatagaaatattttcaataaagtgttaatagtgtaagataaagtattgtataaaccatggtttgtgaaa

SEQ ID NO: 792 - DNA, 2765 bp, Homo sapiens
gagcctgctgggacttgaaccagcagtaagattttcacgacacagtgctgtctgcttctccgtaagaagttagaagccctagaaaacaatctcctggtccaaggtgcttgagtgggccgatccagctatatcaagaacctttgagaacaaaattctcaagcatttctgaggggagtcgaataggtgaaaaccttggctggcctgaccttatcatggaacctgacgactttgattctgaagacaaagagatattaagctgggatattaatgatgtgaaactgccacagaacgtgaaaaaaaccgactggttccaggagtggccagattcctatgccaaacacatctacagctcggaggacaagaatgcgcagcggcacctgagcagctgggccatgcgcaataccaacaaccacaactcccgcatcctcaagaagtcctgcctgggtgtggtggtgtgcggccgcgactgtctcgcagaggaggggcgcaagatctacctgagacctgccatctgtgacaaggcccggcagaagcagcagcggaaacgctgtcccaactgtgacgggcctctgaagctcatcccttgccgaggtcatgggggcttcccggtcaccaacttctggaggcacgacggacgctttatatttttccagtcaaagggagagcatgatcatccaaaaccagaaaccaagttagaagctgaggcaagaagagccatgaagaaagtgaacacagcaccttcctccgtctcattgagcctgaaggggagcacagagaccaggtctcttccaggtgaaacacaaagtcaggggagtttacctttaacttggtctttccaggaaggcgtccaattgcctggtagttacagtggacatttaatagctaacactcctcagcagaactcactaaatgattgcttttccttctccaagagttatggtctgggaggaatcacagatctgactgaccagacttccactgtggaccccatgaagctctatgaaaagcgcaaattgtccagtagcagaacctacagtagtggagacctgcttcctccttctgcctccggagtctactctgatcatggcgatctacaagcgtggagtaaaaatgctgctttggggagaaatcatcttgctgacaactgttattccaattatccttttcctctgaccagctggccttgcagcttctctccttcccaaaactcttcagaacccttttaccagcagcttccattggagccacctgcagccaaaactggctgtcccccattatggccaaatccagcgggtaatctttatgaagagaaagtacatgtggattttaacagctacgtccagtctcctgcataccattcacctcaagaagacccctttctcttcacctacgcctctcatcctcatcagcaatattcactgccaagcaagagcagcaaatgggattttgaggaagaaatgacatacttgggtttggatcactgcaacaatgatatgcttctgaacctgtgtcctttgagatgacccaaatctttcactatgtgcaccccagcccctcaaaaatggggaagggctgaaagaatttccttaggaaataatttttaaaacataaccacagataaatgagaatcatgataagcagtagacaaggcttttttctttttcttttttccttctttttttttttttttttttttttttgagacagagtcttgctcttttgcccaggcaggaatgcagtggcgccatctcggctcactgcaacctctgcctcccgggtttgagtgattctcctgcgtcagcctcccgagtagctgggattacaggcacctgccactgcgcctggctaatttttctatttttagtagagacagggttttgccatgttggtcaggctgctctcaaactcctgatctcaagtgatctgcccacctcaccatcccaaagtgctgggattacaggcgtgagccattgtgcccggctgacaaggcttttttcttcacatgagtaatttttttggcttcttctcctccactctagtatttccaccctcagtaaggaatggaaacctgtcccgtctggggtgtgaagtgccctctgctttttcccccacattgtttggggttcccagcacctcagccacattgcatgctgggttttcattgtcattgttgcaaatgaaatggagtagacatgtgaaatgctaacctatctaggacctgatctatgccttcttgggaactgagaatgaagaaacagaaatagatggtggaagaactgcctaaggtgtgaaaagctgaagattctaccactgaagtactgaatatgttgtctagttgtgagactagtgtgtaaaatatatgttttctagatgatttctgagacttgtgatgacaaggaacctgacctaaccccatttttcataaagacaaagaacagcaatgttaaattgccatatgaagagaaacactagtgatgtgcgtggtctccttgcctcttgtttccttccctcttcctcactgacttccccttgcacaggggcttctgttttatcccatttattatttgtggcacctatatcaatgtggggtttgtaataggtgagaaatatttgcttggagaagctcttgtgcaattagcctggcaatgattggccggccatgtttgaatgccagtttctcttctttgctgaagtactttatgataaaagtaagcctagacataaaatctggagagaaccatgcaataaacaagtatttttgaaat

SEQ ID NO: 793 - DNA, 2441 bp, Homo sapiens
cctctctctctttctctctctctgcacctccccttcacacaccccactttcttctttaaagagaagaaaaaaaacccacctggcgcacctgtccttttttcttctatttttcagaaccctgggcggaaagcgcgagcgagttgggcagatgccggcggccgcggtgcaggaagcggtcggcgtgtgctcctacgggatgcagctcagctgggacatcaacgatccgcagatgcctcaggagctggccctctttgaccaattccgagagtggcctgacggctatgtgcgcttcatctacagcagcgatgagaagaaggcacagcgtcacctgagcggctgggccatgcgcaacaccaacaaccacaatggccacatcctcaagaagtcgtgcctgggtgtggtggtgtgtacacaggcctgcaccctgcccgacggttcccgcctgcagctgaggccggccatctgcgacaaggcacggctgaaacagcagaagaaggcatgccctaactgtcattctgctttggagttgattccttgtcgagggcacagcggataccccgtaaccaacttttggcggcttgatggcaacgcgatcttttttcaggccaagggagttcatgatcatccaagaccagagagcaaatcagagacagaagctagaagaagcgccatcaagagacaaatggcctctttctaccaaccccagaaaaagagaattcgagaatccgaggcagaagaaaatcaagacagcagtggtcatttcagcaacatacctcccttggaaaatccagaagactttgatatagttactgaaaccagcttccctattccagggcagccttgcccttccttcccaaagtctgatgtttacaaagctacctgtgacctagccacctttcaaggagacaaaatgccacccttccagaaatactcaagcccaagaatctatttgcctaggccaccttgcagctatgaattggcaaaccctggttatacaaattcaagcccatatcccaccctttataaggattccaccagtatccctaatgacacagactgggttcatctgaacacactacaatgtaatgtcaattcatacagcagctatgagagaagctttgatttcaccaacaaacagcatggctggaaaccagctcttggaaaacccagccttgtggaaaggactaaccatgggcagtttcaggccatggccactcgcccttattataacccagagcttccctgcaggtacctcacgactccaccaccaggtgcccctgccctacaaaccgtgatcaccaccaccactaaagtgtcctaccaggcctaccagccccctgctatgaaatacagtgacagtgtgcgagaggtgaagagcctttcgagctgtaactatgctcctgaagatactgggatgtctgtctatccagaaccctggggtcctccggtgacagtcaccagggcagcctctccttcagggccacctcctatgaaaattgcaggagattgccgggccatcagacccactgtggctattccccacgagccagtttcctctaggacagatgaagcagagacttgggatgtgtgtctgtctgggctgggctccgcagtcagttactcagacagagtgggtcccttctttacctacaacaatgaggatttttgaaagacaatccaggggacataatagcagtgtgcatgcaggcaggaggcagggaaatgtgaaatggcaatgatctcttattgagttgggagattcaccttgtgtgcaaagaaacacagatagtagtaaaaattctgagtaactgagaaaataatcagttggaaatgattagataatatgggaaatttcacacagcattttgaaactggctacaatacatagaagtagtgaggaaagtgtgagtctctcaaatgaacaaataagcaaactgtaggaggttaaatactgacctaagttcacttagcttattagcaggagtagaagtcaaggattctggttcttattctaggacttttcccattagagcaccttagggaatttcacatccctagaggctgccaaaatagcttcaggaagaaatttttacaatcttatcacctgagtcatttcatgaaatttttgtttagcatttagaacctgttaaactagcttcaggaagtaattttgattgttttatctccaacgtgtgtatctacagcttttcaaaaaatctctagcaatggtaaagttcagttgtttttaaaagattcaatattagcttttcataacatgatagtttcctaaccttttcataaccttttcataacatgatagtttccataacagagacagcctaacaatgatgagttgtatttaatggattaccattgtactaaatacattttttttctgattaggtttcagaattataattaaaatgttttgctgaaataca

SEQ ID NO: 794 - DNA, 2812 bp, Homo sapiens
cactgtgtactgagactggatgcatccttgcaataaaaaagaggttgatcacgacaaatgtgaaccccgccgttataaaaacagccatcatggctgtaaatgccaaaaagcagtcagtcttgtaacttgaaaaaaaaaaaaaaggaattgtagattgtgcgcatggactcggagtgggggcggtggacagtaagtcatgatgttttggtggtaccacctggttgaatttcttcatctgaataagaagctcctgtgatgttctggggaggccttggaaggctagcgcatccctcatagaaagtgaatgggagctacggacaccgtaccccgggctcagagaagagcctgctggacctggaccttgctgagggccctggccccacctgctgccagggcctgtttctccctgcaggaagcccaccgccccgggctcacccccaagcttgtgagaggctgctgcatttcccccaccctgacaggtcacctagaccccaggccacgtatgtgaacggcagcctcccaaccacacaacacatcaaacaggagtccttgcccgactaccaagccatggcagaggcccgcacatccctgtctgcccactgtcggggcccgctggccactggcctgcacccagacctggacctcccgggccgaagcctcgccacccctgcgccttcctgctaccttctgggcagcgaacccagctctggcctgggcctccagcccgagacccacctccccgagggcagcctgaagcggtgctgcgtcttgggcctaccccccacctccccagcctcctcctcaccctgtgcctcctccgacgtcacctccatcatccgctcctcccagacgtctctggtcacctgtgtaaatggactccggagcccccctctgacgggagatctggggggcccttccaagcgggcccggcctggccctgcatcgacggacagccatgagggcagcttgcaacttgaagcctgccggaaggcgagcttcctgaagcaggaacccgcggatgagttttcagagctctttgggcctcaccagcagggcctgccgcccccctatcccctgtctcagttgccgcctggcccaagccttggaggcctggggctgggcctggcaggcagggtggtggccgggcggcaggcgtgccgctgggtggactgctgtgcagcctatgagcagcaggaggagctggtgcggcacatcgagaagagccacatcgaccagcgcaagggcgaggacttcacctgcttctgggctggctgcgtgcgccgctacaagcccttcaacgcccgctacaagctgctcatccacatgcgagtgcactcgggcgagaagcccaacaagtgcatgtttgaaggctgcagcaaggccttctcacggctggagaacctcaagatccacctgaggagccacacgggcgagaagccgtacctgtgccagcacccgggttgccagaaggccttcagcaactccagcgaccgcgccaagcaccagcgcacccacctagacacgaagccgtacgcctgtcagatccctggctgctccaagcgctacacagaccccagctccctccgcaagcacgtcaaggcccattcagccaaagagcagcaggtgcgtaagaagctgcatgcgggccctgacaccgaggccgacgtcctgaccgagtgtctggtcctgcagcagctccacacgtccacacagctggctgccagcgacggcaagggtggctgtggcctgggccaggagctgctcccaggtgtgtatcctggctccatcaccccccataacggacttgcatcgggcctcctgcccccagcgcacgacgtaccttccaggcaccacccgctggatgccaccaccagttcccaccaccatctgtcccctctgcccatggctgagagcacccgggatgggttggggcccggcctcctctcaccaatagtcagccccctgaaggggctggggccaccgccgctgcccccatcctctcagagccattctccggggggccagcccttccccacactccccagcaagccgtcctacccacccttccagagccctccacccccgcctctgcccagcccacaaggttaccagggcagtttccactccatccagagttgcttcccctatggcgactgctaccggatggctgaaccagcagccggtggggacggactggtcggggagacccacggtttcaaccccctgcggcccaatggctaccacagcctcagcacgcccttgcctgccacaggctatgaggccctggctgaggcctcatgccccacagcgctgccacagcagccatctgaagatgtggtgtccagcggccccgaggactgtggcttcttccccaatggagcctttgaccactgcctgggccacatcccctccatctacacagacacctgaaggagcccccacatgcgcctgcccatccagcactgcagatgccacctcgcccacctgctgtcgctcccaccctccgtgcacctagcaggagtgccaggccacagccggaacagccaggccatgacccaggggagccagcgctgccaccccacccagcgctgccagggagccgccatccgagcttgagctgggcgcacagaggtgcccgccaggatctgtggccctgtaacattccctcgatcttgtcttcccgttcctccccgcagtggttttgaaatcacagacctcgtgtatataaaatatgcagaacttgttttccgttcccctgccagttttatatttttggttttacaagaaaaaacattaaaaactggaaaggaga

SEQ ID NO: 795 - DNA, 3772 bp, Homo sapiens
ggcccactccaatgggcggcgccggggcgacttgctgttcccggcggcccgtgcgtcggcggtggttgggtggtaagatggcggctgtgagtctgcggctcggcgacttggtgtgggggaaactcggccgatatcctccttggccaggaaagattgttaatccaccaaaggacttgaagaaacctcgcggaaagaaatgcttctttgtgaaattttttggaacagaagatcatgcctggatcaaagtggaacagctgaagccatatcatgctcataaagaggaaatgataaaaattaacaagggtaaacgattccagcaagcggtagatgctgtcgaagagttcctcaggagagccaaagggaaagaccagacgtcatcccacaattcttctgatgacaagaatcgacgtaattccagtgaggagagaagtaggccaaactcaggtgatgagaagcgcaaacttagcctgtctgaagggaaggtgaagaagaacatgggagaaggaaagaagagggtgtcttcaggctcttcagagagaggctccaaatcccctctgaaaagagcccaagagcaaagtccccggaagcggggtcggcccccaaaggatgagaaggatctcaccatcccggagtctagtaccgtgaaggggatgatggccggaccgatggccgcgtttaaatggcagccaaccgcaagcgagcctgttaaagatgcagatcctcatttccatcatttcctgctaagccaaacagagaagccagctgtctgttaccaggcaatcacgaagaagttgaaaatatgtgaagaggaaactggctccacctccatccaggcagctgacagcacagccgtgaatggcagcatcacacccacagacaaaaagataggatttttgggccttggtctcatgggaagtggaatcgtctccaacttgctaaaaatgggtcacacagtgactgtctggaaccgcactgcagagaaatgtgatttgttcatccaggagggggcccgtctgggaagaacccccgctgaagtcgtctcaacctgcgacatcactttcgcctgcgtgtcggatcccaaggcggccaaggacctggtgctgggccccagtggtgtgctgcaagggatccgccctgggaagtgctacgtggacatgtcaacagtggacgctgacaccgtcactgagctggcccaggtgattgtgtccaggggggggcgctttctggaagcccccgtctcagggaatcagcagctgtctaatgacgggatgttggtgatcttagcggctggagacaggggcttatatgaggactgcagcagctgcttccaggcgatggggaagacctccttcttcctaggtgaagtgggcaatgcagccaagatgatgctgatcgtgaacatggtccaagggagcttcatggccactattgccgaggggctgaccctggcccacgtgacaggccagtcccagcagacactcttggacatcctcaatcagggacagttggccagcatcttcctggaccagaagtgccaaaatatcctgcaaggaaactttaagcctgatttctacctgaaatacattcagaaggatctccgcttagccattgcgctgggtgatgcggtcaaccatccgactcccatggcagctgcagcaaatgaggtgtacaaaagagccaaggcgctggaccagtctgacaacgatatgtccgccgtgtaccgagcctacatacactaagctgtcgacaccccgccctcacccctccaatcccccctctgaccccctcttcctcacatggggtcgggggcctgggagttcattctggaccagcccacctatctccatttccttttatacagactttgagacttgccatcagcacagcacacagcagcacccttcccctgaggccggtggggaggggacaagtgtcagcaggattggcgtgtgggaaagctcttgagctgggcactggccccccggacgaggtggctgtgtgttcacacacacacacacacacacacacacacacacacacaggctctcgccccaggatagaagctgcccagaaactgctgcctggctttttttcttccgagcttgtcttatctcaaaccccttccagtcaaggaactagaatcagcaacgagagttggaagccttcccacagcttcccccagagcgaagaggctgtagtcatgtccccatcccccactggattccctacaaggagaggccttgggcccagatgagccagtacagactccagacagaggggcccttggggccctccaacctcaggtgatgagctgagaaagatgttcacgtctaagcgtccagtgtgcacccagcgctccatagacgcctttgtgaactgaaaagagactggcagagtcccgagaagatggggccctggctttccagggagtgcagcaagcagccggcctgcaggtgagcatggaggcccggccctcaccgcctcgaagccatgccccagatgccactgccacagcgggcgctcgctcctccctaggctgttttagtatttggatttgcattccatcccttgggagggagtcctcagggccactagtgatgagccaagaggagtgggggttgggggcgctcctttctgtttccgttaggccacagactcttcacctggctctgaagagccactcttacctcggtcccctcccagtggtcccaccttctccaccctgccctgccaagtcccctgcatgcccaccgctctccatcctccctcctctccctcttcctcccgtggagacagtatttctttctgtctgtccctttggcccagacccagcctgaccaacgatgagcatttcttaggctcagctcttgatacggaaacgagtgtcttcactccagccagcatcatggtcttcggtgcttcccgggcccggggtctgtcgggagggaagagaactgggcctgacctacctgaactgactggccctccgaggtgggtctgggacatcctagaggccctacatttgtccttggataggggaccggggggggcttggaatgttgcaaaaaaaaaagttacccaagggatgtcagttttttatccctctgcatgggttggattttccaaaatcataatttgcagaaggaaggccagcatttacgatgcaatatgtaattatatatagggtggccacactagggcggggtccttcccccctcacagctttggcccctttcagagattagaaactgggttagaggattgcagaagacgagtggggggagggcagggaagatgcctgtcgggtttttagcacagttcatttcactgggattttgaagcatttctgtctgaacacaaagcctgttctagtcctggcggaacacactgggggtgggggcgggggaagatgcggtaatgaaaccggttagtcaattttgtcttaatattgttgacaattctgtaaagttcctttttatgaatatttctgtttaagctatttcacctttcttttgaaatccttcccttttaaggagaaaatgtgacacttgtgaaaaagcttgtaagaaagcccctcccttttttctttaaacctttaaatgacaaatctaggtaattaaggttgtgaatttttatttttgctttgtttttaatgaacatttgtctttcagaataggattgtgtgataatgtttaaatggcaaaaacaaaacatgattttgtgcaattaacaaagctactgcaagaaaaataaaacacttcttggtaacaca

SEQ ID NO: 796 - DNA, 3657 bp, Homo sapiens
gtggttgggtggtaagatggcggctgtgagtctgcggctcggcgacttggtgtgggggaaactcggccgatatcctccttggccaggaaagattgttaatccaccaaaggacttgaagaaacctcgcggaaagaaatgcttctttgtgaaattttttggaacagaagatcatgcctggatcaaagtggaacagctgaagccatatcatgctcataaagaggaaatgataaaaattaacaagggtaaacgattccagcaagcggtagatgctgtcgaagagttcctcaggagagccaaagggaaagaccagacgtcatcccacaattcttctgatgacaagaatcgacgtaattccagtgaggagagaagtaggccaaactcaggtgatgagaagcgcaaacttagcctgtctgaagggaaggtgaagaagaacatgggagaaggaaagaagagggtgtcttcaggctcttcagagagaggctccaaatcccctctgaaaagagcccaagagcaaagtccccggaagcggggtcggcccccaaaggatgagaaggatctcaccatcccggagtctagtaccgtgaaggggatgatggccggaccgatggccgcgtttaaatggcagccaaccgcaagcgagcctgttaaagatgcagatcctcatttccatcatttcctgctaagccaaacagagaaggaaactggctccacctccatccaggcagctgacagcacagccgtgaatggcagcatcacacccacagacaaaaagataggatttttgggccttggtctcatgggaagtggaatcgtctccaacttgctaaaaatgggtcacacagtgactgtctggaaccgcactgcagagaaatgtgatttgttcatccaggagggggcccgtctgggaagaacccccgctgaagtcgtctcaacctgcgacatcactttcgcctgcgtgtcggatcccaaggcggccaaggacctggtgctgggccccagtggtgtgctgcaagggatccgccctgggaagtgctacgtggacatgtcaacagtggacgctgacaccgtcactgagctggcccaggtgattgtgtccaggggggggcgctttctggaagcccccgtctcagggaatcagcagctgtctaatgacgggatgttggtgatcttagcggctggagacaggggcttatatgaggactgcagcagctgcttccaggcgatggggaagacctccttcttcctaggtgaagtgggcaatgcagccaagatgatgctgatcgtgaacatggtccaagggagcttcatggccactattgccgaggggctgaccctggcccacgtgacaggccagtcccagcagacactcttggacatcctcaatcagggacagttggccagcatcttcctggaccagaagtgccaaaatatcctgcaaggaaactttaagcctgatttctacctgaaatacattcagaaggatctccgcttagccattgcgctgggtgatgcggtcaaccatccgactcccatggcagctgcagcaaatgaggtgtacaaaagagccaaggcgctggaccagtctgacaacgatatgtccgccgtgtaccgagcctacatacactaagctgtcgacaccccgccctcacccctccaatcccccctctgaccccctcttcctcacatggggtcgggggcctgggagttcattctggaccagcccacctatctccatttccttttatacagactttgagacttgccatcagcacagcacacagcagcacccttcccctgaggccggtggggaggggacaagtgtcagcaggattggcgtgtgggaaagctcttgagctgggcactggccccccggacgaggtggctgtgtgttcacacacacacacacacacacacacacacacacacacaggctctcgccccaggatagaagctgcccagaaactgctgcctggctttttttcttccgagcttgtcttatctcaaaccccttccagtcaaggaactagaatcagcaacgagagttggaagccttcccacagcttcccccagagcgaagaggctgtagtcatgtccccatcccccactggattccctacaaggagaggccttgggcccagatgagccagtacagactccagacagaggggcccttggggccctccaacctcaggtgatgagctgagaaagatgttcacgtctaagcgtccagtgtgcacccagcgctccatagacgcctttgtgaactgaaaagagactggcagagtcccgagaagatggggccctggctttccagggagtgcagcaagcagccggcctgcaggtgagcatggaggcccggccctcaccgcctcgaagccatgccccagatgccactgccacagcgggcgctcgctcctccctaggctgttttagtatttggatttgcattccatcccttgggagggagtcctcagggccactagtgatgagccaagaggagtgggggttgggggcgctcctttctgtttccgttaggccacagactcttcacctggctctgaagagccactcttacctcggtcccctcccagtggtcccaccttctccaccctgccctgccaagtcccctgcatgcccaccgctctccatcctccctcctctccctcttcctcccgtggagacagtatttctttctgtctgtccctttggcccagacccagcctgaccaacgatgagcatttcttaggctcagctcttgatacggaaacgagtgtcttcactccagccagcatcatggtcttcggtgcttcccgggcccggggtctgtcgggagggaagagaactgggcctgacctacctgaactgactggccctccgaggtgggtctgggacatcctagaggccctacatttgtccttggataggggaccggggggggcttggaatgttgcaaaaaaaaaagttacccaagggatgtcagttttttatccctctgcatgggttggattttccaaaatcataatttgcagaaggaaggccagcatttacgatgcaatatgtaattatatatagggtggccacactagggcggggtccttcccccctcacagctttggcccctttcagagattagaaactgggttagaggattgcagaagacgagtggggggagggcagggaagatgcctgtcgggtttttagcacagttcatttcactgggattttgaagcatttctgtctgaacacaaagcctgttctagtcctggcggaacacactgggggtgggggcgggggaagatgcggtaatgaaaccggttagtcaattttgtcttaatattgttgacaattctgtaaagttcctttttatgaatatttctgtttaagctatttcacctttcttttgaaatccttcccttttaaggagaaaatgtgacacttgtgaaaaagcttgtaagaaagcccctcccttttttctttaaacctttaaatgacaaatctaggtaattaaggttgtgaatttttatttttgctttgtttttaatgaacatttgtctttcagaataggattgtgtgataatgtttaaatggcaaaaacaaaacatgattttgtgcaattaacaaagctactgcaagaaaaataaaacacttcttggtaac

SEQ ID NO: 797 - DNA, 3465 bp, Homo sapiens
gtggttgggtggtaagatggcggctgtgagtctgcggctcggcgacttggtgtgggggaaactcggccgatatcctccttggccaggaaagattgttaatccaccaaaggacttgaagaaacctcgcggaaagaaatgcttctttgtgaaattttttggaacagaagatcatgcctggatcaaagtggaacagctgaagccatatcatgctcataaagaggaaatgataaaaattaacaagggtaaacgattccagcaagcggtagatgctgtcgaagagttcctcaggagagccaaagggaaagaccaggatctcaccatcccggagtctagtaccgtgaaggggatgatggccggaccgatggccgcgtttaaatggcagccaaccgcaagcgagcctgttaaagatgcagatcctcatttccatcatttcctgctaagccaaacagagaagccagctgtctgttaccaggcaatcacgaagaagttgaaaatatgtgaagaggaaactggctccacctccatccaggcagctgacagcacagccgtgaatggcagcatcacacccacagacaaaaagataggatttttgggccttggtctcatgggaagtggaatcgtctccaacttgctaaaaatgggtcacacagtgactgtctggaaccgcactgcagagaaatgtgatttgttcatccaggagggggcccgtctgggaagaacccccgctgaagtcgtctcaacctgcgacatcactttcgcctgcgtgtcggatcccaaggcggccaaggacctggtgctgggccccagtggtgtgctgcaagggatccgccctgggaagtgctacgtggacatgtcaacagtggacgctgacaccgtcactgagctggcccaggtgattgtgtccaggggggggcgctttctggaagcccccgtctcagggaatcagcagctgtctaatgacgggatgttggtgatcttagcggctggagacaggggcttatatgaggactgcagcagctgcttccaggcgatggggaagacctccttcttcctaggtgaagtgggcaatgcagccaagatgatgctgatcgtgaacatggtccaagggagcttcatggccactattgccgaggggctgaccctggcccacgtgacaggccagtcccagcagacactcttggacatcctcaatcagggacagttggccagcatcttcctggaccagaagtgccaaaatatcctgcaaggaaactttaagcctgatttctacctgaaatacattcagaaggatctccgcttagccattgcgctgggtgatgcggtcaaccatccgactcccatggcagctgcagcaaatgaggtgtacaaaagagccaaggcgctggaccagtctgacaacgatatgtccgccgtgtaccgagcctacatacactaagctgtcgacaccccgccctcacccctccaatcccccctctgaccccctcttcctcacatggggtcgggggcctgggagttcattctggaccagcccacctatctccatttccttttatacagactttgagacttgccatcagcacagcacacagcagcacccttcccctgaggccggtggggaggggacaagtgtcagcaggattggcgtgtgggaaagctcttgagctgggcactggccccccggacgaggtggctgtgtgttcacacacacacacacacacacacacacacacacacacaggctctcgccccaggatagaagctgcccagaaactgctgcctggctttttttcttccgagcttgtcttatctcaaaccccttccagtcaaggaactagaatcagcaacgagagttggaagccttcccacagcttcccccagagcgaagaggctgtagtcatgtccccatcccccactggattccctacaaggagaggccttgggcccagatgagccagtacagactccagacagaggggcccttggggccctccaacctcaggtgatgagctgagaaagatgttcacgtctaagcgtccagtgtgcacccagcgctccatagacgcctttgtgaactgaaaagagactggcagagtcccgagaagatggggccctggctttccagggagtgcagcaagcagccggcctgcaggtgagcatggaggcccggccctcaccgcctcgaagccatgccccagatgccactgccacagcgggcgctcgctcctccctaggctgttttagtatttggatttgcattccatcccttgggagggagtcctcagggccactagtgatgagccaagaggagtgggggttgggggcgctcctttctgtttccgttaggccacagactcttcacctggctctgaagagccactcttacctcggtcccctcccagtggtcccaccttctccaccctgccctgccaagtcccctgcatgcccaccgctctccatcctccctcctctccctcttcctcccgtggagacagtatttctttctgtctgtccctttggcccagacccagcctgaccaacgatgagcatttcttaggctcagctcttgatacggaaacgagtgtcttcactccagccagcatcatggtcttcggtgcttcccgggcccggggtctgtcgggagggaagagaactgggcctgacctacctgaactgactggccctccgaggtgggtctgggacatcctagaggccctacatttgtccttggataggggaccggggggggcttggaatgttgcaaaaaaaaaagttacccaagggatgtcagttttttatccctctgcatgggttggattttccaaaatcataatttgcagaaggaaggccagcatttacgatgcaatatgtaattatatatagggtggccacactagggcggggtccttcccccctcacagctttggcccctttcagagattagaaactgggttagaggattgcagaagacgagtggggggagggcagggaagatgcctgtcgggtttttagcacagttcatttcactgggattttgaagcatttctgtctgaacacaaagcctgttctagtcctggcggaacacactgggggtgggggcgggggaagatgcggtaatgaaaccggttagtcaattttgtcttaatattgttgacaattctgtaaagttcctttttatgaatatttctgtttaagctatttcacctttcttttgaaatccttcccttttaaggagaaaatgtgacacttgtgaaaaagcttgtaagaaagcccctcccttttttctttaaacctttaaatgacaaatctaggtaattaaggttgtgaatttttatttttgctttgtttttaatgaacatttgtctttcagaataggattgtgtgataatgtttaaatggcaaaaacaaaacatgattttgtgcaattaacaaagctactgcaagaaaaataaaacacttcttggtaac

SEQ ID NO: 798 - DNA, 7138 bp, Homo sapiens
tggcgcatagtgttaggcgcatgctccttgatgcactgcggcgcggcgctccgaggctcggggacgcgcacgcaattcgctgttgttggctgacttccggtggtgccaaagccgtttccgtggaatcaggccggctgaatggaacaaaagtgggacttttaaaatgttgccctgtaagaagagaagaactacagtgacagagtccctacagcataaaggcaatcaagaggaaaacaacgtagacctagaatcagccgttaaaccagaatctgaccaggttaaggacttgagttcggtgtcactatcctgggatccaagtcatggcagagtagctggcttcgaagtacagtctttgcaggatgcaggaaatcagcttggtatggaggatacatctctgagctctggaatgctcacccagaacacaaatgtaccaattctagaaggtgttgatgtggccatctctcagggaatcaccctaccttccttggagtcttttcacccccttaatatacacattggtaaaggaaaactccacgctactggctcaaagagagggaaaaaaatgacactcaggcctgggccagttacccaagaagacagatgtgatcatcttaccctaaaggagcctttttcaggagagcctagtgaagaagtcaaggaagaaggagggaaacctcaaatgaattctgaaggggagataccttccctgccatcaggcagccaatctgcaaaaccagtaagccagcccaggaaatcaacccagccagatgtttgtgcctctcctcaagaaaagccactcaggactctgtttcaccaacctgaggaagagatagaagatggtggactcttcattccaatggaagaacaagacaatgaagaaagtgagaaaaggagaaaaaagaaaaagggtaccaagaggaaacgagatggaaggggtcaagaagggaccttggcatatgacctgaaactggatgacatgcttgaccgtaccttggaggatggtgccaagcagcacaatctaacagcagtcaatgtccgaaacatccttcatgaagtaatcacaaatgaacacgtggtagctatgatgaaagcagccatcagtgagacggaagatatgccaatgtttgagcctaaaatgacacgctctaaactgaaggaagtagtggaaaaaggagtggtaattccaacatggaatatttcaccaattaagaaggccaatgaaattaagcctcctcagtttgtggatatccaccttgaagaagatgattcctcagatgaagaataccagccggatgatgaagaagaagatgaaactgctgaagagagcttattggaaagtgatgttgaaagcactgcttcatctccacgtggggcaaagaaatccagattgaggcagtcttctgagatgactgaaacagatgaggagagtggcatattatcagaggctgagaaagtcaccacaccagccatcaggcacatcagtgctgaggtagtgcccatggggcccccgccccctccaaagccgaaacagaccagagatagtactttcatggagaagttacatgcggtagatgaggagctggcttccagtccagtctgcatggattctttccagcccatggatgacagtctcattgcatttcgaacgcgttctaagatgcccctgaaagatgttcccctgggccaattagaggcagagctccaagctccagacatcactccagatatgtatgaccccaatacggcagatgatgaggactggaagatgtggctggggggacttatgaatgatgatgtggggaatgaagatgaagcagatgatgatgatgatccagaatataatttcctggaagacctcgatgaaccagacacagaggatttccggactgaccgggcagtgagaatcaccaaaaaggaagtaaatgagctgatggaagagctgtttgaaactttccaagatgagatgggattctccaacatggaagatgatggcccagaagaggaggagtgtgtagctgagcctcgtcctaactttaacacccctcaagctctacggtttgaggaaccactggccaacctgttaaatgaacaacatcggacagtgaaggagctatttgaacagctgaagatgaagaaatcttcagccaaacagctgcaggaagtagagaaggttaaaccccagagtgagaaagttcatcagactctgattctggacccagcacagaggaagagactccagcagcagatgcagcagcacgttcagctcttgacccaaatccaccttcttgccacctgcaaccccaacctcaatccggaggccactaccaccaggatatttcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgcgaatgaatttccctgtttgccaaagcaagtggcttggattctggccacaagcaaggttttcatgtatccagagttacttccagtgtgttccctgaaggcaaagaatccccaggataagatcgtcttcaccaaggctgaggacaatttgttagctttaggactgaagcattttgaaggaactgagtttcctaatcctctaatcagcaagtaccttctaacctgcaaaactgcccaccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcgaagcctagaaaaagacaatttggagttggggagtgaatctcggtacccactgctattgcctaagggtgtagtcctgaaactgaagccagttgccacccgtttccccaggaaggcttggagacagaagcgttcatcagtcctgaagcccctccttatccaacccagcccctctctccagcccagcttcaaccctgggaaaacaccagcccgatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctgtgccccctgaggccaggacaagcttccctctgtctgagtcccagactttgctctcttctgcccctgtgcccaaggtaatgctgccctcccttgccccttctaagtttcgaaagccatatgtgagacggagaccctcaaagagaagaggagtcaaggcctctccctgtatgaaacctgcccctgttatccaccaccctgcatctgttatcttcactgttcctgctaccactgtgaagattgtgagccttggcggtggctgtaacatgatccagcctgtcaatgcggctgtggcccagagtccccagactattcccatcactaccctcttggttaaccctacttccttcccctgtccattgaaccagtcccttgtggcctcctctgtctcacccttaattgtttctggcaattctgtgaatcttcctataccatccacccctgaagataaggcccacgtgaatgtggacattgcttgtgctgtggctgatggggaaaatgcctttcagggcctagaacccaaattagagccccaggaactatctcctctctctgctactgttttcccgaaagtggaacatagcccagggcctccactagcagatgcagagtgccaagaaggattgtcagagaatagtgcctgtcgctggaccgttgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaagtaacgaaacagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggaaacaatggagaaactgacttggctggcatctgaaaggcgcatgagtcaggagggtgagtctgaagaagagaattctcaggaggagaactctgagccagaagaagaggaggaagaagaagcagaaggaatggaaagcctgcagaaagaggatgaaatgacggatgaagcagttggagactctgctgagaagcctcctacttttgcttcacctgagactgctccagaagtggagaccagcagaactccaccaggagagagcatcaaagctgctggaaaaggccggaacaatcatcgagctcgcaacaagcggggaagtcgggctcgggccagcaaggacacctccaagctgctgttgctgtatgatgaggacattctcgagcgagatccactcagggagcagaaggacttggcctttgcccaagcttatctgaccagggtgcgagaagccctacaacatatccctggcaagtatgaagacttccttcaagtcatctatgaatttgagtcaagtacccagagacggacggctgtagatctctacaaaagcctgcaaattctgctccaagactggcctcagctgttgaaagactttgctgctttcctgttacctgagcaagctctggcctgtggattatttgaggagcagcaggcttttgagaagagccgcaagttccttcggcagctggagatttgctttgcagagaacccctcacaccaccagaagattatcaaggtcctccaaggctgtgcagactgccttccccaggagatcaccgagctcaagacacagatgtggcagctcctcaagggccacgaccacctgcaggatgagttttctatcttctttgaccacttgcgcccagcagctagccggatgggtgactttgaagagatcaattggactgaggaaaaggagtatgagtttgatggctttgaagaagtggccctgcctgatgtggaagaagaggaggagcctcccaagatacccacagcctcaaagaacaagaggaaaaaagagatcggggtccaaaatcatgataaggagactgaatggccagatggggccaaggactgtgcctgctcctgccatgaaggaggtccagattccaagctgaagaagagcaaaaggcggagctgtagccactgtagcagcaaggtctgtgacagcaaatcctacaagagcaaggagccccatgagttggtgggcagcagcccccaccgagaggctagtcctatgcctggtgctaaggaagctgggcagggcaaggatatgatggaagaggaagccccagaggagcgggagagcactgaggccacccagagcaggactgtcaggaccaccagaaagggagagatgcctgtttcaggattggcagtggggagcactttgccatcccctcgagaagtgactgttacagaacggctcctcctggatggcccaccacctcattcaccagagactcctcaatttccccccacaactggagctgtactgtacactgttaagagaaaccaggttgggcctgaggttcgctcctgccccaaggcatcccccagacttcagaaagagagggagggccaaaaggcagtgagtgagtcagaggctttgatgctggtctgggatgcatcagaaactgagaaattgcctggtaccgtggaaccccctgcttccttcctgagtcctgtttcctcaaagaccagagatgcagggagaagacatgtgtccgggaaaccagacactcaagagagatggctgccctcaagcagagctcgggtgaagacaagagacaggacgtgccctgtccatgaatctccatcaggaattgacacctcagagacttctcccaaagcccctagagggggtttggctaaagacagtggaacacaggccaagggtccagagggggagcagcagccaaaggccgcagaagctacggtgtgtgccaacaacagcaaggtcagctccactggggaaaaggttgtcctgtggacaagggaagctgaccgtgtgatcctcaccatgtgccaggagcaaggggcacagccacagaccttcaacatcatctcccagcagctgggaaataagacccctgctgaggtttcccaccgttttcgagaactcatgcagctcttccacactgcctgtgaagccagctctgaggatgaggatgatgcaaccagtaccagcaatgcagaccagctgtctgaccatggggaccttctgtctgaagaggagctggatgaatgagactctgggaatcatctacacaggaccaaacccaacaggcgccctggcaccggggagggggtagttgtactctgcttgtacagtccttgagcccagtttacagatctggagagcaggaggccaggacaaggacaaaggctggaggatggagtaggacccaggggctctgccatcctaggcatcattcaaggtcttttatgaagactttacagatgtcctctgtaaatagcatcgagagtggagttcagctcc

SEQ ID NO: 799 - DNA, 5118 bp, Homo sapiens
gacttccggtggtgccaaagccgtttccgtggaatcaggccggctgaatggaacaaaagtgggacttttaaaatgttgccctgtaagaagagaagaactacagtgacagagtccctacagcataaaggcaatcaagaggaaaacaacgtagacctagaatcagccgttaaaccagaatctgaccaggttaaggacttgagttcggtgtcactatcctgggatccaagtcatggcagagtagctggcttcgaagtacagtctttgcaggatgcaggaaatcagcttggtatggaggatacatctctgagctctggaatgctcacccagaacacaaatgtaccaattctagaaggtgttgatgtggccatctctcagggaatcaccctaccttccttggagtcttttcacccccttaatatacacattggtaaaggaaaactccacgctactggctcaaagagagggaaaaaaatgacactcaggcctgggccagttacccaagaagacagatgtgatcatcttaccctaaaggagcctttttcaggagagcctagtgaagaagtcaaggaagaaggagggaaacctcaaatgaattctgaaggggagataccttccctgccatcaggcagccaatctgcaaaaccagtaagccagcccaggaaatcaacccagccagatgtttgtgcctctcctcaagaaaagccactcaggactctgtttcaccaacctgaggaagagatagaagatggtggactcttcattccaatggaagaacaagacaatgaagaaagtgagaaaaggagaaaaaagaaaaagggtaccaagaggaaacgagatggaaggggtcaagaagggaccttggcatatgacctgaaactggatgacatgcttgaccgtaccttggaggatggtgccaagcagcacaatctaacagcagtcaatgtccgaaacatccttcatgaagtaatcacaaatgaacacgtggtagctatgatgaaagcagccatcagtgagacggaagatatgccaatgtttgagcctaaaatgacacgctctaaactgaaggaagtagtggaaaaaggagtggtaattccaacatggaatatttcaccaattaagaaggccaatgaaattaagcctcctcagtttgtggatatccaccttgaagaagatgattcctcagatgaagaataccagccggatgatgaagaagaagatgaaactgctgaagagagcttattggaaagtgatgttgaaagcactgcttcatctccacgtggggcaaagaaatccagattgaggcagtcttctgagatgactgaaacagatgaggagagtggcatattatcagaggctgagaaagtcaccacaccagccatcaggcacatcagtgctgaggtagtgcccatggggcccccgccccctccaaagccgaaacagaccagagatagtactttcatggagaagttacatgcggtagatgaggagctggcttccagtccagtctgcatggattctttccagcccatggatgacagtctcattgcatttcgaacgcgttctaagatgcccctgaaagatgttcccctgggccaattagaggcagagctccaagctccagacatcactccagatatgtatgaccccaatacggcagatgatgaggactggaagatgtggctggggggacttatgaatgatgatgtggggaatgaagatgaagcagatgatgatgatgatccagaatataatttcctggaagacctcgatgaaccagacacagaggatttccggactgaccgggcagtgagaatcaccaaaaaggaagtaaatgagctgatggaagagctgtttgaaactttccaagatgagatgggattctccaacatggaagatgatggcccagaagaggaggagtgtgtagctgagcctcgtcctaactttaacacccctcaagctctacggtttgaggaaccactggccaacctgttaaatgaacaacatcggacagtgaaggagctatttgaacagctgaagatgaagaaatcttcagccaaacagctgcaggaagtagagaaggttaaaccccagagtgagaaagttcatcagactctgattctggacccagcacagaggaagagactccagcagcagatgcagcagcacgttcagctcttgacccaaatccaccttcttgccacctgcaaccccaacctcaatccggaggccactaccaccaggatatttcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgcgaatgaatttccctgtttgccaaagcaagtggcttggattctggccacaagcaaggttttcatgtatccagagttacttccagtgtgttccctgaaggcaaagaatccccaggataagatcgtcttcaccaaggctgaggacaatttgttagctttaggactgaagcattttgaaggaactgagtttcctaatcctctaatcagcaagtaccttctaacctgcaaaactgcccaccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcgaagcctagaaaaagacaatttggagttggggagtgaatctcggtacccactgctattgcctaagggtgtagtcctgaaactgaagccagttgccacccgtttccccaggaaggcttggagacagaagcgttcatcagtcctgaagcccctccttatccaacccagcccctctctccagcccagcttcaaccctgggaaaacaccagcccgatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctgtgccccctgaggccaggacaagcttccctctgtctgagtcccagactttgctctcttctgcccctgtgcccaaggtaatgctgccctcccttgccccttctaagtttcgaaagccatatgtgagacggagaccctcaaagagaagaggagtcaaggcctctccctgtatgaaacctgcccctgttatccaccaccctgcatctgttatcttcactgttcctgctaccactgtgaagattgtgagccttggcggtggctgtaacatgatccagcctgtcaatgcggctgtggcccagagtccccagactattcccatcactaccctcttggttaaccctacttccttcccctgtccattgaaccagtcccttgtggcctcctctgtctcacccttaattgtttctggcaattctgtgaatcttcctataccatccacccctgaagataaggcccacgtgaatgtggacattgcttgtgctgtggctgatggggaaaatgcctttcagggcctagaacccaaattagagccccaggaactatctcctctctctgctactgttttcccgaaagtggaacatagcccagggcctccactagcagatgcagagtgccaagaaggattgtcagagaatagtgcctgtcgctggaccgttgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaagtaacgaaacagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggtgagagctggagaatattctcaagtatttcgtggactcagtaatatgtatcacttattgatatgccacctgcttgcttgctgcactatggatagtcctaaaatcatttgtatttgatttgtgaatgcattatgggacatgattgtggagttgaggtgaaatgagatggaaaggatgaaattttacttattatattaaactcgtttacacattaaattgaatcacctgaccatactttaaatgccttaaaaaatagtaataggctgggcttggtggctcactcctgtagtcccagcactttgggaggctgaggtgggtggatcacaaggccaggagtttcagactggcctggccgacgtggtaaaaccccatctatattaaaaataacaaaaattagccaggcatggtggcggacacctgtaatccctgctgcttgggaggcagaggcaggagaattgcttgagcccgagagacagaggttgcagtgagccgagatcacgtcattgctctccagcctgggcaacagagcaaggctctgtctcaaaaaaaaaaaaaaaaaaaaaaaaaaaaaaa

SEQ ID NO: 800 - DNA, 2452 bp, Homo sapiens
tggcgcatagtgttaggcgcatgctccttgatgcactgcggcgcggcgctccgaggctcggggacgcgcacgcaattcgctgttgttggctgacttccggtggtgccaaagccgtttccgtggaatcaggccggctgaatggaacaaaagtgggacttttaaaatgttgccctgtaagaagagaagaactacagtgacagagtccctacagcataaaggcaatcaagaggaaaacaacgtagacctagaatcagccgttaaaccagaatctgaccaggttaaggacttgagttcggtgtcactatcctgggatccaagtcatggcagagtagctggcttcgaagtacagtctttgcaggatgcaggaaatcagcttggtatggaggatacatctctgagctctggaatgctcacccagaacacaaatgtaccaattctagaaggtgttgatgtggccatctctcagggaatcaccctaccttccttggagtcttttcacccccttaatatacacattggtaaaggaaaactccacgctactggctcaaagagagggaaaaaaatgacactcaggcctgggccagttacccaagaagacagatgtgatcatcttaccctaaaggagcctttttcaggagagcctagtgaagaagtcaaggaagaaggagggaaacctcaaatgaattctgaaggggagataccttccctgccatcaggcagccaatctgcaaaaccagtaagccagcccaggaaatcaacccagccagatgtttgtgcctctcctcaagaaaagccactcaggactctgtttcaccaacctgaggaagagatagaagatggtggactcttcattccaatggaagaacaagacaatgaagaaagtgagaaaaggagaaaaaagaaaaagggtaccaagaggaaacgagatggaaggggtcaagaagggaccttggcatatgacctgaaactggatgacatgcttgaccgtaccttggaggatggtgccaagcagcacaatctaacagcagtcaatgtccgaaacatccttcatgaagtaatcacaaatgaacacgtggtagctatgatgaaagcagccatcagtgagacggaagatatgccaatgtttgagcctaaaatgacacgctctaaactgaaggaagtagtggaaaaaggagtggtaattccaacatggaatatttcaccaattaagaaggccaatgaaattaagcctcctcagtttgtggatatccaccttgaagaagatgattcctcagatgaagaataccagccggatgatgaagaagaagatgaaactgctgaagagagcttattggaaagtgatgttgaaagcactgcttcatctccacgtggggcaaagaaatccagattgaggcagtcttctgagatgactgaaacagatgaggagagtggcatattatcagaggctgagaaagtcaccacaccagccatcaggcacatcagtgctgaggtagtgcccatggggcccccgccccctccaaagccgaaacagaccagagatagtactttcatggagaagttacatgcggtagatgaggagctggcttccagtccagtctgcatggattctttccagcccatggatgacagtctcattgcatttcgaacgcgttctaagatgcccctgaaagatgttcccctgggccaattagaggcagagctccaagctccagacatcactccagatatgtatgaccccaatacggcagatgatgaggactggaagatgtggctggggggacttatgaatgatgatgtggggaatgaagatgaagcagatgatgatgatgatccagaatataatttcctggaagacctcgatgaaccagacacagaggatttccggactgaccgggcagtgagaatcaccaaaaaggaagtaaatgagctgatggaagagctgtttgaaactttccaagatgagatgggattctccaacatggaagatgatggcccagaagaggaggagtgtgtagctgagcctcgtcctaactttaacacccctcaagctctacggtttgaggaaccactggccaacctgttaaatgaacaacatcggacagtgaaggagctatttgaacagctgaagatgaagaaatcttcagccaaacagctgcaggaagtagagaaggttaaaccccagagtgagaaagttcatcagactctgattctggacccagcacagaggaagagactccagcagcagatgcagcagaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactggtaggagacagatgtgtcagctttaa

SEQ ID NO: 801 - DNA, 7640 bp, Homo sapiens
tttccgtggaatcaggccggctgaatggaacaaaagtgggacttttaaaatgttgccctgtaagaagagaagaactacagtgacagagtccctacagcataaaggcaatcaagaggaaaacaacgtagacctagaatcagccgttaaaccagaatctgaccaggttaaggacttgagttcggtgtcactatcctgggatccaagtcatggcagagtagctggcttcgaagtacagtctttgcaggatgcaggaaatcagcttggtatggaggatacatctctgagctctggaatgctcacccagaacacaaatgtaccaattctagaaggtgttgatgtggccatctctcagggaatcaccctaccttccttggagtcttttcacccccttaatatacacattggtaaaggaaaactccacgctactggctcaaagagagggaaaaaaatgacactcaggcctgggccagttacccaagaagacagatgtgatcatcttaccctaaaggagcctttttcaggagagcctagtgaagaagtcaaggaagaaggagggaaacctcaaatgaattctgaaggggagataccttccctgccatcaggcagccaatctgcaaaaccagtaagccagcccaggaaatcaacccagccagatgtttgtgcctctcctcaagaaaagccactcaggactctgtttcaccaacctgaggaagagatagaagatggtggactcttcattccaatggaagaacaagacaatgaagaaagtgagaaaaggagaaaaaagaaaaagggtaccaagaggaaacgagatggaaggggtcaagaagggaccttggcatatgacctgaaactggatgacatgcttgaccgtaccttggaggatggtgccaagcagcacaatctaacagcagtcaatgtccgaaacatccttcatgaagtaatcacaaatgaacacgtggtagctatgatgaaagcagccatcagtgagacggaagatatgccaatgtttgagcctaaaatgacacgctctaaactgaaggaagtagtggaaaaaggagtggtaattccaacatggaatatttcaccaattaagaaggccaatgaaattaagcctcctcagtttgtggatatccaccttgaagaagatgattcctcagatgaagaataccagccggatgatgaagaagaagatgaaactgctgaagagagcttattggaaagtgatgttgaaagcactgcttcatctccacgtggggcaaagaaatccagattgaggcagtcttctgagatgactgaaacagatgaggagagtggcatattatcagaggctgagaaagtcaccacaccagccatcaggcacatcagtgctgaggtagtgcccatggggcccccgccccctccaaagccgaaacagaccagagatagtactttcatggagaagttacatgcggtagatgaggagctggcttccagtccagtctgcatggattctttccagcccatggatgacagtctcattgcatttcgaacgcgttctaagatgcccctgaaagatgttcccctgggccaattagaggcagagctccaagctccagacatcactccagatatgtatgaccccaatacggcagatgatgaggactggaagatgtggctggggggacttatgaatgatgatgtggggaatgaagatgaagcagatgatgatgatgatccagaatataatttcctggaagacctcgatgaaccagacacagaggatttccggactgaccgggcagtgagaatcaccaaaaaggaagtaaatgagctgatggaagagctgtttgaaactttccaagatgagatgggattctccaacatggaagatgatggcccagaagaggaggagtgtgtagctgagcctcgtcctaactttaacacccctcaagctctacggtttgaggaaccactggccaacctgttaaatgaacaacatcggacagtgaaggagctatttgaacagctgaagatgaagaaatcttcagccaaacagctgcaggaagtagagaaggttaaaccccagagtgagaaagttcatcagactctgattctggacccagcacagaggaagagactccagcagcagatgcagcagcacgttcagctcttgacccaaatccaccttcttgccacctgcaaccccaacctcaatccggaggccactaccaccaggatatttcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgcgaatgaatttccctgtttgccaaagcaagtggcttggattctggccacaagcaaggttttcatgtatccagagttacttccagtgtgttccctgaaggcaaagaatccccaggataagatcgtcttcaccaaggctgaggacaatttgttagctttaggactgaagcattttgaaggaactgagtttcctaatcctctaatcagcaagtaccttctaacctgcaaaactgcccaccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcgaagcctagaaaaagacaatttggagttggggagtgaatctcggtacccactgctattgcctaagggtgtagtcctgaaactgaagccagttgccacccgtttccccaggaaggcttggagacagaagcgttcatcagtcctgaagcccctccttatccaacccagcccctctctccagcccagcttcaaccctgggaaaacaccagcccgatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctgtgccccctgaggccaggacaagcttccctctgtctgagtcccagactttgctctcttctgcccctgtgcccaaggtaatgctgccctcccttgccccttctaagtttcgaaagccatatgtgagacggagaccctcaaagagaagaggagtcaaggcctctccctgtatgaaacctgcccctgttatccaccaccctgcatctgttatcttcactgttcctgctaccactgtgaagattgtgagccttggcggtggctgtaacatgatccagcctgtcaatgcggctgtggcccagagtccccagactattcccatcactaccctcttggttaaccctacttccttcccctgtccattgaaccagtcccttgtggcctcctctgtctcacccttaattgtttctggcaattctgtgaatcttcctataccatccacccctgaagataaggcccacgtgaatgtggacattgcttgtgctgtggctgatggggaaaatgcctttcagggcctagaacccaaattagagccccaggaactatctcctctctctgctactgttttcccgaaagtggaacatagcccagggcctccactagcagatgcagagtgccaagaaggattgtcagagaatagtgcctgtcgctggaccgttgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaagtaacgaaacagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggaaacaatggagaaactgacttggctggcatctgaaaggcgcatgagtcaggagggtgagtctgaagaagagaattctcaggaggagaactctgagccagaagaagaggaggaagaagaagcagaaggaatggaaagcctgcagaaagaggatgaaatgacggatgaagcagttggagactctgctgagaagcctcctacttttgcttcacctgagactgctccagaagtggagaccagcagaactccaccaggagagagcatcaaagctgctggaaaaggccggaacaatcatcgagctcgcaacaagcggggaagtcgggctcgggccagcaaggacacctccaagctgctgttgctgtatgatgaggacattctcgagcgagatccactcagggagcagaaggacttggcctttgcccaagcttatctgaccagggtgcgagaagccctacaacatatccctggcaagtatgaagacttccttcaagtcatctatgaatttgagtcaagtacccagagacggacggctgtagatctctacaaaagcctgcaaattctgctccaagactggcctcagctgttgaaagactttgctgctttcctgttacctgagcaagctctggcctgtggattatttgaggagcagcaggcttttgagaagagccgcaagttccttcggcagctggagatttgctttgcagagaacccctcacaccaccagaagattatcaaggtcctccaaggctgtgcagactgccttccccaggagatcaccgagctcaagacacagatgtggcagctcctcaagggccacgaccacctgcaggatgagttttctatcttctttgaccacttgcgcccagcagctagccggatgggtgactttgaagagatcaattggactgaggaaaaggagtatgagtttgatggctttgaagaagtggccctgcctgatgtggaagaagaggaggagcctcccaagatacccacagcctcaaagaacaagaggaaaaaagagatcggggtccaaaatcatgataaggagactgaatggccagatggggccaaggactgtgcctgctcctgccatgaaggaggtccagattccaagctgaagaagagcaaaaggcggagctgtagccactgtagcagcaaggtctgtgacagcaaatcctacaagagcaaggagccccatgagttggtgggcagcagcccccaccgagaggctagtcctatgcctggtgctaaggaagctgggcagggcaaggatatgatggaagaggaagccccagaggagcgggagagcactgaggccacccagagcaggactgtcaggaccaccagaaagggagagatgcctgtttcagcaggattggcagtggggagcactttgccatcccctcgagaagtgactgttacagaacggctcctcctggatggcccaccacctcattcaccagagactcctcaatttccccccacaactggagctgtactgtacactgttaagagaaaccaggttgggcctgaggttcgctcctgccccaaggcatcccccagacttcagaaagagagggagggccaaaaggcagtgagtgagtcagaggctttgatgctggtctgggatgcatcagaaactgagaaattgcctggtaccgtggaaccccctgcttccttcctgagtcctgtttcctcaaagaccagagatgcagggagaagacatgtgtccgggaaaccagacactcaagagagatggctgccctcaagcagagctcgggtgaagacaagagacaggacgtgccctgtccatgaatctccatcaggaattgacacctcagagacttctcccaaagcccctagagggggtttggctaaagacagtggaacacaggccaagggtccagagggggagcagcagccaaaggccgcagaagctacggtgtgtgccaacaacagcaaggtcagctccactggggaaaaggttgtcctgtggacaagggaagctgaccgtgtgatcctcaccatgtgccaggagcaaggggcacagccacagaccttcaacatcatctcccagcagctgggaaataagacccctgctgaggtttcccaccgttttcgagaactcatgcagctcttccacactgcctgtgaagccagctctgaggatgaggatgatgcaaccagtaccagcaatgcagaccagctgtctgaccatggggaccttctgtctgaagaggagctggatgaatgagactctgggaatcatctacacaggaccaaacccaacaggcgccctggcaccggggagggggtagttgtactctgcttgtacagtccttgagcccagtttacagatctggagagcaggaggccaggacaaggacaaaggctggaggatggagtaggacccaggggctctgccatcctaggcatcattcaaggtcttttatgaagactttacagatgtcctctgtaaatagcatcgagagtggagttcagctcctttctctacttttttttggtctgatggcacatatttattgttctgtggtctaatcacagtgtttctaaatgtaaaaagtgcatatgttggtgtagctagtcccgcgacattgagctcctctgcatgaagacactgggctcctgcatccagctgtttttattgcaaactagctcctttctcccacactgggaactttagtccacgaggctgtcaccaccctggtagcactgggccaggctttgtagctcctgcagcagctctgctacgtcatcgtgctccactccagcatccatgaagctggcccagcgccgcaagtcgagtttggtgaggtctctggccaaggcttccagggtctggtgcagggacgaagaggaacacagtgccccaaacactgggatgctctccactgctgtggagggagaggaaacagagacctgtagatggatgattattctgccctgggactcgccaaactgataaggaagtccaaccttagtagacttgattgtaaactcaacaaatttggtgtattgtccccttagtacaccagtactccagaggaagaatgcttttcttgggagccatagggtgaataaaggaatgtttaactgtg

SEQ ID NO: 802 - DNA, 7713 bp, Homo sapiens
ctctcccggaggggactcctcccaccgccgagttttcccgagaatgaggccgcgcccactgacgcgctgtggttccaaaacgagaaagtactgaaggaatggaacaaaagtgggacttttaaaatgttgccctgtaagaagagaagaactacagtgacagagtccctacagcataaaggcaatcaagaggaaaacaacgtagacctagaatcagccgttaaaccagaatctgaccaggttaaggacttgagttcggtgtcactatcctgggatccaagtcatggcagagtagctggcttcgaagtacagtctttgcaggatgcaggaaatcagcttggtatggaggatacatctctgagctctggaatgctcacccagaacacaaatgtaccaattctagaaggtgttgatgtggccatctctcagggaatcaccctaccttccttggagtcttttcacccccttaatatacacattggtaaaggaaaactccacgctactggctcaaagagagggaaaaaaatgacactcaggcctgggccagttacccaagaagacagatgtgatcatcttaccctaaaggagcctttttcaggagagcctagtgaagaagtcaaggaagaaggagggaaacctcaaatgaattctgaaggggagataccttccctgccatcaggcagccaatctgcaaaaccagtaagccagcccaggaaatcaacccagccagatgtttgtgcctctcctcaagaaaagccactcaggactctgtttcaccaacctgaggaagagatagaagatggtggactcttcattccaatggaagaacaagacaatgaagaaagtgagaaaaggagaaaaaagaaaaagggtaccaagaggaaacgagatggaaggggtcaagaagggaccttggcatatgacctgaaactggatgacatgcttgaccgtaccttggaggatggtgccaagcagcacaatctaacagcagtcaatgtccgaaacatccttcatgaagtaatcacaaatgaacacgtggtagctatgatgaaagcagccatcagtgagacggaagatatgccaatgtttgagcctaaaatgacacgctctaaactgaaggaagtagtggaaaaaggagtggtaattccaacatggaatatttcaccaattaagaaggccaatgaaattaagcctcctcagtttgtggatatccaccttgaagaagatgattcctcagatgaagaataccagccggatgatgaagaagaagatgaaactgctgaagagagcttattggaaagtgatgttgaaagcactgcttcatctccacgtggggcaaagaaatccagattgaggcagtcttctgagatgactgaaacagatgaggagagtggcatattatcagaggctgagaaagtcaccacaccagccatcaggcacatcagtgctgaggtagtgcccatggggcccccgccccctccaaagccgaaacagaccagagatagtactttcatggagaagttacatgcggtagatgaggagctggcttccagtccagtctgcatggattctttccagcccatggatgacagtctcattgcatttcgaacgcgttctaagatgcccctgaaagatgttcccctgggccaattagaggcagagctccaagctccagacatcactccagatatgtatgaccccaatacggcagatgatgaggactggaagatgtggctggggggacttatgaatgatgatgtggggaatgaagatgaagcagatgatgatgatgatccagaatataatttcctggaagacctcgatgaaccagacacagaggatttccggactgaccgggcagtgagaatcaccaaaaaggaagtaaatgagctgatggaagagctgtttgaaactttccaagatgagatgggattctccaacatggaagatgatggcccagaagaggaggagtgtgtagctgagcctcgtcctaactttaacacccctcaagctctacggtttgaggaaccactggccaacctgttaaatgaacaacatcggacagtgaaggagctatttgaacagctgaagatgaagaaatcttcagccaaacagctgcaggaagtagagaaggttaaaccccagagtgagaaagttcatcagactctgattctggacccagcacagaggaagagactccagcagcagatgcagcagcacgttcagctcttgacccaaatccaccttcttgccacctgcaaccccaacctcaatccggaggccactaccaccaggatatttcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgcgaatgaatttccctgtttgccaaagcaagtggcttggattctggccacaagcaaggttttcatgtatccagagttacttccagtgtgttccctgaaggcaaagaatccccaggataagatcgtcttcaccaaggctgaggacaatttgttagctttaggactgaagcattttgaaggaactgagtttcctaatcctctaatcagcaagtaccttctaacctgcaaaactgcccaccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcgaagcctagaaaaagacaatttggagttggggagtgaatctcggtacccactgctattgcctaagggtgtagtcctgaaactgaagccagttgccacccgtttccccaggaaggcttggagacagaagcgttcatcagtcctgaagcccctccttatccaacccagcccctctctccagcccagcttcaaccctgggaaaacaccagcccgatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctgtgccccctgaggccaggacaagcttccctctgtctgagtcccagactttgctctcttctgcccctgtgcccaaggtaatgctgccctcccttgccccttctaagtttcgaaagccatatgtgagacggagaccctcaaagagaagaggagtcaaggcctctccctgtatgaaacctgcccctgttatccaccaccctgcatctgttatcttcactgttcctgctaccactgtgaagattgtgagccttggcggtggctgtaacatgatccagcctgtcaatgcggctgtggcccagagtccccagactattcccatcactaccctcttggttaaccctacttccttcccctgtccattgaaccagtcccttgtggcctcctctgtctcacccttaattgtttctggcaattctgtgaatcttcctataccatccacccctgaagataaggcccacgtgaatgtggacattgcttgtgctgtggctgatggggaaaatgcctttcagggcctagaacccaaattagagccccaggaactatctcctctctctgctactgttttcccgaaagtggaacatagcccagggcctccactagcagatgcagagtgccaagaaggattgtcagagaatagtgcctgtcgctggaccgttgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaagtaacgaaacagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggaaacaatggagaaactgacttggctggcatctgaaaggcgcatgagtcaggagggtgagtctgaagaagagaattctcaggaggagaactctgagccagaagaagaggaggaagaagaagcagaaggaatggaaagcctgcagaaagaggatgaaatgacggatgaagcagttggagactctgctgagaagcctcctacttttgcttcacctgagactgctccagaagtggagaccagcagaactccaccaggagagagcatcaaagctgctggaaaaggccggaacaatcatcgagctcgcaacaagcggggaagtcgggctcgggccagcaaggacacctccaagctgctgttgctgtatgatgaggacattctcgagcgagatccactcagggagcagaaggacttggcctttgcccaagcttatctgaccagggtgcgagaagccctacaacatatccctggcaagtatgaagacttccttcaagtcatctatgaatttgagtcaagtacccagagacggacggctgtagatctctacaaaagcctgcaaattctgctccaagactggcctcagctgttgaaagactttgctgctttcctgttacctgagcaagctctggcctgtggattatttgaggagcagcaggcttttgagaagagccgcaagttccttcggcagctggagatttgctttgcagagaacccctcacaccaccagaagattatcaaggtcctccaaggctgtgcagactgccttccccaggagatcaccgagctcaagacacagatgtggcagctcctcaagggccacgaccacctgcaggatgagttttctatcttctttgaccacttgcgcccagcagctagccggatgggtgactttgaagagatcaattggactgaggaaaaggagtatgagtttgatggctttgaagaagtggccctgcctgatgtggaagaagaggaggagcctcccaagatacccacagcctcaaagaacaagaggaaaaaagagatcggggtccaaaatcatgataaggagactgaatggccagatggggccaaggactgtgcctgctcctgccatgaaggaggtccagattccaagctgaagaagagcaaaaggcggagctgtagccactgtagcagcaaggtctgtgacagcaaatcctacaagagcaaggagccccatgagttggtgggcagcagcccccaccgagaggctagtcctatgcctggtgctaaggaagctgggcagggcaaggatatgatggaagaggaagccccagaggagcgggagagcactgaggccacccagagcaggactgtcaggaccaccagaaagggagagatgcctgtttcaggattggcagtggggagcactttgccatcccctcgagaagtgactgttacagaacggctcctcctggatggcccaccacctcattcaccagagactcctcaatttccccccacaactggagctgtactgtacactgttaagagaaaccaggttgggcctgaggttcgctcctgccccaaggcatcccccagacttcagaaagagagggagggccaaaaggcagtgagtgagtcagaggctttgatgctggtctgggatgcatcagaaactgagaaattgcctggtaccgtggaaccccctgcttccttcctgagtcctgtttcctcaaagaccagagatgcagggagaagacatgtgtccgggaaaccagacactcaagagagatggctgccctcaagcagagctcgggtgaagacaagagacaggacgtgccctgtccatgaatctccatcaggaattgacacctcagagacttctcccaaagcccctagagggggtttggctaaagacagtggaacacaggccaagggtccagagggggagcagcagccaaaggccgcagaagctacggtgtgtgccaacaacagcaaggtcagctccactggggaaaaggttgtcctgtggacaagggaagctgaccgtgtgatcctcaccatgtgccaggagcaaggggcacagccacagaccttcaacatcatctcccagcagctgggaaataagacccctgctgaggtttcccaccgttttcgagaactcatgcagctcttccacactgcctgtgaagccagctctgaggatgaggatgatgcaaccagtaccagcaatgcagaccagctgtctgaccatggggaccttctgtctgaagaggagctggatgaatgagactctgggaatcatctacacaggaccaaacccaacaggcgccctggcaccggggagggggtagttgtactctgcttgtacagtccttgagcccagtttacagatctggagagcaggaggccaggacaaggacaaaggctggaggatggagtaggacccaggggctctgccatcctaggcatcattcaaggtcttttatgaagactttacagatgtcctctgtaaatagcatcgagagtggagttcagctcctttctctacttttttttggtctgatggcacatatttattgttctgtggtctaatcacagtgtttctaaatgtaaaaagtgcatatgttggtgtagctagtcccgcgacattgagctcctctgcatgaagacactgggctcctgcatccagctgtttttattgcaaactagctcctttctcccacactgggaactttagtccacgaggctgtcaccaccctggtagcactgggccaggctttgtagctcctgcagcagctctgctacgtcatcgtgctccactccagcatccatgaagctggcccagcgccgcaagtcgagtttggtgaggtctctggccaaggcttccagggtctggtgcagggacgaagaggaacacagtgccccaaacactgggatgctctccactgctgtggagggagaggaaacagagacctgtagatggatgattattctgccctgggactcgccaaactgataaggaagtccaaccttagtagacttgattgtaaactcaacaaatttggtgtattgtccccttagtacaccagtactccagaggaagaatgcttttcttgggagccatagggtgaataaaggaatgtttaactgtgga

SEQ ID NO: 803 - DNA, 5506 bp, Homo sapiens
tggcgcatagtgttaggcgcatgctccttgatgcactgcggcgcggcgctccgaggctcggggacgcgcacgcaattcgctgttgttggctgacttccggtggtgccaaagccgtttccgtggaatcaggccggctgaatggaacaaaagtgggacttttaaaatgttgccctgtaagaagagaagaactacagtgacagagtccctacagcataaaggcaatcaagaggaaaacaacgtagacctagaatcagccgttaaaccagaatctgaccaggttaaggacttgagttcggtgtcactatcctgggatccaagtcatggcagagtagctggcttcgaagtacagtctttgcaggatgcaggaaatcagcttggtatggaggatacatctctgagctctggaatgctcacccagaacacaaatgtaccaattctagaaggtgttgatgtggccatctctcagggaatcaccctaccttccttggagtcttttcacccccttaatatacacattggtaaaggaaaactccacgctactggctcaaagagagggaaaaaaatgacactcaggcctgggccagttacccaagaagacagatgtgatcatcttaccctaaaggagcctttttcaggagagcctagtgaagaagtcaaggaagaaggagggaaacctcaaatgaattctgaaggggagataccttccctgccatcaggcagccaatctgcaaaaccagtaagccagcccaggaaatcaacccagccagatgtttgtgcctctcctcaagaaaagccactcaggactctgtttcaccaacctgaggaagagatagaagatggtggactcttcattccaatggaagaacaagacaatgaagaaagtgagaaaaggagaaaaaagaaaaagggtaccaagaggaaacgagatggaaggggtcaagaagggaccttggcatatgacctgaaactggatgacatgcttgaccgtaccttggaggatggtgccaagcagcacaatctaacagcagtcaatgtccgaaacatccttcatgaagtaatcacaaatgaacacgtggtagctatgatgaaagcagccatcagtgagacggaagatatgccaatgtttgagcctaaaatgacacgctctaaactgaaggaagtagtggaaaaaggagtggtaattccaacatggaatatttcaccaattaagaaggccaatgaaattaagcctcctcagtttgtggatatccaccttgaagaagatgattcctcagatgaagaataccagccggatgatgaagaagaagatgaaactgctgaagagagcttattggaaagtgatgttgaaagcactgcttcatctccacgtggggcaaagaaatccagattgaggcagtcttctgagatgactgaaacagatgaggagagtggcatattatcagaggctgagaaagtcaccacaccagccatcaggcacatcagtgctgaggtagtgcccatggggcccccgccccctccaaagccgaaacagaccagagatagtactttcatggagaagttacatgcggtagatgaggagctggcttccagtccagtctgcatggattctttccagcccatggatgacagtctcattgcatttcgaacgcgttctaagatgcccctgaaagatgttcccctgggccaattagaggcagagctccaagctccagacatcactccagatatgtatgaccccaatacggcagatgatgaggactggaagatgtggctggggggacttatgaatgatgatgtggggaatgaagatgaagcagatgatgatgatgatccagaatataatttcctggaagacctcgatgaaccagacacagaggatttccggactgaccgggcagtgagaatcaccaaaaaggaagtaaatgagctgatggaagagctgtttgaaactttccaagatgagatgggattctccaacatggaagatgatggcccagaagaggaggagtgtgtagctgagcctcgtcctaactttaacacccctcaagctctacggtttgaggaaccactggccaacctgttaaatgaacaacatcggacagtgaaggagctatttgaacagctgaagatgaagaaatcttcagccaaacagctgcaggaagtagagaaggttaaaccccagagtgagaaagttcatcagactctgattctggacccagcacagaggaagagactccagcagcagatgcagcagcacgttcagctcttgacccaaatccaccttcttgccacctgcaaccccaacctcaatccggaggccactaccaccaggatatttcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgcgaatgaatttccctgtttgccaaagcaagtggcttggattctggccacaagcaaggttttcatgtatccagagttacttccagtgtgttccctgaaggcaaagaatccccaggataagatcgtcttcaccaaggctgaggacaatttgttagctttaggactgaagcattttgaaggaactgagtttcctaatcctctaatcagcaagtaccttctaacctgcaaaactgcccaccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggaaacaatggagaaactgacttggctggcatctgaaaggcgcatgagtcaggagggtgagtctgaagaagagaattctcaggaggagaactctgagccagaagaagaggaggaagaagaagcagaaggaatggaaagcctgcagaaagaggatgaaatgacggatgaagcagttggagactctgctgagaagcctcctacttttgcttcacctgagactgctccagaagtggagaccagcagaactccaccaggagagagcatcaaagctgctggaaaaggccggaacaatcatcgagctcgcaacaagcggggaagtcgggctcgggccagcaaggacacctccaagctgctgttgctgtatgatgaggacattctcgagcgagatccactcagggagcagaaggacttggcctttgcccaagcttatctgaccagggtgcgagaagccctacaacatatccctggcaagtatgaagacttccttcaagtcatctatgaatttgagtcaagtacccagagacggacggctgtagatctctacaaaagcctgcaaattctgctccaagactggcctcagctgttgaaagactttgctgctttcctgttacctgagcaagctctggcctgtggattatttgaggagcagcaggcttttgagaagagccgcaagttccttcggcagctggagatttgctttgcagagaacccctcacaccaccagaagattatcaaggtcctccaaggctgtgcagactgccttccccaggagatcaccgagctcaagacacagatgtggcagctcctcaagggccacgaccacctgcaggatgagttttctatcttctttgaccacttgcgcccagcagctagccggatgggtgactttgaagagatcaattggactgaggaaaaggagtatgagtttgatggctttgaagaagtggccctgcctgatgtggaagaagaggaggagcctcccaagatacccacagcctcaaagaacaagaggaaaaaagagatcggggtccaaaatcatgataagattggcagtggggagcactttgccatcccctcgagaagtgactgttacagaacggctcctcctggatggcccaccacctcattcaccagagactcctcaatttccccccacaactggagctgtactgtacactgttaagagaaaccaggttgggcctgaggttcgctcctgccccaaggcatcccccagacttcagaaagagagggagggccaaaaggcagtgagtgagtcagaggctttgatgctggtctgggatgcatcagaaactgagaaattgcctggtaccgtggaaccccctgcttccttcctgagtcctgtttcctcaaagaccagagatgcagggagaagacatgtgtccgggaaaccagacactcaagagagatggctgccctcaagcagagctcgggtgaagacaagagacaggacgtgccctgtccatgaatctccatcaggaattgacacctcagagacttctcccaaagcccctagagggggtttggctaaagacagtggaacacaggccaagggtccagagggggagcagcagccaaaggccgcagaagctacggtgtgtgccaacaacagcaaggtcagctccactggggaaaaggttgtcctgtggacaagggaagctgaccgtgtgatcctcaccatgtgccaggagcaaggggcacagccacagaccttcaacatcatctcccagcagctgggaaataagacccctgctgaggtttcccaccgttttcgagaactcatgcagctcttccacactgcctgtgaagccagctctgaggatgaggatgatgcaaccagtaccagcaatgcagaccagctgtctgaccatggggaccttctgtctgaagaggagctggatgaatgagactctgggaatcatctacacaggaccaaacccaacaggcgccctggcaccggggagggggtagttgtactctgcttgtacagtccttgagcccagtttacagatctggagagcaggaggccaggacaaggacaaaggctggaggatggagtaggacccaggggctctgccatcctaggcatcattcaaggtcttttatgaagactttacagatgtcctctgtaaatagcatcgagagtggagttcagctcc

SEQ ID NO: 804 - DNA, 1033 bp, Homo sapiens
atggcggcagcggctgggggcgcggcgagccgccggggtgccgggcggccctgccccttctccatcgagcacatcctctccagcctgcccgagcggagcctcccggcccgggccgcctgcccaccgcagcccgccggtcgccagagccccgcgaagccagaggagcccggggcgcccgaggctgcgccctgcgcctgctgctgctgctgcggcccccgcgcggcgccctgcgggcccccagaggcggccgccgggctgggcgctcgtctggcgtggccgctgaggctgggaccggcggtgcccttgtctctgggtgcgccagccggaggttccggggcgctcccgggcgcggtcggcccgggttcgcagcggcgcacgaggcgccaccgcaccatcttcagcgaagagcagctgcaggcgctcgaggcgcttttcgtgcagaaccagtatcctgacgtgagtacgcgcgagcgcctggccggccgcatccgccttcgcgaggagcgcgtggaggtctggttcaagaaccgccgggccaaatggcgacaccagaagcgcgcgtcggcttccgcgaggctcctgcccggcgtcaagaagtccccgaaggggagctgctgatgactctaggagctgcccctgggctcggccaccctttttgggatctttggagttggcgctgagagaagacaggtctacccgaaaaggagctgggagagtacaccggccgcctccacccgtctccacagcccttgcctcctgcagctcgtgctgccgtggcgctggggacgggcccccggtgcttggtgttccacggcagtgggagtggcgagtcccttgggggtgggctggggcatagagcagtttcctcagctccctaccccccgagagacactaactccaccgcaggaggggaaccaccccgtatcaacacgggacccagaatcctacgcagtggagcgtctctccgcaccctgggacatgctggccaccctcttctcaatgtggacattgacctaacttgacctggctcgtc

SEQ ID NO: 805 - DNA, 1870 bp, Homo sapiens
aggagatgtgccaaactgttaagagtggttatttctgagcagaagaatgtggatgaattccattcttcctatttttcttttcaggtctgtgcggctgctaaagaacgacccagtcaacttgcagaaattctcttacactagtgaggatgaggcctggaagacgtacctagaaaacccgttgacagctgccacaaaggccatgatgagagtcaatggagatgatgacagtgttgcggccttgagcttcctctatgattactacatgggtcccaaggagaagcggatattgtcctccagcactgggggcaggaatgaccaaggaaagaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacacagcgctggcagccagacagcaccttcaaagatgacccacaggagtcgatgctcttcccagatatcctgaaaacctccccggaacccccatgtccagaggactaccccagcctcaaaagtgactttgaatacaccctgggctcccccaaagccatccacatcaagtcaggcgagtcacccatggcctacctcaacaaaggccagttctaccccgtcaccctgcggaccccagcaggtggcaaaggccttgccttgtcctccaacaaagtcaagagtgtggtgatggttgtcttcgacaatgagaaggtcccagtagagcagctgcgcttctggaagcactggcattcccggcaacccactgccaagcagcgggtcattgacgtggctgactgcaaagaaaacttcaacactgtggagcacattgaggaggtggcctataatgcactgtcctttgtgtggaacgtgaatgaagaggccaaggtgttcatcggcgtaaactgtctgagcacagacttttcctcacaaaagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggcagccccctcggcaggacccagcagctccaacaggctgcctctgaagcgtacctgctcgcccttcactgaggagtttgagcctctgccctccaagcaggccaaggaaggcgaccttcagagagttctgctgtatgtgcggagggagactgaggaggtgtttgacgcgctcatgttgaagaccccagacctgaaggggctgaggaatgcgatctctgagaagtatgggttccctgaagagaacatttacaaagtctacaagaaatgcaagcgaggaatcttagtcaacatggacaacaacatcattcagcattacagcaaccacgtcgccttcctgctggacatgggggagctggacggcaaaattcagatcatccttaaggagctgtaa

SEQ ID NO: 806 - DNA, 2799 bp, Homo sapiens
ccagcgctgctgggaacctacctgtcagcaaaatctcgacacccaaacctcaacataaatcaaacactttcccgggcagagaatgtctgtgtcaggcaagaattagagacaagcggtcagcagagcctcagtgctgatcgtcggagcttgggagcaggaagatgtcgaatgaacttgatttcaggtctgtgcggctgctaaagaacgacccagtcaacttgcagaaattctcttacactagtgaggatgaggcctggaagacgtacctagaaaacccgttgacagctgccacaaaggccatgatgagagtcaatggagatgatgacagtgttgcggccttgagcttcctctatgattactacatgggtcccaaggagaagcggatattgtcctccagcactgggggcaggaatgaccaaggaaagaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacacagcgctggcagccagacagcaccttcaaagatgacccacaggagtcgatgctcttcccagatatcctgaaaacctccccggaacccccatgtccagaggactaccccagcctcaaaagtgactttgaatacaccctgggctcccccaaagccatccacatcaagtcaggcgagtcacccatggcctacctcaacaaaggccagttctaccccgtcaccctgcggaccccagcaggtggcaaaggccttgccttgtcctccaacaaagtcaagagtgtggtgatggttgtcttcgacaatgagaaggtcccagtagagcagctgcgcttctggaagcactggcattcccggcaacccactgccaagcagcgggtcattgacgtggctgactgcaaagaaaacttcaacactgtggagcacattgaggaggtggcctataatgcactgtcctttgtgtggaacgtgaatgaagaggccaaggtgttcatcggcgtaaactgtctgagcacagacttttcctcacaaaagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggcagccccctcggcaggacccagcagctccaacaggctgcctctgaagcgtacctgctcgcccttcactgaggagtttgagcctctgccctccaagcaggccaaggaaggcgaccttcagagagttctgctgtatgtgcggagggagactgaggaggtgtttgacgcgctcatgttgaagaccccagacctgaaggggctgaggaatgcgatctctgagaagtatgggttccctgaagagaacatttacaaagtctacaagaaatgcaagcgaggaatcttagtcaacatggacaacaacatcattcagcattacagcaaccacgtcgccttcctgctggacatgggggagctggacggcaaaattcagatcatccttaaggagctgtaaggcctctcgagcatccaaaccctcacgacctgcaaggggccagcagggacgtggccccacgccacacacaacctctccacatgcctcagcgctgttacttgaatgccttccctgagggaagaggcccttgagtcacagacccacagacgtcagggccagggagagacctagggggtcccctggcctggatccccatggtatgcttgaatctgctccctgaacttcctgccagtgcctccccgtaccccaaaacaatgtcaccatggttaccacctacccagaagactgttccctcctcccaagacccttgtctgcagtggtgctcctgcaggctgcccgttaagatggtggcggcacacgctccctcccgcagcaccacgccagctggtgcggcccccactctctgtcttccttcaacttcagacaaaggatttctcaacctttggtcagttaacttgaaaactcttgattttcagtgcaaatgacttttaaaagacactatattggagtctctttctcagacttcctcagcgcaggatgtaaatagcactaacgatcgactggaacaaagtgaccgctgtgtaaaactactgccttgccactcactgttgtatacatttcttatttacgattttcatttgttatatatatatataaatatactgtatatatatgcaacattttatatttttcatggatatgtttttatcatttcaaaaaatgtgtatttcacatttcttggactttttttagctgttattcagtgatgcattttgtatactcacgtggtatttagtaataaaaatctatctatgtattacgtcacatt

SEQ ID NO: 807 - DNA, 2119 bp, Homo sapiens
ctcgacacccaaacctcaacataaatcaaacactttcccgggcagagaatgtctgtgtcaggcaagaattagagacaagcggtcagcagagcctcagtgctgatcgtcggagcttgggagcaggaagatgtcgaatgaacttgatttcaggtctgtgcggctgctaaagaacgacccagtcaacttgcagaaattctcttacactagtgaggatgaggcctggaagacgtacctagaaaacccgttgacagctgccacaaaggccatgatgagagtcaatggagatgatgacagtgttgcggccttgagcttcctctatgattactacatgggtcccaaggagaagcggatattgtcctccagcactgggggcaggaatgaccaaggaaagaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacacagcgctggcagccagacagcaccttcaaagatgacccacaggagtcgatgctcttcccagatatcctgaaaacctccccggaacccccatgtccagaggactaccccagcctcaaaagtgactttgaatacaccctgggctcccccaaagccatccacatcaagtcaggcgagtcacccatggcctacctcaacaaaggccagttctaccccgtcaccctgcggaccccagcaggtggcaaaggccttgccttgtcctccaacaaagtcaagagtgtggtgatggttgtcttcgacaatgagaaggtcccagtagagcagctgcgcttctggaagcactggcattcccggcaacccactgccaagcagcgggtcattgacgtggctgactgcaaagaaaacttcaacactgtggagcacattgaggaggtggcctataatgcactgtcctttgtgtggaacgtgaatgaagaggccaaggtgttcatcggcgtaaactgtctgagcacagacttttcctcacaaaagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggcagccccctcggcaggacccagcagctccaacaggctgcctctgaagcgtacctgctcgcccttcactgaggagtttgagcctctgccctccaagcaggccaaggaaggcgaccttcagagagttctgctgtatgtgcggagggagactgaggaggtgtttgacgcgctcatgttgaagaccccagacctgaaggggctgaggaatgcgatctctgagaagtatgggttccctgaagagaacatttacaaagtctacaagaaatgcaagcgaggggaaacttctctcctccacccacgcctgtctcgccaccccccacctgactgtcttgaatgttcccatcctgtgactcaagtgaggaacatgggttttggagatggattttggaggcagagggacctggattcaaatcccagccccaccaccgtcaacagcctgcacttcactgtaaactcggaatgacacacccacctggaggagaggtggaaggacgacggcaggtcacatctgagagctctcagctcagagtatgtggcccctgaatacattctggctattactttgcatttaaaa

SEQ ID NO: 808 - DNA, 2804 bp, Homo sapiens
tgagtgagtaaacatcggtggatacctgccgctctcagagcgtggaggctggatggggtttcctggagggggaagagcggggaggccggcaccgggattcacagagcaatttgtaagggtaaatgaatgggctgacgatcttactttggcgtgtcaaggcaagccccagtctcaagctagagtttcaggtctgtgcggctgctaaagaacgacccagtcaacttgcagaaattctcttacactagtgaggatgaggcctggaagacgtacctagaaaacccgttgacagctgccacaaaggccatgatgagagtcaatggagatgatgacagtgttgcggccttgagcttcctctatgattactacatgggtcccaaggagaagcggatattgtcctccagcactgggggcaggaatgaccaaggaaagaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacacagcgctggcagccagacagcaccttcaaagatgacccacaggagtcgatgctcttcccagatatcctgaaaacctccccggaacccccatgtccagaggactaccccagcctcaaaagtgactttgaatacaccctgggctcccccaaagccatccacatcaagtcaggcgagtcacccatggcctacctcaacaaaggccagttctaccccgtcaccctgcggaccccagcaggtggcaaaggccttgccttgtcctccaacaaagtcaagagtgtggtgatggttgtcttcgacaatgagaaggtcccagtagagcagctgcgcttctggaagcactggcattcccggcaacccactgccaagcagcgggtcattgacgtggctgactgcaaagaaaacttcaacactgtggagcacattgaggaggtggcctataatgcactgtcctttgtgtggaacgtgaatgaagaggccaaggtgttcatcggcgtaaactgtctgagcacagacttttcctcacaaaagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggcagccccctcggcaggacccagcagctccaacaggctgcctctgaagcgtacctgctcgcccttcactgaggagtttgagcctctgccctccaagcaggccaaggaaggcgaccttcagagagttctgctgtatgtgcggagggagactgaggaggtgtttgacgcgctcatgttgaagaccccagacctgaaggggctgaggaatgcgatctctgagaagtatgggttccctgaagagaacatttacaaagtctacaagaaatgcaagcgaggaatcttagtcaacatggacaacaacatcattcagcattacagcaaccacgtcgccttcctgctggacatgggggagctggacggcaaaattcagatcatccttaaggagctgtaaggcctctcgagcatccaaaccctcacgacctgcaaggggccagcagggacgtggccccacgccacacacaacctctccacatgcctcagcgctgttacttgaatgccttccctgagggaagaggcccttgagtcacagacccacagacgtcagggccagggagagacctagggggtcccctggcctggatccccatggtatgcttgaatctgctccctgaacttcctgccagtgcctccccgtaccccaaaacaatgtcaccatggttaccacctacccagaagactgttccctcctcccaagacccttgtctgcagtggtgctcctgcaggctgcccgttaagatggtggcggcacacgctccctcccgcagcaccacgccagctggtgcggcccccactctctgtcttccttcaacttcagacaaaggatttctcaacctttggtcagttaacttgaaaactcttgattttcagtgcaaatgacttttaaaagacactatattggagtctctttctcagacttcctcagcgcaggatgtaaatagcactaacgatcgactggaacaaagtgaccgctgtgtaaaactactgccttgccactcactgttgtatacatttcttatttacgattttcatttgttatatatatatataaatatactgtatatatatgcaacattttatatttttcatggatatgtttttatcatttcaaaaaatgtgtatttcacatttcttggactttttttagctgttattcagtgatgcattttgtatactcacgtggtatttagtaataaaaatctatctatgtattacgtcacatta

SEQ ID NO: 809 - DNA, 2869 bp, Homo sapiens
agagttaacagctgcacctgttgaggtatacctccagtcgccggcacctgtacctgtagccaatcagcgccagcgctgctgggaacctacctgtcagcaaaatctcgacacccaaacctcaacataaatcaaacactttcccgggcagagaatgtctgtgtcaggcaagaattagagacaagcggtcagcagagcctcagtgctgatcgtcggagcttgggagcaggaagatgtcgaatgaacttgatttcaggtctgtgcggctgctaaagaacgacccagtcaacttgcagaaattctcttacactagtgaggatgaggcctggaagacgtacctagaaaacccgttgacagctgccacaaaggccatgatgagagtcaatggagatgatgacagtgttgcggccttgagcttcctctatgattactacatgggtcccaaggagaagcggatattgtcctccagcactgggggcaggaatgaccaaggaaagaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacacagcgctggcagccagacagcaccttcaaagatgacccacaggagtcgatgctcttcccagatatcctgaaaacctccccggaacccccatgtccagaggactaccccagcctcaaaagtgactttgaatacaccctgggctcccccaaagccatccacatcaagtcaggcgagtcacccatggcctacctcaacaaaggccagttctaccccgtcaccctgcggaccccagcaggtggcaaaggccttgccttgtcctccaacaaagtcaagagtgtggtgatggttgtcttcgacaatgagaaggtcccagtagagcagctgcgcttctggaagcactggcattcccggcaacccactgccaagcagcgggtcattgacgtggctgactgcaaagaaaacttcaacactgtggagcacattgaggaggtggcctataatgcactgtcctttgtgtggaacgtgaatgaagaggccaaggtgttcatcggcgtaaactgtctgagcacagacttttcctcacaaaagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggcagccccctcggcaggacccagcagctccaacaggctgcctctgaagcgtacctgctcgcccttcactgaggagtttgagcctctgccctccaagcaggccaaggaaggcgaccttcagagagttctgctgtatgtgcggagggagactgaggaggtgtttgacgcgctcatgttgaagaccccagacctgaaggggctgaggaatgcgatctctgagaagtatgggttccctgaagagaacatttacaaagtctacaagaaatgcaagcgaggaatcttagtcaacatggacaacaacatcattcagcattacagcaaccacgtcgccttcctgctggacatgggggagctggacggcaaaattcagatcatccttaaggagctgtaaggcctctcgagcatccaaaccctcacgacctgcaaggggccagcagggacgtggccccacgccacacacaacctctccacatgcctcagcgctgttacttgaatgccttccctgagggaagaggcccttgagtcacagacccacagacgtcagggccagggagagacctagggggtcccctggcctggatccccatggtatgcttgaatctgctccctgaacttcctgccagtgcctccccgtaccccaaaacaatgtcaccatggttaccacctacccagaagactgttccctcctcccaagacccttgtctgcagtggtgctcctgcaggctgcccgttaagatggtggcggcacacgctccctcccgcagcaccacgccagctggtgcggcccccactctctgtcttccttcaacttcagacaaaggatttctcaacctttggtcagttaacttgaaaactcttgattttcagtgcaaatgacttttaaaagacactatattggagtctctttctcagacttcctcagcgcaggatgtaaatagcactaacgatcgactggaacaaagtgaccgctgtgtaaaactactgccttgccactcactgttgtatacatttcttatttacgattttcatttgttatatatatatataaatatactgtatatatatgcaacattttatatttttcatggatatgtttttatcatttcaaaaaatgtgtatttcacatttcttggactttttttagctgttattcagtgatgcattttgtatactcacgtggtatttagtaataaaaatctatctatgtattacgtcacatta

SEQ ID NO: 810 - DNA, 1663 bp, Homo sapiens
gtgggcgcagagggcgggctggctgcggggcgaccgcgcgccggggccatgccgcgctccttcctggtggactcgctagtgctgcgcgaggcgggcgagaagaaggcgcccgagggcagcccgccgccgctcttcccctacgctgtgcccccgccgcacgcgctgcacggtctctcgcctggcgcctgccacgcgcgcaaggctgggctgctgtgcgtgtgcccgctctgcgtcaccgcctcgcagctgcatgggccccccgggccgcccgcgctgcctctactcaaggcttccttcccacccttcggctcgcagtactgccacgcgcccctgggccgccagcactctgctgtgtcgcccggggtcgctcacggcccggccgccgctgctgctgccgccgcgctctaccagacctcctacccgctgcctgaccccaggcagttccactgcatctctgtggacagcagctctaaccagctgcccagcagcaagaggatgcgcacggctttcaccagcacgcagctgctagagctggagcgcgagttcgcttctaatatgtacctgtcccgcctacgtcgcatcgagatcgcgacctacctgaatctgtccgagaagcaggtgaagatctggtttcagaaccgccgagtgaagcacaagaaggagggcaagggcagcaaccatcgtggcggcggcggcgggggtgccggtggtggcgggagcgcaccgcaaggctgcaagtgcgcatcgctctcctcagccaagtgctccgaggatgacgacgaattgcccatgtctccgtcctcctcagggaaggacgaccgggatcttacggtcactccctaggcgcgtgtctccctaggtcgcccaccccaagacctccctgcgcctcggagactagtcctgggactcagcgctgattcccaggcacccgcagccaaaccactgcctggcatggatttggcactgctttgcagaggtcccgggcctgggcagggctgagagcttggcagagactggaccatggcgtccccgccccagggctcgctcgtgtccaaagccaactccaagctgtgaacactgtaagcgctcgagtcctcctgggcagtgcagcaccgcggcccccgcccgcaagcctgcttggcgcagcgccttgctggcagccggcgcctcctagcccgccctctctgggctggcttgggcttcctcgcttactctactctcctccgctctcggtcaaggtcggcggccttggatgctcgttcgcttctctttttaaaatgtctttttgtccctccccacctctttcctgtgatcatttattcactcggcccccgcccgccaacacacacatttatgaacccccactttttttttccttctccttttcccttcccctcctcagggagcctcctccttcagtcagtccatttgtcccttgatctggccttgctgtcctcagtccccacggctcctctcacagatgataaatttcgcccgtagtatccatattggggaaacagatttgctctgtttccaacacgctcttccttcctctaaacataggaccccgctctgcgccgctggcgaccccactcttccccctccagactctggcccgccccagcctagctgtgtaattgtacggcctctgcaatgccagaag

SEQ ID NO: 811 - DNA, 1812 bp, Homo sapiens
gcggcttctgttgtgactcgggcagcctatcccgagggtgcggagctgccgaggagcctgagccgagcggtactccgcagcatcacgtgccagggtggggggctataaaatacccgagccggggcgccgggcgggggacgtgaggaccagccctctccggggacccctttgttcccagcccagacgccaacacctctgcgtccccaagggcttgactgcccgtgtctgcgcggctcccagggcagagcttagaacactagaggagaggggtcgccgcgaactgccggggcttccagccacccacccctctcgacatgtcgcgctccttctatgtcgactcgctcatcatcaaggacacctcacggcctgcgccctcgctgcctgaaccgcaccccgggccggatttcttcatcccgcttggcatgccgcccccattggtgatgtccgtgtccggccccggctgcccgtcccgcaagagcggcgcgttctgcgtgtgccctctctgcgtcacttcgcacctgcactcctctcgggggtctgtgggcgccggcagcgggggcgcaggggccggggttaccggggccggaggcagtggggtggcaggggccgcaggggcactgcctctgcttaagggccagttctcttcggctcctggggacgcgcagttttgcccgcgggtgaaccatgcgcatcatcaccaccacccgccgcagcaccaccatcaccatcatcagccccagcagcctggctcggccgcggcggcggcagcagcagcagcggcggcggcggccgcggcggccttggggcacccgcagcaccacgcacctgtctgcaccgccaccacctacaacgtggcggacccgcggagattccactgcctcaccatgggaggctctgacgccagccaggtacccaatggcaagaggatgaggacggcgttcactagcacgcaactcctggagctggagagagaattctcttccaacatgtacctgtctcgactccggaggattgaaatcgccacttacctgaacctgtcggagaagcaggtgaaaatctggtttcagaaccgccgagtgaagcacaagaaggaggggaagggcacgcagaggaacagtcacgcgggctgcaagtgcgtcgggagccaggtgcactacgcgcgctccgaggatgaggactccctgtcgccggcctcagccaacgatgacaaggagatttcccccttatgagggagggcctcctccctcacatcccccgctcctggcagaccaggcaacgccaaggcgtggggcacccaggggccagaatccttgctcattgcagtggtcccatctggagaagaaacgaacctggaagttctggaatggacaagccgggacctgacccttcgcgtctccttcttgacctgtttatctaggactccaacttgaagttacagatttttttaaaaaatgtaaataacctataattcaactcattcttgtcgtataacagaggaaaaacagggttggtttaagtttaacactgtatggggtttttgaaagcacatgtcagttccccatccctactctctttcagaactcgataagaacacaggatttattgattattttctgttgtcgttttcaaacaaaaacacccaagttgaaaataatttagaaaattagaccttgtaggtcttgctttctgaaatttcgcctggggagaatttaaaatctaagtcgctggaagtccctttgtatgtgaataggtttatataaaatttatatttatatttatttaaataaatgaaacaaaaaccagaattttaaa

SEQ ID NO: 812 - DNA, 3558 bp, Homo sapiens
gggaaagaaagaaagagaaaaaggagggcgagtggcgagcaggggcctcggccgccacccacacgccccgaagcgtgctcgtcccccgcgcggggctcccggccgccgccctcggccatcggctgctccccggtggcccaggcctcggactccgcggccggcccggcgcggcccagcgccctcagggatcatggcccaggtagcagtgtccaccctgcctgttgaagaagagtcctcctcagagaccaggatggtggtgacattcctcgtgtctgccctcgaatccatgtgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgcgttgcagagggactgtgtgaggtgaaacctccctgccctgtgaacgggatgcaggtccactcgggcgaaacggaaatactcaggaaggcagtggaggactatttctgcttttgttatggtaaagccttagggacaacagtgatggtgcctgttccctatgagaagatgctgcgagaccagtcggctgtggtagtgcaggggcttccggaaggcgttgcctttcaacaccctgagaattacgaccttgcaaccctgaaatggattttggagaacaaagcagggatttcattcatcataaatagacccttcctaggaccagagagtcagctgggtggccctgggatggtaacagatgcggagagatccatagtatcaccaagtgaaagctgcggccccatcaatgtgaaaactgaacccatggaagattctggcatttcactgaaagcagaagctgtctcagtcaagaaagaatcagaagatcctaattactatcaatataatatgcaaggaagccacccttcttccacaagcaatgaagtaatagaaatggaattaccaatggaagattccactccgctggtcccttcagaagaaccaaatgaggaccctgaagccgaggtgaaaatcgaaggaaacacaaattcatccagtgttacaaattctgcagcaggtgttgaagatcttaacatcgttcaagtgactgttccagataatgagaaggaaagattatcaagcattgaaaagattaaacagctaagagaacaagttaatgacctctttagccgaaaatttggtgaagcaattggcgtggatttccctgtgaaagttccctacaggaagatcacattcaaccctggctgtgtggtgattgatggcatgcccccgggggtggtattcaaggcccccggctatctggaaatcagttccatgaggaggatcttggaggcagctgagtttatcaaattcacagtcatcaggccgcttccagggcttgagctcagtaatgtgggaaaacgcaagatagaccaggagggccgtgtgtttcaagaaaagtgggagagagcgtatttcttcgtggaagtacagaatattccaacatgtctcatatgcaaacaaagcatgtctgtgtccaaagaatataacctaagacgccactatcaaaccaatcacagcaagcattatgaccagtatatggaaagaatgcgtgacgagaagcttcacgagctgaaaaaagggctcaggaagtatctcttaggcttgtcagacaccgagtgtcccgagcaaaaacaagtgtttgcacacccaagtccaacccagaaatcccccgtgcagcctgtagaggacctagctgggaacttatgggagaagttacgtgaaaaaatcaggtcttttgtggcatattctatcgcaatcgatgagatcacggatataaataataccacccagttggccatattcatccgtggtgtcgatgagaatttcgatgtgtccgaagaacttctggacacggtgcccatgacgggtacaaaatctggcaacgagatcttttcgcgtgttgagaagagcctgaaaaagttctgtatcgactggtcgaaattagtaagcgtggcctccactggcaccccagcgatggtggatgccaataacgggcttgtcacaaaactgaagtccagggtggcgacgttctgcaagggtgcggaactgaagtccatctgttgtataattcatccggaatcactctgtgctcagaagttgaagatggaccacgtcatggacgtggtagtgaagtccgtgaactggatatgctcccggggactgaaccacagtgagttcacaaccttgctctatgagctggacagccagtatggtagcctcctgtactacacggagattaagtggctcagtcgcgggctcgtgctaaagagatttttcgaatccttggaagaaatcgactccttcatgtcatccagagggaaacccctgcctcaactgagctccatagattggatccgagacctggccttcttggttgacatgacgatgcatctgaacgctttgaacatctctctccaaggacactcccaaatcgtcacgcagatgtatgacctgatccgggcgttcctagcaaaactgtgcctctgggagactcatttgacgaggaataatctggcccactttcccaccctgaaattggcttccagaaatgaaagcgatggcctgaactacattcccaaaatcgcggaactcaagaccgaattccagaaaaggctgtctgatttcaaactctacgaaagcgaactgactctgttcagctccccgttctccacgaagatcgacagtgtgcacgaggagctccagatggaggttatcgacctgcaatgcaacacggtcctgaagacgaaatacgacaaggtgggaataccagaattctacaagtacctctggggtagctacccgaaatacaagcaccattgcgcaaagattctttccatgttcgggagcacctacatctgcgaacagctgttctccattatgaaactgagcaaaacaaaatactgctcccagttaaaggattcccagtgggattctgtactccacatcgcaacgtgatggagagaaaactcctggcagggccctatggtgggaaaggctggagtcttctagtcccaagggattgggagatgacaaaatgaatttttttttcttttttgagatggagtcttgctctgtcgcccaggttggagtgcagtggcgtgatctcggcttactgcaacttccagctcctgggttcgaacgattctcctgcctcagcctcccgagcagctgggactacaggcgtgcgccaccatgcctggctaatttttgtattagtagagatgaggtttcaccatgttggccaggctggtctccaactcctgacctcaggtgatccacctgcctcgacctcacaaagtgctgggattacaggcatgaaccactgtgcccagctgacaaaatgagttcttaaacttttttttttttcagttttttttccactttgaatcagaaatataatctgcagtatcatacttgtttatattacattgtgtgcctcactattcattaaaaatcaagaaagttttattgta

SEQ ID NO: 813 - DNA, 2242 bp, Homo sapiens
agtgactgttccagataatgagaaggaaagattatcaagcattgaaaagattaaacagctaagagaacaagttaatgacctctttagccgaaaatttggccgcttccagggcttgagctcagtaatgtgggaaaacgcaagatagaccaggagggccgtgtgtttcaagaaaagtgggagagagcgtatttcttcgtggaagtacagaatattccaacatgtctcatatgcaaacaaagcatgtctgtgtccaaagaatataacctaagacgccactatcaaaccaatcacagcaagcattatgaccagtatatggaaagaatgcgtgacgagaagcttcacgagctgaaaaaagggctcaggaagtatctcttaggcttgtcagacaccgagtgtcccgagcaaaaacaagtgtttgcacacccaagtccaacccagaaatcccccgtgcagcctgtagaggacctagctgggaacttatgggagaagttacgtgaaaaaatcaggtcttttgtggcatattctatcgcaatcgatgagatcacggatataaataataccacccagttggccatattcatccgtggtgtcgatgagaatttcgatgtgtccgaagaacttctggacacggtgcccatgacgggtacaaaatctggcaacgagatcttttcgcgtgttgagaagagcctgaaaaagttctgtatcgactggtcgaaattagtaagcgtggcctccactggcaccccagcgatggtggatgccaataacgggcttgtcacaaaactgaagtccagggtggcgacgttctgcaagggtgcggaactgaagtccatctgttgtataattcatccggaatcactctgtgctcagaagttgaagatggaccacgtcatggacgtggtagtgaagtccgtgaactggatatgctcccggggactgaaccacagtgagttcacaaccttgctctatgagctggacagccagtatggtagcctcctgtactacacggagattaagtggctcagtcgcgggctcgtgctaaagagatttttcgaatccttggaagaaatcgactccttcatgtcatccagagggaaacccctgcctcaactgagctccatagattggatccgagacctggccttcttggttgacatgacgatgcatctgaacgctttgaacatctctctccaaggacactcccaaatcgtcacgcagatgtatgacctgatccgggcgttcctagcaaaactgtgcctctgggagactcatttgacgaggaataatctggcccactttcccaccctgaaattggcttccagaaatgaaagcgatggcctgaactacattcccaaaatcgcggaactcaagaccgaattccagaaaaggctgtctgatttcaaactctacgaaagcgaactgactctgttcagctccccgttctccacgaagatcgacagtgtgcacgaggagctccagatggaggttatcgacctgcaatgcaacacggtcctgaagacgaaatacgacaaggtgggaataccagaattctacaagtacctctggggtagctacccgaaatacaagcaccattgcgcaaagattctttccatgttcgggagcacctacatctgcgaacagctgttctccattatgaaactgagcaaaacaaaatactgctcccagttaaaggattcccagtgggattctgtactccacatcgcaacgtgatggagagaaaactcctggcagggccctatggtgggaaaggctggagtcttctagtcccaagggattgggagatgacaaaatgaatttttttttcttttttgagatggagtcttgctctgtcgcccaggttggagtgcagtggcgtgatctcggcttactgcaacttccagctcctgggttcgaacgattctcctgcctcagcctcccgagcagctgggactacaggcgtgcgccaccatgcctggctaatttttgtattagtagagatgaggtttcaccatgttggccaggctggtctccaactcctgacctcaggtgatccacctgcctcgacctcacaaagtgctgggattacaggcatgaaccactgtgcccagctgacaaaatgagttcttaaacttttttttttttcagttttttttccactttgaatcagaaatataatctgcagtatcatacttgtttatattacattgtgtgcctcactattcattaaaaatcaagaaagttt

SEQ ID NO: 814 - DNA, 1869 bp, Homo sapiens
aaagagaaaaaggagggcgagtggcgagcaggggcctcggccgccacccacacgccccgaagcgtgctcgtcccccgcgcggggctcccggccgccgccctcggccatcggctgctccccggtggcccaggcctcggactccgcggccggcccggcgcggcccagcgccctcagggatcatggcccaggtagcagtgtccaccctgcctgttgaagaagagtcctcctcagagaccaggatggtggtgacattcctcgtgtctgccctcgaatccatgtgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgcgttgcagagggactgtgtgaggtgaaacctccctgccctgtgaacgggatgcaggtccactcgggcgaaacggaaatactcaggaaggcagtggaggactatttctgcttttgttatggtaaagccttagggacaacagtgatggtgcctgttccctatgagaagatgctgcgagaccagtcggctgtggtagtgcaggggcttccggaaggcgttgcctttcaacaccctgagaattacgaccttgcaaccctgaaatggattttggagaacaaagcagggatttcattcatcataaatagacccttcctaggaccagagagtcagctgggtggccctgggatggtaacagatgcggagagatccatagtatcaccaagtgaaaggcatttcactgaaagcagaagctgtctcagtcaagaaagaatcagaagatcctaattactatcaatataatatgcaaggaagccacccttcttccacaagcaatgaagtaatagaaatggaattaccaatggaagattccactccgctggtcccttcagaagaaccaaatgaggaccctgaagccgaggtgaaaatcgaaggaaacacaaattcatccagtgttacaaattctgcagcaggtgttgaagatcttaacatcgttcaagtgactgttccagataatgagaaggaaagattatcaagcattgaaaagattaaacagctaagagaacaagttaatgacctctttagccgaaaatttggtgaagcaattggcgtggatttccctgtgaaagttccctacaggaagatcacattcaaccctggctgtgtggtgattgatggcatgcccccgggggtggtattcaaggcccccggctatctggaaatcagttccatgaggaggatcttggaggcagctgagtttatcaaattcacagtcatcaggccgcttccagggcttgagctcagtaatggacttttggaggccaaggcaagaggattgcttgaggccaggagtttgagaccagcctgggcaacatagcaagaccccatctctacaaaaaatttaaaaattagctggaaacagtggctcacacctgtagccccagctacttggcaggctaaagcaggaggatcacttaaactcaggagtttgagacagcagagaaccataattgcaatactatactccagcctgggtgacagaacaagaccctgtctctaaaaagaaaatgcaaacatattatcaaataattcctgtttaaactggacataacaagcacagctacatgctgaacctcatcaaaggtgtcttttgtttggctcatgtacttttgaaaataaggatgaggcctggcacggtggctcctgtaatcccagcactttgggaggccaaggcgggtggatcgcttgagcctggggtttcagaccagcctgggcaacaaggtaagactccagctct

SEQ ID NO: 815 - DNA, 3545 bp, Homo sapiens
agaaaaaggagggcgagtggcgagcaggggcctcggccgccacccacacgccccgaagcgtgctcgtcccccgcgcggggctcccggccgccgccctcggccatcggctgctccccggtggcccaggcctcggactccgcggccggcccggcgcggcccagcgccctcagggatcatggcccaggtagcagtgtccaccctgcctgttgaagaagagtcctcctcagagaccaggatggtggtgacattcctcgtgtctgccctcgaatccatgtgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgcgttgcagagggactgtgtgaggtgaaacctccctgccctgtgaacgggatgcaggtccactcgggcgaaacggaaatactcaggaaggcagtggaggactatttctgcttttgttatggtaaagccttagggacaacagtgatggtgcctgttccctatgagaagatgctgcgagaccagtcggctgtggtagtgcaggggcttccggaaggcgttgcctttcaacaccctgagaattacgaccttgcaaccctgaaatggattttggagaacaaagcagggatttcattcatcataaatagacccttcctaggaccagagagtcagctgggtggccctgggatggtaacagatgcggagagatccatagtatcaccaagtgaaagctgcggccccatcaatgtgaaaactgaacccatggaagattctggcatttcactgaaagcagaagctgtctcagtcaagaaagaatcagaagatcctaattactatcaatataatatgcaaggaagccacccttcttccacaagcaatgaagtaatagaaatggaattaccaatggaagattccactccgctggtcccttcagaagaaccaaatgaggaccctgaagccgaggtgaaaatcgaaggaaacacaaattcatccagtgttacaaattctgcagcaggtgttgaagatcttaacatcgttcaagtgactgttccagataatgagaaggaaagattatcaagcattgaaaagattaaacagctaagagaacaagttaatgacctctttagccgaaaatttggtgaagcaattggcgtggatttccctgtgaaagttccctacaggaagatcacattcaaccctggctgtgtggtgattgatggcatgcccccgggggtggtattcaaggcccccggctatctggaaatcagttccatgaggaggatcttggaggcagctgagtttatcaaattcacagtcatcaggccgcttccagggcttgagctcagtaatgtgggaaaacgcaagatagaccaggagggccgtgtgtttcaagaaaagtgggagagagcgtatttcttcgtggaagtacagaatattccaacatgtctcatatgcaaacaaagcatgtctgtgtccaaagaatataacctaagacgccactatcaaaccaatcacagcaagcattatgaccagtatacggaaagaatgcgtgacgagaagcttcacgagctgaaaaaagggctcaggaagtatctcttaggctcgtcagacaccgagtgtcccgagcaaaaacaagtgtttgcaaacccaagtccaacccagaaatcccccgtgcagcctgtagaggacctagctgggaacttatgggagaagttacgtgaaaaaatcaggtcttttgtggcatattctatcgcaatcgatgagatcacggatataaataataccacccagttggccatattcatccgtggtgtcgatgagaatttcgatgtgtccgaagaacttctggacacggtgcccatgacgggtacaaaatctggcaacgagatctttttgcgtgttgagaagagcctgaaaaagttctgtatcaactggtcgagattagtaagcgtggcctccactggcaccccagcgatggtggatgccaataacgggcttgtcacaaaactgaagtccagggtggcgacgttctgcaagggtgcggaactgaagtccatctgttgtataattcatccggaatcactctgtgctcagaagttgaagatggaccacgtcatggacgtggtagtgaagtccgtgaactggatatgctcccggggactgaaccacagcgagttcacaaccttgctctatgagctggacagccagtatggtagcctcctgtactacacggagattaagtggctcagtcgcgggctcgtgctaaagagatttttcgaatccttggaagaaatcgactccttcatgtcatccagagggaaacccctgcctcaactgagctccatagattggatccgagacctggccttcttggttgacatgacgatgcatctgaacgctttgaacatctctctccaaggacactcccaaatcgtcacgcagatgtatgacctgatccgggcgttcctagcaaaactgtgcctctgggagactcatttgacgaggaataatctggcccactttcccaccctgaaattggtttccagaaatgaaagcgatggcctgaactacattcccaaaatcgcggaactcaagaccgaattccagaaaaggctgtctgatttcaaactctacgaaagcgaactgactctgttcagctccccgttctccacgaagatcgacagtgtgcacgaggagctccagatggaggttatcgacctgcaatgcaacacggtcctgaagacgaaatacgacaaggtgggaataccagaattctacaagtacctctggggtagctacccgaaatacaagcaccattgcgcaaagattctttccatgttcgggagcacctacatctgcgaacagctgttctccattatgaaactgagcaaaacaaaatactgctcccagttaaaggattcccagtgggattctgtactccacatcgcaacgtgatggagagaaaactcctggcagggccctatggtgggaaaggctggagtcttctagtcccaagggattgggagatgacaaaatgaattttttttttcttttttgagatggagtcttgctctgtcgcccaggttggagtgcagtggcgtgatctcggcttactgcaacttccagctcctgggttcgaacgattctcctgcctcagcctcccgagcagctgggactacaggcatgcgccaccatgcccggctaatttttgtattagtagagatgaggtttcaccatgttggccaggctggtctccaactcctgacctcaggtgatccacctgcctcgacctcacaaagtgctgggattacaggcatgaaccactgtgcccagctgacaaaatgagttcttaaactttttttttttttcagttttttttccactttgaatcagaaatataatctgcagtatcatacttgtttatattacattgtatgcctcactattcattaaaaatcaagaaagttttattgta

SEQ ID NO: 816 - DNA, 1704 bp, Homo sapiens
gtcccgagcaaaaacaagtgtttgcaaacccaagtccaacccagaaatcccccgtgcagcctgtagaggacctagctgggaacttatgggagaagttacgtgaaaaaatcaggtcttttgtggcatattctatcgcaatcgatgagatcacggatataaataataccacccagttggccatattcatccgtggtgtcgatgagaatttcgatgtgtccgaagaacttctggacacggtgcccatgacgggtacaaaatctggcaacgagatctttttgcgtgttgagaagagcctgaaaaagttctgtatcaactggtcgagattagtaagcgtggcctccactggcaccccagcgatggtggatgccaataacgggcttgtcacaaaactgaagtccagggtggcgacgttctgcaagggtgcggaactgaagtccatctgttgtataattcatccggaatcactctgtgctcagaagttgaagatggaccacgtcatggacgtggtagtgaagtccgtgaactggatatgctcccggggactgaaccacagcgagttcacaaccttgctctatgagctggacagccagtatggtagcctcctgtactacacggagattaagtggctcagtcgcgggctcgtgctaaagagatttttcgaatccttggaagaaatcgactccttcatgtcatccagagggaaacccctgcctcaactgagctccatagattggatccgagacctggccttcttggttgacatgacgatgcatctgaacgctttgaacatctctctccaaggacactcccaaatcgtcacgcagatgtatgacctgatccgggcgttcctagcaaaactgtgcctctgggagactcatttgacgaggaataatctggcccactttcccaccctgaaattggtttccagaaatgaaagcgatggcctgaactacattcccaaaatcgcggaactcaagaccgaattccagaaaaggctgtctgatttcaaactctacgaaagcgaactgactctgttcagctccccgttctccacgaagatcgacagtgtgcacgaggagctccagatggaggttatcgacctgcaatgcaacacggtcctgaagacgaaatacgacaaggtgggaataccagaattctacaagtacctctggggtagctacccgaaatacaagcaccattgcgcaaagattctttccatgttcgggagcacctacatctgcgaacagctgttctccattatgaaactgagcaaaacaaaatactgctcccagttaaaggattcccagtgggattctgtactccacatcgcaacgtgatggagagaaaactcctggcagggccctatggtgggaaaggctggagtcttctagtcccaagggattgggagatgacaaaatgaattttttttttcttttttgagatggagtcttgctctgtcgcccaggttggagtgcagtggcgtgatctcggcttactgcaacttccagctcctgggttcgaacgattctcctgcctcagcctcccgagcagctgggactacaggcgtggtggcacatgcctgtaatcccagctactcaggaggctgaggcagaagaatcgcttgaacctgggaggcagaggttgcagtgagccgagattgcaccactgcactccagcctggatgacagagcaagactctgtctc

SEQ ID NO: 817 - DNA, 2236 bp, Homo sapiens
ttttagataatgagaaggaaagattatcaagcattgaaaagattaaacagctaagagaacaagttaatgacctctttagccgaaaatttggccgcttccagggcttgagctcagtaatgtgggaaaacgcaagatagaccaggagggccgtgtgtttcaagaaaagtgggagagagcgtatttcttcgtggaagtacagaatattccaacatgtctcatatgcaaacaaagcatgtctgtgtccaaagaatataacctaagacgccactatcaaaccaatcacagcaagcattatgaccagtatacggaaagaatgcgtgacgagaagcttcacgagctgaaaaaagggctcaggaagtatctcttaggctcgtcagacaccgagtgtcccgagcaaaaacaagtgtttgcaaacccaagtccaacccagaaatcccccgtgcagcctgtagaggacctagctgggaacttatgggagaagttacgtgaaaaaatcaggtcttttgtggcatattctatcgcaatcgatgagatcacggatataaataataccacccagttggccatattcatccgtggtgtcgatgagaatttcgatgtgtccgaagaacttctggacacggtgcccatgacgggtacaaaatctggcaacgagatctttttgcgtgttgagaagagcctgaaaaagttctgtatcaactggtcgagattagtaagcgtggcctccactggcaccccagcgatggtggatgccaataacgggcttgtcacaaaactgaagtccagggtggcgacgttctgcaagggtgcggaactgaagtccatctgttgtataattcatccggaatcactctgtgctcagaagttgaagatggaccacgtcatggacgtggtagtgaagtccgtgaactggatatgctcccggggactgaaccacagcgagttcacaaccttgctctatgagctggacagccagtatggtagcctcctgtactacacggagattaagtggctcagtcgcgggctcgtgctaaagagatttttcgaatccttggaagaaatcgactccttcatgtcatccagagggaaacccctgcctcaactgagctccatagattggatccgagacctggccttcttggttgacatgacgatgcatctgaacgctttgaacatctctctccaaggacactcccaaatcgtcacgcagatgtatgacctgatccgggcgttcctagcaaaactgtgcctctgggagactcatttgacgaggaataatctggcccactttcccaccctgaaattggtttccagaaatgaaagcgatggcctgaactacattcccaaaatcgcggaactcaagaccgaattccagaaaaggctgtctgatttcaaactctacgaaagcgaactgactctgttcagctccccgttctccacgaagatcgacagtgtgcacgaggagctccagatggaggttatcgacctgcaatgcaacacggtcctgaagacgaaatacgacaaggtgggaataccagaattctacaagtacctctggggtagctacccgaaatacaagcaccattgcgcaaagattctttccatgttcgggagcacctacatctgcgaacagctgttctccattatgaaactgagcaaaacaaaatactgctcccagttaaaggattcccagtgggattctgtactccacatcgcaacgtgatggagagaaaactcctggcagggccctatggtgggaaaggctggagtcttctagtcccaagggattgggagatgacaaaatgaattttttttttcttttttgagatggagtcttgctctgtcgcccaggttggagtgcagtggcgtgatctcggcttactgcaacttccagctcctgggttcgaacgattctcctgcctcagcctcccgagcagctgggactacaggcatgcgccaccatgcccggctaatttttgtattagtagagatgaggtttcaccatgttggccaggctggtctccaactcctgacctcaggtgatccacctgcctcgacctcacaaagtgctgggattacaggcatgaaccactgtgcccagctgacaaaatgagttcttaaactttttttttttttcagttttttttccactttgaatcagaaatataatctgcagtatcatacttgtttatattacattgtatgcctcactattcattaaaaatcaagaaagttt

SEQ ID NO: 818 - DNA, 1869 bp, Homo sapiens
aaagagaaaaaggagggcgagtggcgagcaggggcctcggccgccacccacacgccccgaagcgtgctcgtcccccgcgcggggctcccggccgccgccctcggccatcggctgctccccggtggcccaggcctcggactccgcggccggcccggcgcggcccagcgccctcagggatcatggcccaggtagcagtgtccaccctgcctgttgaagaagagtcctcctcagagaccaggatggtggtgacattcctcgtgtctgccctcgaatccatgtgtaaagaactggccaagtccaaggcagaagtggcctgcatcgcagtgtacgaaacagacgtgtttgtcgtcggaaccgagagaggatgcgcttttgttaatgccaggacggattttcagaaagattttgcaaaatactgcgttgcagagggactgtgtgaggtgaaacctccctgccctgtgaacgggatgcaggtccactcgggcgaaacggaaatactcaggaaggcagtggaggactatttctgcttttgttatggtaaagccttagggacaacagtgatggtgcctgttccctatgagaagatgctgcgagaccagtcggctgtggtagtgcaggggcttccggaaggcgttgcctttcaacaccctgagaattacgaccttgcaaccctgaaatggattttggagaacaaagcagggatttcattcatcataaatagacccttcctaggaccagagagtcagctgggtggccctgggatggtaacagatgcggagagatccatagtatcaccaagtgaaaggcatttcactgaaagcagaagctgtctcagtcaagaaagaatcagaagatcctaattactatcaatataatatgcaaggaagccacccttcttccacaagcaatgaagtaatagaaatggaattaccaatggaagattccactccgctggtcccttcagaagaaccaaatgaggaccctgaagccgaggtgaaaatcgaaggaaacacaaattcatccagtgttacaaattctgcagcaggtgttgaagatcttaacatcgttcaagtgactgttccagataatgagaaggaaagattatcaagcattgaaaagattaaacagctaagagaacaagttaatgacctctttagccgaaaatttggtgaagcaattggcgtggatttccctgtgaaagttccctacaggaagatcacattcaaccctggctgtgtggtgattgatggcatgcccccgggggtggtattcaaggcccccggctatctggaaatcagttccatgaggaggatcttggaggcagctgagtttatcaaattcacagtcatcaggccgcttccagggcttgagctcagtaatggacttttggaggccaaggcaagaggattgcttgaggccaggagtttgagaccagcctgggcaacatagcaagaccccatctctacaaaaaatttaaaaattagctggaaacagtggctcacacctgtagccccagctacttggcaggctaaagcaggaggatcacttaaactcaggagtttgagacagcagagaaccataattgcaatactacactccagcctgggtgacagaacaagaccctgtctctaaaaagaaaatgcaaacatattatcaaataattcctgtttaaactggacataacaagcacagctacatgctgaacctcatcaaaggtgtcttttgtttggctcatgtacttttgaaaataaggatgaggcctggcacggtggctcctgtaatcccagcactttgggaggccaaggcgggtggatcgcttgagcctggggtttcagaccagcctgggcaacaaggtaagactccagctct

SEQ ID NO: 819 - DNA, 1300 bp, Homo sapiens
taaggaactgtgggtagatggtttgcaggaccacatacacacacaaaatagccgactaaagaaagcggtggagatcgagatcagtaagtttgatttgggaacaaaaccctggagactctataggtaggtgactgttgggggtggacaggcgctgaagacttggattggtttagacctagaaggaagtggcatttgattggttattataagtgaaaagggcccctccccgggtgagatatgccagccccataattaggacctgaaaatctctgccaggcctgcctttgtgacgtggcccagtctacctcagctatggaacaggccttgactggtgaggcccaaagccggtggccccgcagaggcgggagtggggccatggctgaggcgcctgggcccagtggcgaatcccgaggacactcagccactcagctgccagcggaaaaaactgtcgggggaccatcgaggggctgctcaagctccgtgctcagagtgtcccagttggtgctccaggccatctccactcacaaagggctgactctggcagctctcaagaaggagctccgaaacgccggctacgaagtgcgcaggaagagcggccgccacgaagcgcccagggggcaggccaaggccacgctcctccgggtcagcggcagcgacgccgccggctacttcagggtctggaaggttcccaagcccaggagaaagccgggacgcgcgaggcaagaggagggcacgcgcgctccctggaggaccccagccgcgccccggagctcccggaggcgccgccagccccttcgcaaggcggccaggaaggccagagaagtgtggagacggaacgcgagggcgaaagccaaggccaatgccagggcgaggaggaccaggagggcaaggccgagagccaaggagccgccgtgtgccagagccaaggaggaagcgggagcgacagcggcagacgaggggcgaggacaggccgtgaaggaagacaccacgccgaggtcagggaaggacaagaggcgaagctccaagcccagggaagagaagcaggagcccaagaagcccgcacagcggaccatccagtagccaacgcgggctaaaaccgaccggacatctagcgggcaggggaagactccactaaagacttccacaaagacctcccctaaatctgaaggtcttcctgatccagttgggaatgcatcttgtgggagcagcttcactcccaccacggaccaatgcctttcccccataggccccaagaagagcggctgtcacactcattgaaatgaaatggacctctagacca

SEQ ID NO: 820 - DNA, 1506 bp, Homo sapiens
cgcgcacgcccagcgagttccagaggcgccagtggaagctgcggcggcggtgtctcgcgttcggcgggatttctcttcgctccggctcggcctaggtctacgtccccagctccagccgccggctcggactcggtctctgacccccaactcggtcccctagtccggccccggctccgggccccccaaccctcgctccggcccggcccggcccccaccccagccctgccgcccggccccaggcccggccgcggccgctcccgcctggagccgccgcgcgcccccagcccccctgcaccccctcggcccctcgccttcctcttcccggcgcggccccccggcttccgcgcgccgcccgccaccaatcctcttgctaccatgtccgtggagctcgaggaggccctgccagtgacgaccgccgagggaatggccaagaaggtgaccaaggctggcggctcggcggcgttgtccccatctaagaagaggaagaatagcaagaagaagaaccagccgggcaagtacagccagctggtggtggagaccatccgtaggctgggcgagcgcaacggctcgtcgctggccaagatctacaccgaggccaagaaggttccgtggttcgaccagcagaatgggcgcacctacctcaagtactcgatcaaggcgctggtgcagaacgacacgcttctgcaggtgaagggcaccggcgccaacggttccttcaagctcaaccgcaagaagctggagggcggcggggagcggcgcggagccccggcggccgccaccgccccggcccccaccgcgcacaaagcgaagaaggcagccccgggcgcggccggctcccggcgcgcggacaagaagcccgccaggggccagaagccggagcagcgctcgcacaagaagggcgctggcgccaagaaggacaaaggcggcaaggccaagaagacggcggccgccgggggcaagaaggtgaagaaggcggccaagcccagcgtccccaaagtgcccaagggccgcaagtgagcgtgtcggccggtcagagcggccggcgtgggcttttcggtgtttttgtttttctaccccaagtgacgtagattttgtacggctcacgccggccggggccgcgaggcctggtctgagcctcagggaggggccccgggtcctctcagtctttcccctcccccaacgatgtagcgtttttcgttgtttgctttaggtttttgaaacagccccggcgacgcctctattggctctcggccttggcaacggccgtcgtcatggttactggcccctaggcgccgatggccgaggccgcgcctgcccaccgggcggggtcgctggttggccgggcccaggcgcgcggggacgcggaggccgcgcatcctttcccagctccccaccctccttgcctttgggtgcgcgacaaacaatcgctccgggctcagggctgcgcggctcttcccttcattccatgggcctttttttgggcacaataaagcgtttaaacctttc

SEQ ID NO: 821 - DNA, 4046 bp, Homo sapiens
atgtcgatgttgcacaaaacctccaccaccactaccctgcgttctaaagacccaaggcacgaatggaagacgttgaccaccacgcagctcctcctgcaaccaggcccaaggggttcctggggaagctgtcacagaattgaaagcagtattgaaccccacggaaatctgctcttgtgggcacttgcaaaacaacgaaccccacgtgatccggagatgtggtggaggggtgaggctaacatttcctacaacctcctgcaaaggatggaagcgcgtgccgctctcccgggtttcgggaggcagcctgttttgtagcctctgaggctccggggaaaggtttggctgcgtctaagagagacgtttggagccatccgtcttattttgtttgaaaagtcactcgttcaatttgtcactgtgtgacagctcagaataaaaccaatttgcggccgcccctcctcctcgcttcccggaggatctcctgggaggcacgaggcggacgcggtgctgagttgggccgggactcagggcggcaacatttgggcaagggcccaggaaagatgaggggctttgccgaggacacggactcctggaataaaagcagaatgaggtcaagagaagggaagcaaaggggccaaagcgcgctccgctctccaccgggaggcgggctttgcagagccctaaagagtgagattaccgtcccttccccacgcccccaactcgccccgggtgacaagcgcttcaggaaagctcctgtgatcaaccctccttgccccgtggcggttcggagctgcagaagttagaagagagtcagagccctccggagcggctgcctggcccctacgcagagtagcaagaagcactgcgatgtgcgctactaagcccacgcggccgcagcaaaaactttggcgtggccggggcgtggctagggtccggccaggcccccttgttcctaattcccctccactccccgctcccattggtcacgaggatgaccaatgagcgctcggatcgaggtcctaccccgggcctgactcgaaagctcctgccaaaactttgggagtttttagagacgagtttttttttttttctattacttttccccccccctaactaacggactattattgttgttgttttaaatttagctcttagggcttagctatttgggttttcttgcggtgtccggctcccgtctccctggctcccccgcccgccctgcggccccagcgcccctcgctctcatccagcccgcgaggagtgcgggcgccgcgccgcctttaaagcgaggccagggagcgaggcggtgaccggccgagatccggccctcgcctcctccctcggtggcgctagggctcccggcctctcttcctcagtgcgggcggagaagcgaaagcggatcgtcctcggctgccgccgccttctccgggactcgcgcgcccctccccgcgcgcccacccacccagtccggctggactgcggcagccgcgcggctcaccccggcaggatgttcgcagccgggctggctcccttctacgcctccaacttcagcctctggtcggccgcttactgctcctcggccggcccaggcggctgctccttccccttggaccccgccgccgtcaaaaagccctccttctgcatcgcagacattctgcacgccggcgtgggggatctgggggcggccccggagggcctggcaggggcctcggccgccgccctcaccgcgcacttgggctcggttcacccgcacgcctctttccaagcggcggccagatccccgcttcgacccaccccagtggtggcgccctccgaagtcccggctggcttcccgcagcggctgtctccgctctcagccgcctaccaccaccatcacccgcaacaacaacagcagcagcaacagccgcagcagcaacagcctccgcctccgccccgggctggcgccctgcagcccccggcctcggggacgcgagtggttccgaacccccaccacagtggctctgccccggccccctccagcaaagacctcaaatttggaattgaccgcattttatctgcagaatttgacccaaaagtcaaagaaggcaacacgctgagagatctcacttccctgctaaccggtgggcggcccgccggggtgcacctctcaggcctgcagccctcggccggccagttcttcgcatctctagatcccattaacgaggcttctgcaatcctgagtcccttaaactcgaacccaagaaattcagttcagcatcagttccaagacacgtttccaggtccctatgctgtgctcacgaaggacaccatgccgcagacgtacaaaaggaagcgttcatggtcgcgcgctgtgttctccaacctgcagaggaaaggcctggagaaaaggtttgagattcagaagtacgtgaccaagccggaccgaaagcagctggcggcgatgctgggcctcacggacgcacaggtgaaggtgtggttccagaaccggcggatgaagtggcggcactccaaggaggcccaggcccaaaaggacaaggacaaggaggctggcgagaagccatcaggtggagccccggctgcggatggcgagcaggacgagaggagccccagccgttctgaaggcgaggctgagagcgagagcagcgactccgagtccctggacatggcccccagcgacacggagcggactgaggggagtgagcgttctctgcaccaaacaacagttattaaggccccggtcactggcgccctcattaccgccagcagtgctgggagtggtgggagcagcggcggcggcggcaatagtttcagcttcagcagcgccagcagtcttagtagcagcagcaccagtgcgggttgcgccagcagccttggcggcggcggcgcctcggagcttctccctgcaacacagcccacagccagcagcgctcccaaaagccccgagccagcccaaggcgcgcttggctgcttatagactgtactagggcggaggggatccgggccttgcgtgcagcctcccaaccatgggctgggttttgtgcttactgtatgttggcgacttggtagggcaggagacgcagcgtggagcctacctcccgacattcacgcttcgccccacgctgctccgactggctgcagcggacactgcccaaagcagaggggagtctcagtgtcctgctagccagccgaacacttctctccggaagcaggctggttcgactgtgaggtgtttgactaaactgtttctctgactcgccccagaggtcgtggctcaaaggcacttaggacgccttaaatttgtaaataaaatgtttactacggtttgtaaaggccgcttggctttgctgggggttgttaaggccagagatctacaaccggaccttagtcccggggacactgtagaatgcagcagctgaaggtggtggggctggagtttcaggggaagtggctcaacctcagagccatcttgttacagacatcagagatgggcgtctgggtttagaggcttctaattaagagatttctagcgccaactgccactgaaagtgccctctgagaccctgagtagcctgagagtggagcaggccatagaaactgttaggccagtgcaacagatggtttccccattcacagtatggacgaaatgagttcctagagtactcagagttggaatggggaaggcagtgatgccaggcggggtcaatctaggcacagctgtaatcactatgtggacgcgaagcgcgggcccagagccctgcacaaacttttccttgttccgggatggggtagaggacaggtttgcaatgttgctgaggaaaggacagacatgacacagtggttagagctggaagcttgggtcttagagtgccagggccctggttgtaaacatgccaaacaaagaggtgacttcttcaaggtgaagcagaggcacagcccagatcagaacttggacttcctggcctacatgtggccacggatagaactatgaagttgcatcctccattccctcatccacgcaaaaattttcctttgcaatttggccactggaggtg

SEQ ID NO: 822 - DNA, 1881 bp, Homo sapiens
actgtctacattagtaattcccaacttgggtccgaaagtgaacttttgctgaagcgaagtagctaaccgcttccatgtgcaaggcaggttccagacttcggggtgaggaggattaactgaaggaccccaggggaaccggtgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccg

SEQ ID NO: 823 - DNA, 517 bp, Homo sapiens
cgcccagcatgccgaggaggaggagacgccgagggtcctccggtgctggcggccgggggcggacctgctctcgcaccgtccgagcggagctttcgttttcagtgagccaggtggagcgcagtctacgggagggccactacgctcagcgcctgagtcgcacggcgccggtctacctcgctgcggttattgagtacctgacggccaaggtcccggagctggcgggcaacgaggcccagaacagcggagagcggaacatcactcccctgctgctggacatggtggttcacaacgacaggctactgagcacccttttcaacacgaccaccatctctcaagtggcccctggcgaggactagcttctgacacccggcccctgggacctgacaggtccactcgtccacccacccggccccaaatcccccggcctgaacccccggccttaaacaccctccccccacaacccaggccccaaagtcttgggccttcattaattctgtcaataaaatgtttcaaggaa

SEQ ID NO: 824 - DNA, 517 bp, Homo sapiens
cgcccagcatgccgaggaggaggagacgccgagggtcctccggtgctggcggccgggggcggacctgctctcgcaccgtccgagcggagctttcgttttcagtgagccaggtggagcgcagtctacgggagggccactacgctcagcgcctgagtcgcacggcgccggtctacctcgctgcggttattgagtacctgacggccaaggtcctggagctggcgggcaacgaggcccagaacagcggagagcggaacatcactcccctgctgctggacatggtggttcacaacgacaggctactgagcacccttttcaacacgaccaccatctctcaagtggcccctggcgaggactagcttctgacacccggcccctgggacctgacaggtccactcgtccacccacccggccccaaatcccccggcctgaacccccggccttaaacaccctccccccacaacccaggccccaaagtcttgggccttcattaattctgtcaataaaatgtttcaaggaa

SEQ ID NO: 825 - DNA, 517 bp, Homo sapiens; identical to SEQ ID NO: 824

SEQ ID NO: 826 - DNA, 456 bp, Homo sapiens
atgtccggtcgcgggaaacagggcggcaaagtgcgagcaaaggccaaatcccgctcctcccgcgcgggcctgcagttcccggtgggccgagtgcacagactgctgcgcaaagggaactacgcggagcgagtgggcgccggggcgccggtgtacctggcggcggtgttggagtaccttacggcggagatcctggagctggctggcaacgccgcgcgtgacaacaagaagaccaggataattccccgccacctgcagctcgccatccgcaacgacgaggagttaaacaagctgctgggcaaagtgaccatcgctcagggcggcgtcctgcccaacatccaggccgtgctgctgcccatttgtgagcactcaggaccaagttctgggaagataccgtcggatcgagctgagctcggggcaggaagtgtctgcggccatatttttcaaaaagtggagtaa

SEQ ID NO: 827 - DNA, 785 bp, Homo sapiens
gacgccgagagcggtttgtctccgtctctggagttgtaggcgagaggtgatcatgtccggtcgcgggaaacagggcggcaaagtgcgagcaaaggccaaatcccgctcctcccgcgcgggcctgcagttcccggtgggccgagtgcacagactgctgcgcaaagggaactacgcggagcgagtgggcgccggggcgccggtgtacctggcggcggtgttggagtaccttacggcggagatcctggagctggctggcaacgccgcgcgtgacaacaagaagaccaggataattccccgccacctgcagctcgccatccgcaacgacgaggagttaaacaagctgctgggcaaagtgaccatcgctcagggcggcgtcctgcccaacatccaggccgtgctgctgcccaagaagacggagagtcagaagacgaagagcaaatgaccctgacgccgccctcagggagctggctcccccagcaaaggcccttttcatgagccttcgctctcctgccagtttgtgagcactcaggaccaagttctgggaagataccgtcggatcgagctgagctcggggcaggaagtgtctgcggccatatttttcaaaaagtggagtaactttccgtcttggaagggtggctctgatggcacgatgtcaacttgagattcttcctagcctagtagctgctgtgctttcatgctttggatatcagatatctttatatagcacttttatgttcatattttttttttaatgaaggaaacgttcaataagtgagtcatgaggt

SEQ ID NO: 828 - DNA, 3665 bp, Homo sapiens
agagccaatggaaaggggctgccgcgcggccgtaaagagtttgtagaggcagttcgggtgcggtacgttgcattccggtaccggacgccgagagcggtttgtctccgtctctggagttgtaggcgagaggtgatcatgtccggtcgcgggaaacagggcggcaaagtgcgagcaaaggccaaatcccgctcctcccgcgcgggcctgcagttcccggtgggccgagtgcacagactgctgcgcaaagggaactacgcggagcgagtgggcgccggggcgccggtgtacctggcggcggtgttggagtaccttacggcggagatcctggagctggctggcaacgccgcgcgtgacaacaagaagaccaggataattccccgccacctgcagctcgccatccgcaacgacgaggagttaaacaagctgctgggcaaagtgaccatcgctcagggcggcgtcctgcccaacatccaggccgtgctgctgcccaagaagacggagagtcagaagacgaagagcaaatgaccctgacgccgccctcagggagctggctcccccagcaaaggcccttttcatggtcgtcccgcaatgcttttgaatgtgctggatgtcatggagggccggtgacatctagcggggaggtgggcggcgagggtcccggcgggagccaataaagttggtgaaaatcgtttggtcgagagagctgtgtagtcgcggggacatgtcggatggccccaggggaggggggcgaccgggaaacccctggagcaggcactggtgggtgggcttgagccactctggacggctttagtccgcaggtcaccctcgaggcgtcaggggagggtggcctggaggtgggcagggtggaagccacctcgctgtcagtagggcaaaggggaggcagagtcggtgcggtgaggcctccttcggaattatttttacttccctttcacagagccttcgctctcctgccagtttgtgagcactcaggaccaagttctgggaagataccgtcggatcgagctgagctcggggcaggaagtgtctgcggccatatttttcaaaaagtggagtaactttccgtcttggaagggtggctctgatggcacgatgtcaacttgagattcttcctagcctagtagctgctgtgctttcatgctttggatatcagatatctttatatagcacttttatgttcatattttttttttaatgaaggaaacgttcaataagtgagtcatgaggttggaaattcgttcccctgacagtcatattgcataacattgcagcgcctttagtcgtgggttacatatgcttgagcttttaaagtgatgttgtcaagtttctagcttcataatgatcctgtcttcatcatatcatattcactttgagaatcggtttgactttgctttcaaacaaaacaaaaacctcttgcttttaggggttcttacccaacaaataacctgtttgaactctcttatattctcccactagcctgaagcaatgacctcattccagtaatgtctttgggagttgcattgcctaatggcacaatattgctttaataaacatgtaaggaaagataggaccaaatatgtaagtgcagggggaaacacatttcagaccaggaatccacattgaaaagttaacactagtaatcatcttctgcccttaattgacactcctatttatttcatcctcagcaaatttcatcctggctcacagaccccacaaaaaagatcccagtacagatttcacatctttggattcatctttcctgtgagtcggaattgaagtcttccccaaaaatatatgtatatattgtatgtcttcatccttggtagcggctggcccattttcccacatggactttattttgtccccagtatttattgaacagctgtctatgccaggctctgtacaaagtgataggagtagagctgtgaatgaggccaaccagatttccactctctcggagctcactttatttttattggttcctgaagacgggacaaggaacaaatacatacgttaatatgagagatcagcttctgttagtacttgtacctctctgctgtgtgtggatgaatgatggaattacttctcccatgttgccatttttgaggtgtacaaaggtcaggccgtacacacctctgttaggaggcaaattattgggcaggttcgagatgttctgctatttactctgtggttttgtcatatgtaaaagtcataacacctgttttaaggattgagattgttcatttactgtgtgccacatattagacaataaatggaaaaaagtaccatgttcaatgggggtatgggtttatccttataggttaaattataggtaaacattaataggactttttaaaaaatgcctcattgttagaactactactcacagttaccacttggggtcagtggaacaaaatgcatatatggttttgacatttgagtctaaatttcttaaagggatgaggcatctgagggattgttaccaaaatgatgaagaaataaggacaagggacatcaagacattcataagaaaaagcacctttgccttcccctgggaagattcacaggaatctgtccagctcttattacatgatgagcaacatagacaagatacgaggcattgtaactgccctgtcgccacccgcctctcccaccactacccaaaggattcttagcatcccctcacatactctgcctgcctcaacgttcagtcagcccctcaccatttttgtttttgagagttttttttttaacccgaatagtttacgggctgtttaaaatgcatactcctacaaaatcagctcagcccatgatccatgatgaacaaacagtagttcttgctgatgtgtgattatgaatttaaaaggccagtatttctttaagcataagaccatatggaaaaaggcctaagacaaaatctgatgggaactgaattccagtttttaatagagttataatccatagttttatttacacacaaacacacacacacacactctttcctgcagagataagcaagccgttcagtgtggctgtggcttggccaggatttgtttgatctttgtttttcctgcagggccagtcttgtctttgtgtccccgaggactggtctgtttagttgtgcctgcctggaatcaaaaggcttagtcaggccccataattggtgatgactggcatactatatgcaaacttcacaatgccccttccagtggttgaaaggtcgcataccatgctgtgtaagaactttagctctctgcaatgagacttaaattcagattcactctactccttattagttatctgatttttggaaacttaatctctttaaacctcagtttcatctctaaaatgggcataatagtttacctcatagagtttggggagaattgagtgaattaatgtgtgtgaggacactaagattcccatatagaaataggctcaatgaatagtagctgtttttatttctatgtaaagtgagtagcggtagttgatgggagctgttgaaacaggtaaacagcattctagcaatccttcgacttttgtgatagcaaaccataaaaacaattttagtggctgttttactaattaaaggacatccacaattcaatgtataacagaaaaagtaatgattaaagcttgtgaatctg

SEQ ID NO: 829 - DNA, 3804 bp, Homo sapiens
gtccggctccggcggcggcggtcggtgctgcgagagcggcggcggcggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtgagaagagaaggtgttcttagatcagaagatgccattgtattaggtgacggcaaggttttgctgatttagtggaacaagattctactgggatgtgtgctgagctgaaccaaggaactgcccgaatgtgctgaacaaggacatttgcttctcagatacgtgaattcaattttaagcaagattcttgatctgcttcagagcagctttgatttaaagtaatttcagagcgcttttccttgcatgagtaattttctgaatgtataaaatattctatttatgtttgaccttttggataaactgtgttgctgcagtgttggtccacactaccatcctaagtgaagacttagtaagtctgaggatctccaggcactggaaagagtgagaacctgggagtgaaagggttatagttagtgttcatttttcgggttttgtttcatagggagtcctgagtggggtaacctgaaatgttttaacagttgaagatcatcctattcctatccccagtaaaaataggcctttccacaatcttctaccagttaacttagctttttttttttttttttcctttaatagagtctcattcttgtcacccagactggagtgcgatggcacgatcttggctcactgcaaccctccctcccgggttccagcgattctcctgcctcagcctcccaagtagctgggattacaggcgcacgccaccatgcccagctaatttttgtatttttagtagacgtggggtttcaccatgttggccagactggtctcaaactcctgacctcaggcgatccgcccgtctaagccttccaaagtgctgggattactggcaggaaccaccaggcccagccaaccagcatttcttaaggtgaaaatacatggtgttaatttatattttgagtgagacccagtccagctgctataactgcttggacacttggcagaggacagagtactgcaaaagtgtctaagggagacagcattttgccttgggtgctgtagatgtacaagagaggttccaggagggggtgataggcagaattttggtccccatcaccttccctgcccagtgttatgcctatgaatgtgttacattatgtggtaaaagggactttgcagatgtaactaaaatttctaaaatagagatattatcctggattacctgggggaacccagtgtaattacatgaacccttaaaaatggaagaggatgcaggagtcagattcaaaggaaggcccaaggtgctattgctgacttgaagatagaggggccatgtggaaatcaagagaaggaagtgaatccttccagtgagcttggaagaaagcaccttgaggcacagatgagaagcttggccttacctgatgccttgattttagcctggtgagaccctgagcatataaatttgctgtgctatgccacacttctcacctacagaaacttagtttaaagccactaagtttgtggtaatttgttggctttaggcccctgagggtagagatttatggcttgtgttacaagtagagagcagtggagagttgggctttgtaattctttcaagggtgattgtagttctggagtcctatctacctgggttcagatctttgttggccagtccctggctgtgtgacttcactgctttaagcctctgtcttcatccttaaagtggtgatgatagtacctacctcactctgatctctgaatgagaacacatgtaagacacttagcacagttcctggtgctcaaagagttccaacacctgaaagcaccatggccctgtttgtttttcagtcaagatttctaaaagccgttattaccagaggttcagtgagaacatgggcagggtaaactcaaaatggagaacataaaaactgggactcccagaccagtcacttagaagactgctgcaggaagtaccaaggtcgttaagaatcagtaataataataagtaatgtgtgaatccattagaatgttgagaagtagacctttgacatttcagaaaaatgtatatctcagacacagccatatgtattgttatccctgagttggaagagcatcacagggcatagtttcacaaaagcttcaaaaaatatactaattgctggtaatatgtgaactaacagaaaaaaatagccatgttaaaataggagtgcctgacaattagctctattcatcttgtctcctagctgtaagcaccctagattcaaattatgcacctagaaaactaaattactatgtatgttataggcctttgaaatggatacatgaaaattagtgaaatcagaatgaacgtttcgcctgccaaagatatgtatttttataagtgatacaagggccccatgagctccatggccacatctgtacaaaacaggccctcctttcaggaactggtctcgagagagcaaaggggtcaactccctaaatggcagctgagacagtcctccctggtggcatggccctgtttcctgttgatatggtgatagttggagagtcaaatttttaccagaatttgtgaatatcatctctggttaatgattacacaaaaccttttaaaattttaaaaaattatttctaattctataaataaactctgcagttgtacagccactgtacagctaacatctcaacactggaaatgaggctggtttcttccagtttggctcagattcttcagggaagcccagttaagacaaacagctctctatactcaatccttactttgctgagaagatacaggcctgcccactcgctcccacctgctcttcacgaggagtcctttattcctgcatgtttcctgttctttgggacctttaggagctaacctccacagatgctgatagtctgtagagtcaggaataccatgtaacatgttgaagtagactaaagattagttctttggcaatagcccagtctggacttactatgtacttttgaaaataaaactgcttatttgtaaactctgtaattaggaccttttgctatttgagttatattcctttctaacttcaaacgtctgcattcatgtataatagccattttatgcacagatgaggtgattcccacactttttttcgcagatgtttcattatctggatgagtgtattacataataaatttgaataatggtagtcttccaaatgacaaaaagcaagctagttgatttgtcaattttgagtttaaatgttttgactgcttatcagcaaaaaaaatcaaagaatagcatactaatattaatggaaatgcagagtatatttaattggcatgattttttcatggatgtgtgcttcatttgatctattgtatgtagctcgtgatcacattttctgttggttaacattgttcctagcttatatgatggaattaaatatattctgtgtaaaaa

SEQ ID NO: 830 - DNA, 752 bp, Homo sapiens
gcggcggtcggtgctgcgagagcggcggcggcggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaa

SEQ ID NO: 831 - DNA, 596 bp, Homo sapiens
ggcagcgggagggcgcgcggccgagcggaggcggagtcggcgccgagaacatggctggaggcaaagctggaaaggacagtgggaaggccaaggctaaggcagtatctcgctcacagagagctgggctacaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaa

SEQ ID NO: 832 - DNA, 687 bp, Homo sapiens
tccggctccggcggcggcggtcggtgctgcgagagcggcggcggcggcgcgggtcggcagcgggagggcgcgcggccgagcggaggcggagtcggcgccgagaacatgtttcctgtgggccgcatccacagacacttgaagactcgcaccacaagccatggaagggtgggtgccactgctgccgtgtacagtgctgcgattctggagtacctcactgcagaggtgctggagctggcaggtaatgcttctaaggatctcaaagtaaagcgtatcactccgcgtcacttgcagcttgcaatccgtggtgatgaagagttggattctcttatcaaggctaccatagctgggggtggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttttacaaaattaa

SEQ ID NO: 833 - DNA, 628 bp, Homo sapiens
attgtccggctccggcggcggcggtcggtgctgcgagagcggcggcggcggcgcgggtcggcagcgggagggcgcgcggccgagcggaggcggagtcggcgccgagaacatggctggaggcaaagctggaaaggacagtgggaaggccaaggctaaggcagtatctcgctcacagagagctgggctacagtttcctgtgggccgcatccacagacacttgaagactcgcaccacaagccatggaagggtgggtgccactgctgccgtgtacagtgctgcgattctggagtacctcactgcagaggtgtgatccctcacatccacaaatctctgattggaaagaagggacagcagaaaactgcttagagggatgctttaaccaaccctcttcctccccgtcattgtactgtaactgggacagaagaaataatggggatatgtggaatttttaacaacagttaaatggaaaagcatagacaattactgtagacatgataaaagaaacatttgtatgttcttagactcgaagtttgataaaagtaccttttcatgtggtgacagttgtgtgttgattggctaggtttctcccgtgtgttttatacaaaaatggaattgataaaccattttt

SEQ ID NO: 834 - DNA, 1859 bp, Homo sapiens
gccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagaagcagggtgaagtcagtaaggcagccagcgccgacagcacaaccgagggcacacctgccgacggcttcacagtcctctccaccaagagcctcttccttggccagaagttgcaagttgtacaggctgacattgcctcgatcgacagtgatgctgtcgttcacccgacaaacactgacttctacatcggtggtgaagtaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgt

SEQ ID NO: 835 - DNA, 924 bp, Homo sapiens
agttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatcta

SEQ ID NO: 836 - DNA, 1314 bp, Homo sapiens
gtctacattagtaattcccaacttgggtccgaaagtgaacttttgctgaagcgaagtagctaaccgcttccatgtgcaaggcaggttccagacttcgggtgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaa

SEQ ID NO: 837 - DNA, 2789 bp, Homo sapiens
aacagccattgtgccttcccactgggttagtgggaaggttcctaaagatgccgtggcagcgacagtcccgtgctcagagccaggcacacagtaggcgttcactcgagacgcagagtctgggacgcgccctgaagaagctcctctccaggggcctggcccttcccaaggactgggctctgggcgtccccggggtcatgggtcagacctcgcgtccggggtgcgggctggtgcctgggcgcagagcggccggcgtcaacgggtagggcgcgggcccggggtcaaggccggggcgccgggcggcacgggcgcggaggccggacgctcggggccgcgaagggatgtgacgagcggcgcgctgtgcattgtgggaagccggccgcgaggactggttccagttcactcggcagcggcgccgggcggagggggagagcgcgggccgcgcgggcgggaagcgaagaggcgggcgggccagcgaggagcgcggagagaaaaggcgcgagcggccaggagggctcaggccgagacaccttgcagctgccgccgccgccaccgagccgccgctgtgctcactgatccgcctccagggccaccgccatgtcgagccgcggtgggaagaagaagtccaccaagacgtccaggtctgccaaagcaggagtcatctttcccgtggggcggatgctgcggtacatcaagaaaggccaccccaagtacaggattggagtgggggcacccgtgtacatggccgccgtcctggaatacctgacagcggagattctggagctggctggcaatgcagcgagagacaacaagaagggacgggtcacaccccggcacatcctgctggctgtggccaatgatgaagagctgaatcagctgctaaaaggagtcaccatagccagtgggggtgtgttacccaacatccaccccgagttgctagcgaagaagcggggatccaaaggaaagttggaagccatcatcacaccacccccagccaaaaaggccaagtctccatcccagaagaagcctgtatctaaaaaagcaggaggcaagaaaggggcccggaaatccaagaagaagcagggtgaagtcagtaaggcagccagcgccgacagcacaaccgagggcacacctgccgacggcttcacagtcctctccaccaagagcctcttccttggccagaagctgaaccttattcacagtgaaatcagtaatttagccggctttgaggtggaggccataatcaatcctaccaatgctgacattgaccttaaagatgacctaggaaacacgctggagaagaaaggtggcaaggagtttgtggaagctgtcctggaactccggaaaaagaacgggcccttggaagtagctggagctgctgtcagcgcaggccatggcctgcctgccaagtttgtgatccactgtaatagtccagtttggggtgcagacaagtgtgaagaacttctggaaaagacagtgaaaaactgcttggccctggctgatgataagaagctgaaatccattgcatttccatccatcggcagcggcaggaacggttttccaaagcagacagcagctcagctgattctgaaggccatctccagttacttcgtgtctacaatgtcctcttccatcaaaacggtgtacttcgtgctttttgacagcgagagtataggcatctatgtgcaggaaatggccaagctggacgccaactaggctgagcaatgacagaaccagctgcaccatgtaccccaccttcagtttaaaagaaaaaaaaaatccccttcactcctactgggaggtgggacccctttcattttcagttttgctcatctagggaaaataaggctttggtttccagtttaattgtttttgaccttctaaaatgtttttatgttagcactgatagttggcattactgttgttaagcactgtgttccagaccgtgtctgacttagtgtaacctaggagattttatagttttattttaatgaaaccctgattgacgcacagcagtggggagaacagcgtcttttacctgtcaccgaagccaggaagccccgtttgtaagcgtgtgttgtggtgctttattgtacatcctccagtggcgttctttttactctaatgttcttttggtttcccccctcagaagaatcatgaatttgcaacagacctaatttttggttactttttgtcttattgatggatttgaaaatgaaagatttaataaggcaaagcagaatctgttgtccttaattatatttgcaatttggaatttgtgtgagttgatttagtaaaatgttaaaccgttgttgtgactggtgtgttccagttattgtgcccgtgagtcacaggtcttaagtcggcttctgcagtcccaggatgtgggggcagggcagtccatccccctcaacccccaccctgctcccacaactccttggatgctccacagtgttcactgcaacctgggtgggtgtgggccatctgctggccccagtggtttgtagagagaatttttataaagtctcaccttttggttctgtgtgacccttgggccagggtgttatccccattccccgttccacagatgaaggagggagtgtatccaaagccgtgcaggtggcatgtggcaggctccagaccctgagcccagctctctcctaccattgtccccttctgacagtctgtgacttagggctgggcctggccacttgctgatgaagctgctggagcctcattccctctgccgaggctgctgggtctgtcatccctgcaggacaggatccctggca

SEQ ID NO: 838 - DNA, 1959 bp, Homo sapiens
gagcaatcccttctccctcctcctcctccccccgctactatccgcggcccagagaactgccgcttgccgccattgacacgcacagatagaacccaaagaaaggcaaagagtcctgcccggcaccggcgccgcgtgggccaaacctgcgcccgtggaggggcgcgcagagggcaccgggcgccgggagcaggcggcgcagcaccagcattgtgttagtgccgggaggccactgtgtcagcaagctgagagggaaactgaagcaagatgtcgggccggagtgggaagaagaaaatgtccaagctgtcccgttcagctagggcaggtgtcatctttccagtggggaggctgatgcgttatctgaagaaagggacgttcaagtaccggatcagcgtgggcgcccctgtctacatggcggcagtcattgagtacctggcagcggaaattctagaattggccggcaatgccgcgagggacaacaagaaggcccggatagccccgagacacatcttgctggcagttgccaatgacgaggagctcaaccagctgctaaaaggagtgaccatcgccagtggaggcgtcctgcccagaattcaccccgaactgctggccaaaaagcgagggaccaaaggcaagtcggaaacgatcctctccccacccccagagaaaagaggcaggaaggccacgtcaggcaagaagggggggaagaaatccaaggctgccaaaccacggacgtccaaaaagtccaaaccaaaggacagcgataaagaaggaacttcaaattccacctctgaagatgggccaggggatggattcaccattctgtcttctaagagccttgttctgggacagaagctgtccttaacccagagtgacatcagccatattggctccatgagagtggagggcattgtccacccaaccacagccgaaattgacctcaaagaagatataggtaaagccttggaaaaggctgggggaaaagagttcttggaaacggtaaaggagcttcgcaaatcccaaggccctttggaagtcgccgaagccgccgtcagccaatccagtggactcgcagccaaatttgtcatccactgtcacatccctcagtggggctccgacaaatgtgaagaacagcttgaagagaccatcaaaaactgcctgtcagcggcggaggacaagaagctaaagtccgtcgcgttcccgcctttccccagcggcagaaactgctttcccaaacagactgcggcccaggtgaccctcaaagccatctcagcccactttgatgactcgagcgcgtcctcgctgaagaacgtgtacttcctgctcttcgacagcgagagcatcggcatctacgtgcaggagatggccaagctcgacgccaagtagccgccgcactttccagcagggatcggaggacgacccgagtcccaagagtggggttttgctttttaaaaggagagaggaggggtgatggcaggggagtggagggtggccgggcaggtcctgccggcgcagggagccctctgcccttcacactctcctccaaaagagcctccatctgtaaggaagcaggtctccgcgaggggtttctttccatgtgttttcctcctgttgttttagaacttttttaaaaaaacagacctcgttttagatttatagcattgacttttacacacattcacacaagaaaaaaatcctttcaaaattcttaaatcttctgttcctcctttttccaagggaagagggcaaaaagtggcctgggctctgttggtgtgcgtgttccgtggcggagagaagaaaatgggaaagacatctcactggtgcttttctcttttgttttagtgccccccgcccccatccctataatatctgtaactactcctaaaaaggttttgattcaggcttttttttggtttcattttgtttttttaagaaaaagaaaatgaaaggaaaaaaataaaa

SEQ ID NO: 839 - DNA, 1724 bp, Homo sapiens
aactgccgcttgccgccattgacacgcacagatagaacccaaagaaaggcaaagagtcctgcccggcaccggcgccgcgtgggccaaacctgcgcccgtggaggggcgcgcagagggcaccgggcgccgggagcaggcggcgcagcaccagcattgtgttagtgccgggaggccactgtgtcagcaagctgagagggaaactgaagcaagatgtcgggccggagtgggaagaagaaaatgtccaagctgtcccgttcagctagggcaggtgtcatctttccagtggggaggctgatgcgttatctgaagaaagggacgttcaagtaccggatcagcgtgggcgcccctgtctacatggcggcagtcattgagtacctggcagcggaaattctagaattggccggcaatgccgcgagggacaacaagaaggcccggatagccccgagacacatcttgctggcagttgccaatgacgaggagctcaaccagtccaaaccaaaggacagcgataaagaaggaacttcaaattccacctctgaagatgggccaggggatggattcaccattctgtcttctaagagccttgttctgggacagaagctgtccttaacccagagtgacatcagccatattggctccatgagagtggagggcattgtccacccaaccacagccgaaattgacctcaaagaagatataggtaaagccttggaaaaggctgggggaaaagagttcttggaaacggtaaaggagcttcgcaaatcccaaggccctttggaagtcgccgaagccgccgtcagccaatccagtggactcgcagccaaatttgtcatccactgtcacatccctcagtggggctccgacaaatgtgaagaacagcttgaagagaccatcaaaaactgcctgtcagcggcggaggacaagaagctaaagtccgtcgcgttcccgcctttccccagcggcagaaactgctttcccaaacagactgcggcccaggtgaccctcaaagccatctcagcccactttgatgactcgagcgcgtcctcgctgaagaacgtgtacttcctgctcttcgacagcgagagcatcggcatctacgtgcaggagatggccaagctcgacgccaagtagccgccgcactttccagcagggatcggaggacgacccgagtcccaagagtggggttttgctttttaaaaggagagaggaggggtgatggcaggggagtggagggtggccgggcaggtcctgccggcgcagggagccctctgcccttcacactctcctccaaaagagcctccatctgtaaggaagcaggtctccgcgaggggtttctttccatgtgttttcctcctgttgttttagaacttttttaaaaaaacagacctcgttttagatttatagcattgacttttacacacattcacacaagaaaaaaatcctttcaaaattcttaaatcttctgttcctcctttttccaagggaagagggcaaaaagtggcctgggctctgttggtgtgcgtgttccgtggcggagagaagaaaatgggaaagacatctcactggtgcttttctcttttgttttagtgccccccgcccccatccctataatatctgtaactactcctaaaaaggttttgattcaggcttttttttggtttcattttgtttttttaagaaaaagaaaatgaaaggaaaaaaataaaagatccagtgtctttctt

SEQ ID NO: 840 - DNA, 908 bp, Homo sapiens
gatagaacccaaagaaaggcaaagagtcctgcccggcaccggcgccgcgtgggccaaacctgcgcccgtggaggggcgcgcagagggcaccgggcgccgggagcaggcggcgcagcaccagcattgtgttagtgccgggaggccactgtgtcagcaagctgagagggaaactgaagcaagatgtcgggccggagtgggaagaagaaaatgtccaagctgtcccgttcagctagggcaggtgtcatctttccagtggggaggctgatgcgttatctgaagaaagggacgttcaagtaccggatcagcgtgggcgcccctgtctacatggcggcagtcattgagtacctggcagcggaaattctagaattggccggcaatgccgcgagggacaacaagaaggcccggatagccccgagacacatcttgctggcagttgccaatgacgaggagctcaaccagtccaaaccaaaggacagcgataaagaaggaacttcaaattccacctctgaagatgggccaggggatggattcaccattctgtcttctaagagccttgttctgggacagaagctgtccttaacccagagtgacatcagccatattggctccatgagagtggagggcattgtccacccaaccacagccgaaattgacctcaaagaagatataggtaaagccttggaaaaggctgggggaaaagagttcttggaaacggtaaaggagcttcgcaaatcccaaggccctttggaagtcgccgaagccgccgtcagccaatccagtggactcgcagccaaatttgtcatccactgtcacatccctcagtggggctccgacaaatgtgaagaacagcttgaagagaccatcaaaaactgcctgtcagcggcggaggacaagaagctaaagtccgt

SEQ ID NO: 841 - DNA, 979 bp, Homo sapiens
ctcaaggacgcgtcccgagggcgggtggcagccattggtgggatgagcaatccgagttcccggatgagggaacattctgcagtataaagggagcagggaaggcgggagacagcgcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaa

SEQ ID NO: 842 - DNA, 2162 bp, Homo sapiens
atgaagtgtcacgcagggagcctctcagcaaacctacctgcgttgaaggtgactggatggtcccgttgcgtggcatctcgtcaaccaatcacagtgggcgtctgcgggcctaagcgccccttgtggcccagctcggagaaaccattcaactttcatactttggcgaagctccatgacataggcctgggcaatgattttttggatatgaccctgaaagcccagcaacagaagcaaaaaagccatgcgaccataccaaagtgccccccacttccctggtccccaaccgtcactctctgttcttgctatctaatggccgctgcttccgccatggctgaggcttcctctgagacaacctcggaggaaggccagagcatccaggagcccaaagaggccaactccacgaaggcccagaagcagaagaggcgagggtgccgaggctcccgcaggcgccacgccaaccgccgtggggacagcttcggggacagcttcaccccctatttcccccgggtgctgaagcaggttcaccagggcctcagcctttcccaggaggccgtgagtgtcatggattctatgatccatgacatattggaccgcatcgccaccgaggctggtcagctggcccattacaccaagcgcgtgaccatcacctcccgggacatccagatggccgtgcgactgctgctgccggggaagatgggcaagctcgccgaggcccagggcacgaatgccgccctcagaacttcattatgtgcgatatggcaacagagaaagtgaatatgctgatacaagaagcaagaaaccttccttacttccaggtgtgtgtcagtaggattacggagtgtccacggaaacagctcatgccctagtgtacagtggtacagccaatgagtgacctgcagtctatgagcaacagtcattgacccaatgtggggggagtgacccaagctgaacccacagcagccttcctgttatattcaacctggtgtttaaaggaacggcagtgtgattctttacctgatgtttttgtttgcattgcttgtaatcatgatcttttagggatatgaatccaaagctaagattagaatatgtaccttgtccctaacatcaagttatacagaacattggcaaccattagtagaagtcagataaggcttatttcctcaaaagattagcatatttatattcatgttaatattaatataggctacctttcattgtgctctcttctgggtcccaagtcttggcattttaagcatttttttctataagtgtattgctgaatttcagagcaggtgctcactttcccattgctttccttttccattgatttccagtcgcccgagtatgtggacaagagaacatactctgggactgcaacccacaggaatttattatgttgtgccttgaagctcaacatgtggccatttttgttaaatgtttcccgtaaattttgaaacatctcataaacaacccttctccttcatatgtagaaaccagtaaaggatggcactctcagtcaaaccatgaaacaaaagctggataaatgacaaaaatcaaaattttcttgagcccatcagaagtgggaaagaaccaccccagagggcccaacacatagccacatagattattccaccatttaaagaggaccccttggtcaagagggaaacagggtcagggcaagatggtagccagagcttccctgagtagtgcagatgggaagaggggaaggtcacctccagagctccacttgggatccatagagaaatgatatagaaccaagaagtccactcattgggatctgttactttctgtttttccagattattagaaaaatattacagaaatagctgaagagaaatgttatgaaaatagttgaagttgtgcttattgcacgaggagaccaagaaaaaccccacaaaatcagctgcaagtaaatccttctggatggtgccaccaaatgttcctacaagtccggaacaacccttgccaaaccaaagacccttgccagaaccctgcttcttcccagagacagagctgtgtacctgacaaaacaccacatctcactcagtgacttatttctcattatgctaattgttttgctgtaaaatgccaatgtttctgtgaattaagacatacgaataaatttctgaagttacccttgc

SEQ ID NO: 843 - DNA, 1882 bp, Homo sapiens
aaccgtcactctctgttcttgctatctaatggccgctgcttccgccatggctgaggcttcctctgagacaacctcggaggaaggccagagcatccaggagcccaaagaggccaactccacgaaggcccagaagcagaagaggcgagggtgccgaggctcccgcaggcgccacgccaaccgccgtggggacagcttcggggacagcttcaccccctatttcccccgggtgctgaagcaggttcaccagggcctcagcctttcccaggaggccgtgagtgtcatggattctatgatccatgacatattggaccgcatcgccaccgaggctggtcagctggcccattacaccaagcgcgtgaccatcacctcccgggacatccagatggccgtgcgactgctgctgccggggaagatgggcaagctcgccgaggcccagggcacgaatgccgccctcagaacttcattatgtgcgatatggcaacagagaaagtgaatatgctgatacaagaagcaagaaaccttccttacttccaggtgtgtgtcagtaggattacggagtgtccacggaaacagctcatgccctagtgtacagtggtacagccaatgagtgacctgcagtctatgagcaacagtcattgacccaatgtggggggagtgacccaagctgaacccacagcagccttcctgttatattcaacctggtgtttaaaggaacggcagtgtgattctttacctgatgtttttgtttgcattgcttgtaatcatgatcttttagggatatgaatccaaagctaagattagaatatgtaccttgtccctaacatcaagttatacagaacattggcaaccattagtagaagtcagataaggcttatttcctcaaaagattagcatatttatattcatgttaatattaatataggctacctttcattgtgctctcttctgggtcccaagtcttggcattttaagcatttttttctataagtgtattgctgaatttcagagcaggtgctcactttcccattgctttccttttccattgatttccagtcgcccgagtatgtggacaagagaacatactctgggactgcaacccacaggaatttattatgttgtgccttgaagctcaacatgtggccatttttgttaaatgtttcccgtaaattttgaaacatctcataaacaacccttctccttcatatgtagaaaccagtaaaggatggcactctcagtcaaaccatgaaacaaaagctggataaatgacaaaaatcaaaattttcttgagcccatcagaagtgggaaagaaccaccccagagggcccaacacatagccacatagattattccaccatttaaagaggaccccttggtcaagagggaaacagggtcagggcaagatggtagccagagcttccctgagtagtgcagatgggaagaggggaaggtcacctccagagctccacttgggatccatagagaaatgatatagaaccaagaagtccactcattgggatctgttactttctgtttttccagattattagaaaaatattacagaaatagctgaagagaaatgttatgaaaatagttgaagttgtgcttattgcacgaggagaccaagaaaaaccccacaaaatcagctgcaagtaaatccttctggatggtgccaccaaatgttcctacaagtccggaacaacccttgccaaaccaaagacccttgccagaaccctgcttcttcccagagacagagctgtgtacctgacaaaacaccacatctcactcagtgacttatttctcattatgctaattgttttgctgtaaaatgccaatgtttctgtgaattaagacatacgaataaatttctgaagttacccttgca

SEQ ID NO: 844 - DNA, 894 bp, Homo sapiens
cgtgaagctggcccgagacgtggagccatgctgcgtaccgaagtgccccggcttccccggtccacaaccgccattgtctggtcgtgccatctaatggccactgcctccgccatggctggaccttcctctgagacgacctctgaggaacagctgatcacccaggagcccaaagaggccaactccactacgtcccagaagcagagcaagcagaggaagcgagggcgccatgggccccgcaggtgccactccaactgccgcggggacagcttcgccacctatttccgccgggtgctgaagcaggttcaccagggcctcagcctttcccgggaggccgtgagtgtcatggattctttggttcatgacatattggaccgcatcgccaccgaggctggtcgcctggcccgctccaccaagcgccagaccatcactgcctgggagacccggatggctgtgcgcctgctgctgccggggcagatgggcaagctcgccgagtccgaaggcacgaaggctgtcctcagaacttcactgtatgccatacagcaacagagaaagtgaatacgctgatacaagaagcaagaatattagaaaaatgtcatgaaaatagttgaagagaaatgctcactgcacaaggagaccaagaaaaaccccccacgaaatcagccacaactaaatcgctctggacggtgccgccaggtgaccctacatgtccggagcaacactttgaaaaccaaagacgcttggcagaaccctgttcctttccagagacagagctgtgtaccttgtctaaaacaccgcatctcactcagtgacttatttctcattatgctaattgttttcgctttaaagcgccagtctttctgtcaaatgggacatacaaataaatttctaaaatta

SEQ ID NO: 845 - DNA, 1053 bp, Homo sapiens
ggctcttcctcgggcagcggaagcagcgcggaggtcggagaagtggcctaaaacttcggcgttgggtgaaagaaaatggcccgaaccaagcagactgctcgtaaatccaccggtgggaaagccccccgcaaacagctggccacgaaagctgccaggaaaagcaccccctctacctgcggggtgaagcctcatcgctacaggcctgggaccgtggcgcttcgagagattcgtcgttatcagaagtcgaccgagctgctcatccggaagctgcccttccagaggttggtgagggagatcgcgcaggatttcaacactgacctgaggtttcagagcgcagccgtcggtgcgctgcaggaggctagcgaagcgtacctggtgggtctgttggaagatactaacctgtgtgccatccacgctaagagagtcaccatcatgcccaaagacatccagttggctcgccggatacggggagagagagcttaagtgaaggcagtttttatggcattttgtagtaaattctgtaaaatactttggtttaattggtgactttttttgtaagaaattgtttatatgttgcatttgtacttaagtcattccatctttcactcaggatgaatgcgaaaagtgactgtttacagacctcagtgatgtcagcactgttgctcaggagtgacaagttgttaatatgcaaaacggatgcgtgatatttcttgcttctcatgatgcatgtttctgtatgttaatgacttgttgggtagctattaaggtactagaattgataaatgtgtacaacagggtccttttgcaataaaactggttatgacttgatccaagtgtttaacaattggggctgttaagtctgaccatacatcactgtgatagaatgtaggctttttcaagggtgaagatacaaaccttaaccacagtgtaacttatagtttcctttaaaaaaaaaaaattaaacctggcagctatagaatacaatatgtgcatttataatagctattttatatattgtagtgtcaacattttcaaattaaatgttttacattc

SEQ ID NO: 846 - DNA, 793 bp, Homo sapiens
ggtaccatgtgggaagcgctgtgaagagttgttgccttccaagatatacccaaattcccagttccagcccgtgtcattaaaactccgctggcgtgaaagatgacgtccttagcccagcagctgcaacgactcgccctccctcaaagtgatgccagcctcttatctagagatgaagttgcttctttgttatttgaccctaaggaagcggccacaatcgacagggacaccgccttcgccattggatgtactggcctggaagagttgcttggaattgatccttcctttgagcagtttgaagcaccgttgttcagtcagctagcaaaaaccttggagcgaagtgttcagaccaaagcagtaaacaaacagttggatgaaaacatttcattattccttattcacttgtcgccttacttcctgcttaagccagcacagaagtgtctggagtggttgattcacaggtagctaatagaattacagaaataactatgggttaatcactttggtcttgtaaaaaattaagtagttgagaacttatcaaattaaagctgaaaaattaggtatattaagagattgatacaatgtccattgtgtgagataagcatgctcttctgcctttaaattcttttttgttgatagtgaaaagtagaactactggtgattttgagtaaatggtctaacctcattagtttttttttgagatagagtcttgctgggcactcaggctggagtgcaatattgaaatcttggctcactgcaacctctgcctcccaggttcaagtgattctcccacctc

SEQ ID NO: 847 - DNA, 6538 bp, Homo sapiens
gagggttgggctccttggtaccatgtgggaagcgctgtgaagagttgttgccttccaagatatacccaaattcccagttccagcccgtgtcattaaaactccgctggcgtgaaagatgacgtccttagcccagcagctgcaacgactcgccctccctcaaagtgatgccagcctcttatctagagatgaagttgcttctttgttatttgaccctaaggaagcggccacaatcgacagggacaccgccttcgccattggatgtactggcctggaagagttgcttggaattgatccttcctttgagcagtttgaagcaccgttgttcagtcagctagcaaaaaccttggagcgaagtgttcagaccaaagcagtaaacaaacagttggatgaaaacatttcattattccttattcacttgtcgccttacttcctgcttaagccagcacagaagtgtctggagtggttgattcacaggttccatatacatctctataatcaagatagcctcattgcttgtgttctgccataccacgagacaagaatatttgtgcgagtcatacagcttctaaaaattaataattcaaagcacagatggttctggttgttgccagttaagcaatctggagtgccgttagctaaaggaactttgattacccactgctacaaagatcttggattcatggatttcatttgcagtttggtgacaaaatctgtgaaggtttttgctgagtacccgggcagctcagctcagttgagggtgctcttggctttctatgcttctaccatagtgtcggcgctggtagctgcagaggacgtatcagacaatatcatcgccaaactatttccctatatccaaaagggattgaaatcatctttaccagattacagagctgcaacatacatgataatatgtcagatttctgtgaaagtgaccatggaaaatacctttgtgaattcattggcatcacagatcatcaaaacattgaccaagattccctctttgatcaaggatgggttaagttgcttgatagtgctcctgcagagacagaagccagagagccttgggaaaaagccattccctcacttatgtaatgttcctgatcttattacaatacttcatgggatttctgaaacttacgatgtcagtcctcttctgcattacatgcttccccatctggtcgtctccatcattcatcatgttacaggagaagaaactgaaggaatggatggtcaaatctacaagagacacttagaagctatacttacaaaaatatcactgaagaacaacttagaccatttgttggctagccttctatttgaagagtatatttcatatagttcacaggaagaaatggattctaataaagtgtctttgcttaatgaacaatttcttccactcattaggcttttagaaagcaaataccccagaacattagatgttgtattagaggaacacttaaaggaaattgcagatctgaaaaaacaagagcttttccatcagtttgtttctctttctacaagtggaggaaagtatcagtttttagcagattctgatacttctttgatgctcagcctgaatcatccacttgctcctgtgagaattctggccatgaatcatttgaaaaagatcatgaaaacatcaaaggagggtgttgatgaatctttcataaaagaagctgttttagcccgattaggtgatgataatatagatgttgttttgtcggctataagtgcttttgagattttcaaagaacacttcagttcagaagtgacgatttcaaatcttctgaatctctttcaaagagcagaactttcaaagaatggagaatggtacgaggtacttaagatagccgctgacatattaattaaagaagagatactgagtgaaaatgatcagttgtcaaatcaggtggttgtatgtttgctgccatttatggttatcaataatgatgatacggaatctgctgagatgaaaattgctatatatttatcaaaatcaggaatctgctccctgcaccctctattaagaggctgggaagaagctcttgaaaatgtaattaaaagcacaaagccaggaaaactaatcggtgtagcaaatcagaagatgattgagttgttggctgataatataaatttaggagatccttcttcaatgttaaagatggtggaggatttaataagcgtgggtgaggaggagtcctttaacctgaagcagaaagtaacgtttcatgtgatcctgtctgtgctcgtctcttgttgttcatctttaaaagaaacccactttccatttgcgataagagtcttcagtttgttgcagaaaaaaataaagaagcttgaaagtgtcattactgcagtggaaatcccctcagaatggcacattgaactgatgttagacagagggatcccagtggagctgtgggcacattatgtagaagagctcaacagcactcagagggtggccgtggaggactcggtttttcttgtattttccttgaaaaaatttatttatgcactgaaagctcctaaatcttttcctaaaggtgatatatggtggaatcctgaacaactgaaagaagacagcagggactatctgcacttgctcattgggctgtttgagatgatgctcaatggtgccgatgctgttcatttcagagttctgatgaaacttttcataaaggtgcatctagaagatgtttttcagttattcaagttctgttctgttttatggacctatggttctagcctttcaaatccactaaactgcagtgtgaaaacagtgctgcagactcaagctctttatgtgggctgtgcaatgctttcttctcagaagacacagtgtaaacaccaactggcatccatatcttctccagtggtgacatctttactcattaacctgggaagccccgtaaaagaagttcgtagggctgccattcagtgtctccaggccctcagtggagtggcatccccgttttatctgataatagatcatttgatttctaaagcagaggagatcacttcagatgctgcctatgttattcaggatttggctactttatttgaggaactacagagagaaaagaaactgaaatctcatcagaagttgtctgaaactttgaaaaacttacttagttgtgtgtatagttgcccatcttatatagcaaaagatttgatgaaagtacttcagggagtcaacggtgagattacaaaaccattttttgcagccatatcagatgaaaaagttcagcagaagcttttaagaatgttgtttgatttattggtgaactgtaaaaactcacattgtgctcagactgtcagcagtgtttttaaagggatttccgttaatgctgaacaagtccgaatagaactggagccaccagataaagctaaacccttgggcacagttcagcaaaaaagaaggcaaaaaatgcagcagaaaaaatcacaagatctagaatctgttcaggaagttggaggttcttactggcaaagagtaactctcatcctggaattactgcagcacaaaaagaagctcagaagtcctcagatattggtgccaactctttttaacttgctatcaagatgtttagaacccttgccacaagagcagggaaatatggaatacaccaaacaattaattcttagttgtctgctcaacatctgccaaaaactatctccagatggtggcaaaatacccaaagatattttagatgaggagaagttcaacgtggagttgatagttcagtgcatccgcctttcggagatgccgcagacccatcaccatgcccttttacttttgggcactgttgctggaatatttccggataaagttttacacaatatcatgtctatttttacatttatgggagccaatgtcatgcgcctagatgatacttacagttttcaagttattaacaagacagtgaaaatggttattcccgcacttattcagtctgatagtggagattctatagaagtttcaagaaacgttgaagagattgtggtaaaaatcattagtgtatttgtggatgcgctgccacacgtcccggagcacaggcgcctgcccatccttgttcaacttgttgatacactgggtgcagagaaattcctctggattctcctcatcttgctttttgaacagtatgtcacaaaaacagtgctggcggctgcctatggcgaaaaggatgctattttagaagcagacactgaattttggttttcagtctgttgtgagtttagtgtccagcatcagatacaaagcttgatgaatatcctccagtacttactaaagctgccagaggaaaaagaagaaaccattcccaaagcagtgtcatttaataagagtgaatcacaagaagaaatgctacaggtttttaatgtagagactcacactagcaagcaactgcggcattttaaatttttgtcagtgtccttcatgtctcagctcctgtcttccaataattttctgaaaaaggtagttgagagtggtggtcctgagattttaaaaggccttgaagagaggttgctggagaccgttctcggctatatcagtgcagttgcacagtccatggaaaggaacgcagacaaactcaccgtgaagttctggcgcgcgctccttagtaaagcttacgacctgttagataaggtcaatgccttgctgcccacagagacattcattcctgtgatcagagggctggtgggcaatcccctgccatctgttcgccgcaaagcgctggaccttttgaataacaagctgcagcaaaatatatcctggaagaagacaatagttacccgtttcctaaaactggttccagaccttttggccattgtgcagcgtaagaaaaaggaaggggaagaagaacaagcaatcaacagacagacagcattgtataccttaaagcttttatgcaagaattttggtgcagaaaatccagatccttttgtcccagtgctgaacactgctgtgaaactgattgctccagagagaaaggaggagaagaatgtcctgggaagcgcgctgctgtgcatagcagaggtgacctccaccctggaggcgctggccatcccccagcttcccagcctgatgccatcgttgctgacaacaatgaagaacaccagcgagctggtctccagcgaggtctacctgctcagtgccttggctgctctgcagaaggttgtggagactctcccgcacttcatcagcccctatctggaaggcattctctcccaggtgattcatctggagaaaatcactagtgaaatgggttctgcgtcacaggctaatatccgtctcacatctcttaaaaagacactggctaccacacttgcaccccgagtcctgttgcccgccatcaaaaaaacttacaagcagattgagaagaactggaagaatcacatgggtccgtttatgagcatcttgcaagagcatattggggtgatgaagaaggaagagctcacctcccatcagtctcagctaaccgcctttttcctggaagccctggacttccgagcccagcactctgagaacgatctggaggaagttggaaaaacggaaaattgtatcattgactgtctagtagccatggttgtcaaactttccgaggtcacattcaggcccctgttcttcaagctgtttgattgggctaaaacagaagatgccccaaaggacaggttgttgacattttacaacttggcagattgcattgctgaaaagctgaaagggctttttactctgtttgccggccacttagtgaagccttttgctgacaccttgaaccaggtgaacatctccaaaacagatgaagcattttttgactctgaaaatgaccctgaaaagtgctgcttgctgttgcagtttattttgaactgtttatacaaaatcttcctttttgatacccagcattttataagtaaagagagagcagaagccttgatgatgcctctggtggatcagctggaaaacaggcttgggggagaagagaaattccaggaacgggtgacaaagcacctgataccatgcatcgcacagttttcggtggccatggcggatgactctctttggaaaccactgaactaccagattctgctaaagacgagagactcctcgcctaaggttcgatttgctgctttgattactgtgttagcactggctgaaaaactaaaggagaattatattgtcttgctaccagaatccattcctttcttagcagagttgatggaagatgaatgtgaagaagtagaacatcagtgccaaaagactattcagcaactggaaactgtcctgggagagccactccagagctatttctaagactttctgtggtgtttcatactctactcagagttcacactcatatttcatatttttatttttgggtgttgggtgccatgttacttttggtgccttaatacacctacttggattacttacaaatgttttatcacttctttacaaaatccccacctggcttgtgctgccacataagcctctcctgcctatcgtatagagctgcagaaagagtaaatgatacacggtattttt

SEQ ID NO: 848 - DNA, 8447 bp, Homo sapiens
gagggttgggctccttggtaccatgtgggaagcgctgtgaagagttgttgccttccaagatatacccaaattcccagttccagcccgtgtcattaaaactccgctggcgtgaaagatgacgtccttagcccagcagctgcaacgactcgccctccctcaaagtgatgccagcctcttatctagagatgaagttgcttctttgttatttgaccctaaggaagcggccacaatcgacagggacaccgccttcgccattggatgtactggcctggaagagttgcttggaattgatccttcctttgagcagtttgaagcaccgttgttcagtcagctagcaaaaaccttggagcgaagtgttcagaccaaagcagtaaacaaacagttggatgaaaacatttcattattccttattcacttgtcgccttacttcctgcttaagccagcacagaagtgtctggagtggttgattcacaggttccatatacatctctataatcaagatagcctcattgcttgtgttctgccataccacgagacaagaatatttgtgcgagtcatacagcttctaaaaattaataattcaaagcacagatggttctggttgttgccagttaagcaatctggagtgccgttagctaaaggaactttgattacccactgctacaaagatcttggattcatggatttcatttgcagtttggtgacaaaatctgtgaaggtttttgctgagtacccgggcagctcagctcagttgagggtgctcttggctttctatgcttctaccatagtgtcggcgctggtagctgcagaggacgtatcagacaatatcatcgccaaactatttccctatatccaaaagggattgaaatcatctttaccagattacagagctgcaacatacatgataatatgtcagatttctgtgaaagtgaccatggaaaatacctttgtgaattcattggcatcacagatcatcaaaacattgaccaagattccctctttgatcaaggatgggttaagttgcttgatagtgctcctgcagagacagaagccagagagccttgggaaaaagccattccctcacttatgtaatgttcctgatcttattacaatacttcatgggatttctgaaacttacgatgtcagtcctcttctgcattacatgcttccccatctggtcgtctccatcattcatcatgttacaggagaagaaactgaaggaatggatggtcaaatctacaagagacacttagaagctatacttacaaaaatatcactgaagaacaacttagaccatttgttggctagccttctatttgaagagtatatttcatatagttcacaggaagaaatggattctaataaagtgtctttgcttaatgaacaatttcttccactcattaggcttttagaaagcaaataccccagaacattagatgttgtattagaggaacacttaaaggaaattgcagatctgaaaaaacaagagcttttccatcagtttgtttctctttctacaagtggaggaaagtatcagtttttagcagattctgatacttctttgatgctcagcctgaatcatccacttgctcctgtgagaattctggccatgaatcatttgaaaaagatcatgaaaacatcaaaggagggtgttgatgaatctttcataaaagaagctgttttagcccgattaggtgatgataatatagatgttgttttgtcggctataagtgcttttgagattttcaaagaacacttcagttcagaagtgacgatttcaaatcttctgaatctctttcaaagagcagaactttcaaagaatggagaatggtacgaggtacttaagatagccgctgacatattaattaaagaagagatactgagtgaaaatgatcagttgtcaaatcaggtggttgtatgtttgctgccatttatggttatcaataatgatgatacggaatctgctgagatgaaaattgctatatatttatcaaaatcaggaatctgctccctgcaccctctattaagaggctgggaagaagctcttgaaaatgtaattaaaagcacaaagccaggaaaactaatcggtgtagcaaatcagaagatgattgagttgttggctgataatataaatttaggagatccttcttcaatgttaaagatggtggaggatttaataagcgtgggtgaggaggagtcctttaacctgaagcagaaagtaacgtttcatgtgatcctgtctgtgctcgtctcttgttgttcatctttaaaagaaacccactttccatttgcgataagagtcttcagtttgttgcagaaaaaaataaagaagcttgaaagtgtcattactgcagtggaaatcccctcagaatggcacattgaactgatgttagacagagggatcccagtggagctgtgggcacattatgtagaagagctcaacagcactcagagggtggccgtggaggactcggtttttcttgtattttccttgaaaaaatttatttatgcactgaaagctcctaaatcttttcctaaaggtgatatatggtggaatcctgaacaactgaaagaagacagcagggactatctgcacttgctcattgggctgtttgagatgatgctcaatggtgccgatgctgttcatttcagagttctgatgaaacttttcataaaggtgcatctagaagatgtttttcagttattcaagttctgttctgttttatggacctatggttctagcctttcaaatccactaaactgcagtgtgaaaacagtgctgcagactcaagctctttatgtgggctgtgcaatgctttcttctcagaagacacagtgtaaacaccaactggcatccatatcttctccagtggtgacatctttactcattaacctgggaagccccgtaaaagaagttcgtagggctgccattcagtgtctccaggccctcagtggagtggcatccccgttttatctgataatagatcatttgatttctaaagcagaggagatcacttcagatgctgcctatgttattcaggatttggctactttatttgaggaactacagagagaaaagaaactgaaatctcatcagaagttgtctgaaactttgaaaaacttacttagttgtgtgtatagttgcccatcttatatagcaaaagatttgatgaaagtacttcagggagtcaacggtgagatggtgctttctcagctattgcctatggctgaacaactgctagaaaagatccagaaggagcccacagctgtgctgaaagatgaggccatggttctgcatctcactctgggaaagtataatgaattttcagtttcccttttaaatgaggatccgaagagtctagatatatttataaaagctgtgcacacaacaaaggaactttacgcgggaatgccaaccattcagatcacagcccttgaaaagattacaaaaccattttttgcagccatatcagatgaaaaagttcagcagaagcttttaagaatgttgtttgatttattggtgaactgtaaaaactcacattgtgctcagactgtcagcagtgtttttaaagggatttccgttaatgctgaacaagtccgaatagaactggagccaccagataaagctaaacccttgggcacagttcagcaaaaaagaaggcaaaaaatgcagcagaaaaaatcacaagatctagaatctgttcaggaagttggaggttcttactggcaaagagtaactctcatcctggaattactgcagcacaaaaagaagctcagaagtcctcagatattggtgccaactctttttaacttgctatcaagatgtttagaacccttgccacaagagcagggaaatatggaatacaccaaacaattaattcttagttgtctgctcaacatctgccaaaaactatctccagatggtggcaaaatacccaaagatattttagatgaggagaagttcaacgtggagttgatagttcagtgcatccgcctttcggagatgccgcagacccatcaccatgcccttttacttttgggcactgttgctggaatatttccggataaagttttacacaatatcatgtctatttttacatttatgggagccaatgtcatgcgcctagatgatacttacagttttcaagttattaacaagacagtgaaaatggttattcccgcacttattcagtctgatagtggagattctatagaagtttcaagaaacgttgaagagattgtggtaaaaatcattagtgtatttgtggatgcgctgccacacgtcccggagcacaggcgcctgcccatccttgttcaacttgttgatacactgggtgcagagaaattcctctggattctcctcatcttgctttttgaacagtatgtcacaaaaacagtgctggcggctgcctatggcgaaaaggatgctattttagaagcagacactgaattttggttttcagtctgttgtgagtttagtgtccagcatcagatacaaagcttgatgaatatcctccagtacttactaaagctgccagaggaaaaagaagaaaccattcccaaagcagtgtcatttaataagagtgaatcacaagaagaaatgctacaggtttttaatgtagagactcacactagcaagcaactgcggcattttaaatttttgtcagtgtccttcatgtctcagctcctgtcttccaataattttctgaaaaaggtagttgagagtggtggtcctgagattttaaaaggccttgaagagaggttgctggagaccgttctcggctatatcagtgcagttgcacagtccatggaaaggaacgcagacaaactcaccgtgaagttctggcgcgcgctccttagtaaagcttacgacctgttagataaggtcaatgccttgctgcccacagagacattcattcctgtgatcagagggctggtgggcaatcccctgccatctgttcgccgcaaagcgctggaccttttgaataacaagctgcagcaaaatatatcctggaagaagacaatagttacccgtttcctaaaactggttccagaccttttggccattgtgcagcgtaagaaaaaggaaggggaagaagaacaagcaatcaacagacagacagcattgtataccttaaagcttttatgcaagaattttggtgcagaaaatccagatccttttgtcccagtgctgaacactgctgtgaaactgattgctccagagagaaaggaggagaagaatgtcctgggaagcgcgctgctgtgcatagcagaggtgacctccaccctggaggcgctggccatcccccagcttcccagcctgatgccatcgttgctgacaacaatgaagaacaccagcgagctggtctccagcgaggtctacctgctcagtgccttggctgctctgcagaaggttgtggagactctcccgcacttcatcagcccctatctggaaggcattctctcccaggtgattcatctggagaaaatcactagtgaaatgggttctgcgtcacaggctaatatccgtctcacatctcttaaaaagacactggctaccacacttgcaccccgagtcctgttgcccgccatcaaaaaaacttacaagcagattgagaagaactggaagaatcacatgggtccgtttatgagcatcttgcaagagcatattggggtgatgaagaaggaagagctcacctcccatcagtctcagctaaccgcctttttcctggaagccctggacttccgagcccagcactctgagaacgatctggaggaagttggaaaaacggaaaattgtatcattgactgtctagtagccatggttgtcaaactttccgaggtcacattcaggcccctgttcttcaagctgtttgattgggctaaaacagaagatgccccaaaggacaggttgttgacattttacaacttggcagattgcattgctgaaaagctgaaagggctttttactctgtttgccggccacttagtgaagccttttgctgacaccttgaaccaggtgaacatctccaaaacagatgaagcattttttgactctgaaaatgaccctgaaaagtgctgcttgctgttgcagtttattttgaactgtttatacaaaatcttcctttttgatacccagcattttataagtaaagagagagcagaagccttgatgatgcctctggtggatcagctggaaaacaggcttgggggagaagagaaattccaggaacgggtgacaaagcacctgataccatgcatcgcacagttttcggtggccatggcggatgactctctttggaaaccactgaactaccagattctgctaaagacgagagactcctcgcctaaggttcgatttgctgctttgattactgtgttagcactggctgaaaaactaaaggagaattatattgtcttgctaccagaatccattcctttcttagcagagttgatggaagatgaatgtgaagaagtagaacatcagtgccaaaagactattcagcaactggaaactgtcctgggagagccactccagagctatttctaagactttctgtggtgtttcatactctactcagagttcacactcatatttcatatttttatttttgggtgttgggtgccatgttacttttggtgccttaatacacctacttggattacttacaaatgttttatcacttctttacaaaatccccacctggcttgtgctgccacataagcctctcctgcctatcgtatagagctgcagaaagagtaaatgatacacggtatttttatacagactgctgtgtttgtttaaacatttattattctcttcctgattgatggtaataatattagacttgttaattttagcacccaaagctgacgcctcatttgcactgtaagccttaactcttctgtacagcagtatcttacatacatggtatccatgttgcagatttcactcaaagttgctctatttcaagaaaatgaagttatttagcaatcaacagaagtacttttgactgtaaagcctacttttcattttgggtaggcgaacttcagccttcgtttctttgttgtgcccataaagagaagtggttctggaatgctttttttaacccaggagtgtgactgtcacctttatcctttgttcttttgggaaacgggagagatgaaggcaacacgctgcttctaaaacagctcacacctggctgctcacacagagggcccagaaacactgggtggcacgaggaagctcctccaggattcagaatgaacccagttccattggtggttaactaagaactacttgtctaagaaagtaagtatcagtagatttttttcaatgctttgaagtgccctaatctctagtactgggtcatggtgaagttggaaagtgagggttcaaataaaattagatctgccccctttttaaaggcatctaagaacatcccgtagaatgttcgcattgagtttaaaagcctttgaagctaatatagaagtttaatgcagaaatgtggcaagcaaaaggccaacttgcattttagagacagagcttgctagtatagaagtgcatatttctaagaaatgtctcagtaaaattcattaataaatactaatagctttttaaatttttttcctccacgtaaaatgaaaatgaacttaagacttacaaggaatgatgtgagtgggctatttttttcctaaatgcctcacagtctccaacagctcagttaagcactctgatggtctttatggagaaaaataactctgggggattctcgagtcttcttgccttctacagctttccctgtggcaccctccacccccaaccagtgtctttgagcttggtgagactctgcatacattaatatgaaaagctggaaaagaattaagggctagcgatttctacactgagtacttttaaaaaaataagattgacaatggtattcttttcaatatatggatagaaataatatctaaaatctgttctgaaaatattcctaaatcctggcagagttctgccccagtctaatgtgataaaatgatcctcactgactgagcttttttccctccccactcccaaacctttgaaatttcctgtaacaagatctgacctgtaaagatcccatatacatggaacttctgccaactcccctcaaataatagaaaaatcacagaaatggaaccatttaacttgctgatacaggtttgattttaatcacgtaaagtggaagagtgctttgatctcagttgctaatgatgatggactaatctttagaagaacggaggccttgattggtgatttcatgggaacaaaacagatttctgcattacctctgcctgctttgtgggtcccttagttggcgtacactttctgatagtgcctgccttatgaatgcctgaagtctaatcctgaccttactttgttgcccataaatatctttcaaattgaa

SEQ ID NO: 849 - DNA, 1891 bp, Homo sapiens
cgagaagcagcggcccggggcgactgagcggacaaacggaagtgtaggttacggtctgagacatcaccgccaagctgggcatcggggagatggccgagactgaccccaagaccgtgcaggacctcacctcggtggtgcagacactcctgcagcagatgcaagataaatttcagaccatgtctgaccagatcattgggagaattgatgatatgagtagtcgcattgatgatctggaaaagaatatcgcggacctcatgacacaggctggggtggaagaactggaaagtgaaaacaagatacctgccacgcaaaagagttgaaggttgctaataatttatactggaatctggcatttttccaagccaagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggttcttgcataacattgtcagattttttagtgtatttctgtgaagtcattttttttcttgtcattccttttgtagtagttgctgtttggataaaagttgatgtgtgattttttattaaacaaatagtaaacccttcaattatagttagtcttggtgaagtaagatgtttgtagactttagagttctttaattcttggcacaacgtgactgttgagctaacaccaaatagtgtgttggcaatacttttcaaatggctgaaaacacctaaaaattgttcattcagaaatatctgtcactgctctgttgccaaaactcagaatagaacttagacgtatgtctgagtccctgagatcacatgctaaagtcgatgaaaagtaaccactgccactgtcttgtgtcagaacttttacagtacagaaaataacagaatagccttctgtaatgaggcgtttgttagagttttgcatgagattctaatacttcagtaggaccctacctacgtggttcatctacaatggttaccataaaaaatctggcaggattttaaaactcaatcagtctttcctttgagctagtgacttgaaaagaaagagagaaggaaaagagaccatattaagtccatgccagttgcttggctagaatatgatcaacgacttgtagtagactcaagtttttaaaaaacactattttacttaaactgtttcttatctaaattcttgcagagtgtcaatgttatcattgattatagaagacagggataatacctttatctctggccactcaaaaatgcagtgccaggagtgctaaacctagaggccaatactgatgacctggaaggtgatccatatgattgtcaccacaaagtgcttttacacaaaaacttgaaaatttgaaaaacatgatttttttaagtttctcatctcaccagtcttggtgtttatattgcaaatctatcaaagtaagaaataatttgtgctgtatacaaattacatggggaacataaaggagtgagatccttctgtgataaaatgaattcaccactctggttacccaactacagaacctcctttgatcaggccagtaggttgtgatgcaggctggagcccccgaatgccccacacacactgcagcattgaccagaccatccgaaacctgcgtccctggtgatgttctcaagcctcggaagtggcaaatggaaatgatatggccggttgcggttgtaggagagttgtgacttaggcaggagtcgacctcctcaagtaatggaacgatttcaaaggcaggctgccctgaccaaaaatatctgccatgaataaaggtgcctgaaatcct

SEQ ID NO: 850 - DNA, 4107 bp, Homo sapiens
ggtccctggtacgcggcggatgggcgccggcaggagcgggcagggcgaggcgaaggccggggagggatcgagaacggtgtgggagagctaggctcggggggcgaggccccggcccggcggggcgatggaggcgctgctctccacccccatcaaccccaacaacttccccgccaagctgtggcgcctggtgaacagcccgcgctaccgctccatccgctgggacggccgcggcgaggggctgcttatcgatcagccgctcttcgaggccgagctgctcagcccgcccgggccggggggcggtggcgggactgcgggggccggggccgagcccgagctcttcaaaaccaccagcttcaccagcttcatccgccagctcaacctctacggcttccgcaaggtggtgctgggcgggccggggggcggcaaaccggcaggcaatgggccgctccatcacttccacaacccgcacttccgccgcgaccagccacagctgctcgtgcacctcaagcgcctcaccagcgccaacaaggccaagctggcggccggcctggaggtgccctgccgcccgcccaaccgcttccagcggctgctcatcacctcggcctccgccgccaccgcgccactgcagcaccagcagccgccgccgcccgcggggccccggcccgagccgcacggaccagtggctgtaggacaatttcaccggtcatttcgtcgagatagtttgtctccttactcctgtgtatcaactccatcccacgaccacagtacttaccctctgaaaggtttagatcggaccccagttcctcatagaatatggcagaactcccttggaatgcatcctggacaagtggagacatctcccacattttcagataaaggggttccgtttcctgtactccagaggtttccaactgaggttacctatacactgcagcccagcaccacatctgtacatgttcaacaaggtcctcaaacaatggtcagctcctcccaaaaatacagtaactacacaccctcagcacagtactcgcaagcctactatccaacagctgtgctacagtgctgttctcctacccacatggatgctctaagtagttgtgtcactcccaatgcctcttcctatgcacactgcaactacttccagaatccttcaatgcagtcctcctatccagttgaatttttgccttccaattggccctgcagtactactgatgaaaatacaaagacagaagtaaacctagaggctgtctttcagatagttgatgagttgcattcctcccctaaattggagatggtaaaggtggagcctgttgagaatcagtgcccaacatctccgtcttacagaggccaacacattttagctaattctaacaacagcaatccatgttctgcaagtcaggctagccagctggagccacttactcctgtaggctcagatattatgtcttttgtggttggaacagaacaagcagttgcctgctctctaccacagtcacctgagtacatctataccatccacacagctcagcctgttgaaaatagcacaatacaggaatctgcagccatccagcaagctcatgtcaaactgaaggagcacctaaatcataatccatctccatcttcagtagtatttgtgcaggaagggccaccattcagcacacaccaggtggatgccaacataaaatgccagaccagttcacgtgagaatatcttgccgtcagaacagatgggattcctcatttcagaaatggggcctgctagcaagcctagtgaagacacaggtttagccactccagccagatacagagagcacagaagcaactcacaacaaggaaagtcccctgatcttcatctgctggtggacgtggcctgcaagcaggagcgctttccaaaggaggaagaattaaaagagtgaggaatggatgacaaatgtgacattgtgcactagctgtagctggaggcagactagccttgcacatgacaaactgttgggattttttcagttctgttaaggaaaaaaaagtattttttgtttcgttaattgagaattttgttaattgagaattgggaatttgtatgtactacagtggttcagttcagattatctgccttgacaaactactgaacatctagcagccacgttttttggctgcccagatcccttttaaatgaaaagttctgaccttctgttatagtcaaggagcatctaaaaactgctccatctatggtactaagaataatctgtgtgtgtgctgatttgttgtcttgccactcaaactgtagtcagcacaactttagtggggaattcagtctctctgattcaagtcacagtgtgatccttttagaggagattgtgtgagaaacaaaggcatgtgaggtcaccagcatcacaggtctaaatgcatcaggaattccagggaagaaactctggagaagagctaattttctaagtgattaaccaggaaattctcttacttcctaacccagcattctgttttaagagcaaggcatccggacttggaccatctatcacacttaacagcccctgattcttttatattaatggaagcattcttctattttcatatctttctttaattttaatgatacattatcataaatggtaaaaagattttattaatatatcacttatttaaatgtctttaaagaaagtatttaacttgtttaatataattgtatttataaatgctgatagatttaaaggttttaaagttttatatttttattattgcaggatagaaggataaaggatgcatgtgtagtatttttattttgaaaggaaaatgtacaatgtgtgaacaaaaacattaagagatttaatatactattttcttattttagatttttacattcaataagtataaattctcatctatataaggtattgtgtgcaaatttgggaaaaaactgattagcagccatttagtagaagctatgcctctgatttttaaagaatggtttcaatctggtttaagcttctgagagaattttggataatgggatagatggtaacatttttttcttatccctgttacaggattctagatttgtgcagtaggattgtgggactgtgttttaggagagaaggatgtcttggatgtccagtttctgtggttaatcccttacttgcttatccagtgacagcaagaaactttctgatttaaagtctttcaattgaccaaaactttcttattggattctgtttcagttctcctattaagcactgcagaaacgaaaggaaagcctaggaatatgaaactaattaaaaaggcacttggtgatatgacatagtactatgctagccgttgtggatgtaacagttcatttcttatactgcattgtgccttcccaatgatgtcaaaccctagaaatattacagagatctacttttctggaaaagggtgagctctgtattgatctgcagtgactctgtttagatattaaagtaggttctgaaaagcgacctgtgtggtccctctgattagactagttaatgtctatgtgatgggcatttatttatctttattagcaaggtttaaaagagcaaattatcaagacacctatatcttttggccagactatataatattttgtcagagtatgtgaagaggagacccaatttccaaatgaaggaactttgctttttctctgtcatgttgaagagctaatatactgtgtagattttcccctaaatatggctttcttagctttatagatgttgagataatatcttttgaggaacacatgtcaagcaggaaccttggcatagatttggtttcagttgttttaaggcttaattaatgaaatgccttaatcagctttccaaacatttttatatatgaatacagcagaccaaggagctggatctcctgctatccttacacgccttgtatctatcaactaaagctgtcattaatgacttgggcaaaatggcaagaggtataataaagtcttcctgtgaattagccagtagggtctgacacaactagtcaactaacaaggttcctgactagtacctcagtatttcagcaccttaagcactgataaatttcaatcagtcaacaataaagtgagtgttccaactag

SEQ ID NO: 851 - DNA, 3683 bp, Homo sapiens
ggagggatcgagaacggtgtgggagagctaggctcggggggcgaggccccggcccggcggggcgatggaggcgctgctctccacccccatcaaccccaacaacttccccgccaagctgtggcgcctggtgaacagcccgcgctaccgctccatccgctgggacggccgcggcgaggggctgcttatcgatcagccgctcttcgaggccgagctgctcagccccccgcggggccccggcccgagccgcacggaccagtggctgtaggacaatttcaccggtcatttcgtcgagatagtttgtctccttactcctgtgtatcaactccatcccacgaccacagtacttaccctctgaaaggtttagatcggaccccagttcctcatagaatatggcagaactcccttggaatgcatcctggacaagtggagacatctcccacattttcagataaaggggttccgtttcctgtactccagaggtttccaactgaggttacctatacactgcagcccagcaccacatctgtacatgttcaacaaggtcctcaaacaatggtcagctcctcccaaaaatacagtaactacacaccctcagcacagtactcgcaagcctactatccaacagctgtgctacagtgctgttctcctacccacatggatgctctaagtagttgtgtcactcccaatgcctcttcctatgcacactgcaactacttccagaatccttcaatgcagtcctcctatccagttgaatttttgccttccaattggccctgcagtactactgatgaaaatacaaagacagaagtaaacctagaggctgtctttcagatagttgatgagttgcattcctcccctaaattggagatggtaaaggtggagcctgttgagaatcagtgcccaacatctccgtcttacagaggccaacacattttagctaattctaacaacagcaatccatgttctgcaagtcaggctagccagctggagccacttactcctgtaggctcagatattatgtcttttgtggttggaacagaacaagcagttgcctgctctctaccacagtcacctgagtacatctataccatccacacagctcagcctgttgaaaatagcacaatacaggaatctgcagccatccagcaagctcatgtcaaactgaaggagcacctaaatcataatccatctccatcttcagtagtatttgtgcaggaagggccaccattcagcacacaccaggtggatgccaacataaaatgccagaccagttcacgtgagaatatcttgccgtcagaacagatgggattcctcatttcagaaatggggcctgctagcaagcctagtgaagacacaggtttagccactccagccagatacagagagcacagaagcaactcacaacaaggaaagtcccctgatcttcatctgctggtggacgtggcctgcaagcaggagcgctttccaaaggaggaagaattaaaagagtgaggaatggatgacaaatgtgacattgtgcactagctgtagctggaggcagactagccttgcacatgacaaactgttgggattttttcagttctgttaaggaaaaaaaagtattttttgtttcgttaattgagaattttgttaattgagaattgggaatttgtatgtactacagtggttcagttcagattatctgccttgacaaactactgaacatctagcagccacgttttttggctgcccagatcccttttaaatgaaaagttctgaccttctgttatagtcaaggagcatctaaaaactgctccatctatggtactaagaataatctgtgtgtgtgctgatttgttgtcttgccactcaaactgtagtcagcacaactttagtggggaattcagtctctctgattcaagtcacagtgtgatccttttagaggagattgtgtgagaaacaaaggcatgtgaggtcaccagcatcacaggtctaaatgcatcaggaattccagggaagaaactctggagaagagctaattttctaagtgattaaccaggaaattctcttacttcctaacccagcattctgttttaagagcaaggcatccggacttggaccatctatcacacttaacagcccctgattcttttatattaatggaagcattcttctattttcatatctttctttaattttaatgatacattatcataaatggtaaaaagattttattaatatatcacttatttaaatgtctttaaagaaagtatttaacttgtttaatataattgtatttataaatgctgatagatttaaaggttttaaagttttatatttttattattgcaggatagaaggataaaggatgcatgtgtagtatttttattttgaaaggaaaatgtacaatgtgtgaacaaaaacattaagagatttaatatactattttcttattttagatttttacattcaataagtataaattctcatctatataaggtattgtgtgcaaatttgggaaaaaactgattagcagccatttagtagaagctatgcctctgatttttaaagaatggtttcaatctggtttaagcttctgagagaattttggataatgggatagatggtaacatttttttcttatccctgttacaggattctagatttgtgcagtaggattgtgggactgtgttttaggagagaaggatgtcttggatgtccagtttctgtggttaatcccttacttgcttatccagtgacagcaagaaactttctgatttaaagtctttcaattgaccaaaactttcttattggattctgtttcagttctcctattaagcactgcagaaacgaaaggaaagcctaggaatatgaaactaattaaaaaggcacttggtgatatgacatagtactatgctagccgttgtggatgtaacagttcatttcttatactgcattgtgccttcccaatgatgtcaaaccctagaaatattacagagatctacttttctggaaaagggtgagctctgtattgatctgcagtgactctgtttagatattaaagtaggttctgaaaagcgacctgtgtggtccctctgattagactagttaatgtctatgtgatgggcatttatttatctttattagcaaggtttaaaagagcaaattatcaagacacctatatcttttggccagactatataatattttgtcagagtatgtgaagaggagacccaatttccaaatgaaggaactttgctttttctctgtcatgttgaagagctaatatactgtgtagattttcccctaaatatggctttcttagctttatagatgttgagataatatcttttgaggaacacatgtcaagcaggaaccttggcatagatttggtttcagttgttttaaggcttaattaatgaaatgccttaatcagctttccaaacatttttatatatgaatacagcagaccaaggagctggatctcctgctatccttacacgccttgtatctatcaactaaagctgtcattaatgacttgggcaaaatggcaagaggtataataaagtcttcctgtgaattagccagtagggtctgacacaactagtcaactaacaaggttcctgactagtacctcagtatttcagcaccttaagcactgataaatttcaatcagtcaacaataaagtgagtgttccaactag

SEQ ID NO: 852 - DNA, 3420 bp, Homo sapiens
catgaccatgcagttagccagggttttcccgagttgtttgggttgagttcaggagaagcatggccaggtcgagtccgtacctgcgccaacttcagggacctctgctcccacccagggatctggtggaggaggacgacgactacctaaacgacgacgtggaggaggatgaagagtccgtgttcatcgacgccgaggagctctgcagtgggggcgtaaaggctggcagcctccccgggtgcctccgcgtttctatttgtgatgaaaacacacaagagacatgtaaagtgtttggacgttttccgataacaggtgcttggtggagagtgaaggtacaagtaaagcctgtggtgggatcaaggagctatcaatatcaagttcaaggatttccgtcttactttttgcagtctgatatgtcaccaccaaatcaaaaacatatctgtgctctctttcttaaagagtgtgaggtctccagtgatgatgttaataaatttttaacatgggtaaaggaggtatcaaactacaaaaacctaaactttgaaaatcttagggaaacactaagaactttccacaaggaaactggaaggaaagatcaaaagcagcctacacagaatggtcaggaagagttgttcctagacaatgagatgagtcttcctctggaaaacacaattccatttagaaatgtaatgacagctttgcagtttccgaagataatggaattccttccagttcttctgcctcgacactttaaatggatcatagggtcaggttctaaagagatgttgaaagagatagaagagattttaggtacacatccgtggaaacttggatttagtaaaataacctacagagagtggaaactcctgcgatgtgaggcaagttggatagcattttgtcagtgtgagtctcttctccagctgatgactgatttggagaagaatgcattaataatgtattccagactgaagcagatatgtagagaagatgggcacacatatgttgaagtgaatgacttaactttgacattgtcaaatcatatgtcatttcatgctgcttcagagtctctgaagtttttgaaggatattggtgtggtgacatatgagaagtcctgtgtcttcccttatgacctttaccatgctgaaagagccatcgccttttcaatttgtgacctgatgaagaaacctccttggcatttatgtgtcgatgtcgaaaaggtgcttgcctctattcacaccacaaaacctgagaattcaagcgatgatgcattgaatgagagcaaacctgatgaagtaagattagaaaatcctgtggatgttgtggacacacaggacaatggtgaccatatttggactaatggtgaaaatgaaattaatgcagaaataagtgaagttcagctggatcaggatcaggttgaagttccactggatcgggatcaggtggctgctttggaaatgatttgctccaatcctgtgacagtcataagtgggaaaggtggatgtgggaagaccacaatcgttagccgtctttttaagcatatagagcagttggaagaaagagaagtaaaaaaagcctgtgaagattttgaacaagaccagaatgcttcagaagaatggattacctttactgagcaaagtcaactagaggcggacaaggctatagaagttttgctcacagcacctacagggaaagcagctggcttactaagacagaaaactggtcttcatgcctacacactgtgtcaggtcaattatagcttctattcatggactcaaacaatgatgaccacaaacaaaccatggaaattttcttcggttagagttctggttgtggatgaagggagtttggtatctgtaggaatcttcaaatcggtcttaaatttattgtgtgagcactccaaactttctaagcttattatccttggtgacattagacagttacccagtattgaacctggtaacttgctgaaagatctttttgagactcttaagtcaagaaattgtgctattgagctaaagacaaaccatagagcagaatctcagctcattgtggacaatgctacaagaatctcaagacgccaatttccaaaatttgatgcagaactaaatatctctgataatccaacattacccatctcaattcaagataagacatttatttttgtcaggctcccagaagaggatgccagttctcagtcatctaaaactaatcatcactcttgtttatattctgcagttaaaactttactacaagaaaataacttacaaaatgcaaaaacatcacaatttattgcatttagaaggcaagactgtgatctaattaatgactgctgctgcaaacactacacaggccacctcaccaaagaccatcagagtagacttgtttttggaattggtgataaaatttgttgtaccaggaatgcatacctctcagacttactacctgaaaatatctctggaagtcagcaaaataatgatctagatgccagtagtgaagacttttctggtacgcttcctgattttgctaaaaataagcgtgactttgaaagtaacgttcgactgtgcaatggagagatatttttcataacaaatgatgtaactgatgtaacttttggaaagagaagatctttgaccattaataatatggctggcctggaagtaactgtggattttaagaaactaatgaaatattgtcgcataaaacatgcatgggcaagaactattcacacttttcaggggtccgaggagcaaacagttgtctatgtggtggggaaggcgggccgccagcactggcagcatgtctacaccgccgtgaccaggggccgctgccgagtgtatgtgattgcagaggagtctcagctccggaatgccattatgaaaaacagttttcctagaaaaactcgtttgaaacatttcttgcaaagtaagctctcctctagcggcgcacctccagcagattttccgtccccacggaagagctctggagacagtggaggacccagcacaccgtcagcatctccactccctgtagtcacagaccacgccatgacaaatgatgtcacctggagcgaggcctcttcgcctgatgagaggacactcacctttgctgaaagatggcaattatcttcacctgatggagtagatacagatgatgatttaccaaaatcgcgagcatccaaaagaacctgtggtgtgaatgatgatgaaagtccaagcaaaatttttatggtgggagaatctccacaagtgtcttccagacttcagaatttgagactgaataatttaattcccaggcaacttttcaagcccaccgataatcaagaaacttagttttatttcaaattgttccgagtaactatgtttttctattggagacaaaatgaacatcgtaacgtcaaagtaccaagataaaaaaagtttcctataa

SEQ ID NO: 853 - DNA, 3586 bp, Homo sapiens
gtttgggttgagttcaggagaagcatggccaggtcgagtccgtacctgcgccaacttcagggacctctgctcccacccagggatctggtggaggaggacgacgactacctaaacgacgacgtggaggaggatgaagagtccgtgttcatcgacgccgaggagctctgcagtgggggcgtaaaggctggcagcctccccgggtgcctccgcgtttctatttgtgatgaaaacacacaagagacatgtaaagtgtttggacgttttccgataacaggtgcttggtggagagtgaaggtacaagtaaagcctgtggtgggatcaaggagctatcaatatcaagttcaaggatttccgtcttactttttgcagtctgatatgtcaccaccaaatcaaaaacatatctgtgctctctttcttaaagagtgtgaggtctccagtgatgatgttaataaatttttaacatgggtaaaggaggtatcaaactacaaaaacctaaactttgaaaatcttagggaaacactaagaactttccacaaggaaactggaaggaaagatcaaaagcagcctacacagaatggtcaggaagagttgttcctagacaatgagatgagtcttcctctggaaaacacaattccatttagaaatgtaatgacagctttgcagtttccgaagataatggaattccttccagttcttctgcctcgacactttaaatggatcatagggtcaggttctaaagagatgttgaaagagatagaagagattttaggtacacatccgtggaaacttggatttagtaaaataacctacagagagtggaaactcctgcgatgtgaggcaagttggatagcattttgtcagtgtgagtctcttctccagctgatgactgatttggagaagaatgcattaataatgtattccagactgaagcagatatgtagagaagatgggcacacatatgttgaagtgaatgacttaactttgacattgtcaaatcatatgtcatttcatgctgcttcagagtctctgaagtttttgaaggatattggtgtggtgacatatgagaagtcctgtgtcttcccttatgacctttaccatgctgaaagagccatcgccttttcaatttgtgacctgatgaagaaacctccttggcatttatgtgtcgatgtcgaaaaggtgcttgcctctattcacaccacaaaacctgagaattcaagcgatgatgcattgaatgagagcaaacctgatgaagtaagattagaaaatcctgtggatgttgtggacacacaggacaatggtgaccatatttggactaatggtgaaaatgaaattaatgcagaaataagtgaagttcagctggatcaggatcaggttgaagttccactggatcgggatcaggtggctgctttggaaatgatttgctccaatcctgtgacagtcataagtgggaaaggtggatgtgggaagaccacaatcgttagccgtctttttaagcatatagagcagttggaagaaagagaagtaaaaaaagcctgtgaagattttgaacaagaccagaatgcttcagaagaatggattacctttactgagcaaagtcaactagaggcggacaaggctatagaagttttgctcacagcacctacagggaaagcagctggcttactaagacagaaaactggtcttcatgcctacacactgtgtcaggtcaattatagcttctattcatggactcaaacaatgatgaccacaaacaaaccatggaaattttcttcggttagagttctggttgtggatgaagggagtttggtatctgtaggaatcttcaaatcggtcttaaatttattgtgtgagcactccaaactttctaagcttattatccttggtgacattagacagttacccagtattgaacctggtaacttgctgaaagatctttttgagactcttaagtcaagaaattgtgctattgagctaaagacaaaccatagagcagaatctcagctcattgtggacaatgctacaagaatctcaagacgccaatttccaaaatttgatgcagaactaaatatctctgataatccaacattacccatctcaattcaagataagacatttatttttgtcaggctcccagaagaggatgccagttctcagtcatctaaaactaatcatcactcttgtttatattctgcagttaaaactttactacaagaaaataacttacaaaatgcaaaaacatcacaatttattgcatttagaaggcaagactgtgatctaattaatgactgctgctgcaaacactacacaggccacctcaccaaagaccatcagagtagacttgtttttggaattggtgataaaatttgttgtaccaggaatgcatacctctcagacttactacctgaaaatatctctggaagtcagcaaaataatgatctagatgccagtagtgaagacttttctggtacgcttcctgattttgctaaaaataagcgtgactttgaaagtaacgttcgactgtgcaatggagagatatttttcataacaaatgatgtaactgatgtaacttttggaaagagaagatctttgaccattaataatatggctggcctggaagtaactgtggattttaagaaactaatgaaatattgtcgcataaaacatgcatgggcaagaactattcacacttttcaggggtccgaggagcaaacagttgtctatgtggtggggaaggcgggccgccagcactggcagcatgtctacaccgccgtgaccaggggccgctgccgagtgtatgtgattgcagaggagtctcagctccggaatgccattatgaaaaacagttttcctagaaaaactcgtttgaaacatttcttgcaaagtaagctctcctctagcggcgcacctccagcagattttccgtccccacggaagagctctggagacagtggaggacccagcacaccgtcagcatctccactccctgtagtcacagaccacgccatgacaaatgatgtcacctggagcgaggcctcttcgcctgatgagaggacactcacctttgctgaaagatggcaattatcttcacctgatggagtagatacagatgatgatttaccaaaatcgcgagcatccaaaagaacctgtggtgtgaatgatgatgaaagtccaagcaaaatttttatggtgggagaatctccacaagtgtcttccagacttcagaatttgagactgaataatttaattcccaggcaacttttcaagcccaccgataatcaagaaacttagttttatttcaaattgttccgagtaactatgtttttctattggagacaaaatgaacatcgtaacgtcaaagtaccaagataaaaaaagtttcctataactggagttttaagagataggggttcaccatggtgcccaggctggtctcgaactcctggactcaggcagtctgcccacctcgacctcccaaagtgctgggattacaggtgtgagccatcatgcttggttcttctttaattctttgtagttttcagagtataagttttgtatttcttttattaaatttacaatgctctttgtt

SEQ ID NO: 854 - DNA, 5317 bp, Homo sapiens
ttgttgcagaaggagacggcgtcgacgtctgactggactcgcggcgacttacctttcagtcgtgcgctcctgatccggcgctcggaatttgtccccggcttcagggctgcggggcctggaaggaggcgtatcgaggcggctcgaaaacgatccaggggagccgaggcgctcctcttgtcatcccactcagcgccatgtcctggatgttcaagagggatccagtttggaagtacttgcagactgtccagtatggagttcatggaaattttccacgcctctcatatccaactttctttccacgttttgaattccaagatgttatccctccagatgactttctaactagtgatgaagaagtagattccgttttatttggaagtttgagaggtcatgtggttggactacgctattacacgggagtagttaataataatgaaatggttgcattacaacgagatcctaataacccttatgataagaatgcaattaaagtaaacaatgtgaatggaaatcaagttggccatttaaagaaagagcttgcaggtgctttggcctatatcatggacaacaaattggcacaaattgaaggggtagttccttttggtgcaaacaatgcttttaccatgcctctgcatatgactttttggggaaaagaagaaaatagaaaagcggtttcagatcagttgaagaaacatggatttaaattgggtcctgcaccaaaaactttaggattcaatttggaaagtggttggggctctggaagagctggaccaagctatagtatgccagtgcatgctgcagtacagatgacaactgaacagcttaaaacagaatttgacaaattgtttgaagatttaaaagaagatgataaaacccatgaaatggaaccagctgaggctattgaaacaccactgcttccacatcaaaaacaagctctagcttggatggtgtcacgggaaaatagcaaagaacttccaccattctgggaacagcgaaatgacttatactataacacaataacaaatttttctgagaaggaccgaccagaaaatgtccatggaggaattttagctgatgatatgggtttgggtaaaactcttacggccattgcagtaatccttaccaacttccatgatggcagacctcttcctattgaaagagttaaaaagaatctactgaagaaggaatataatgttaacgatgactctatgaaacttggaggaaacaataccagtgaaaaggcagatggactaagcaaagacgcatctagatgtagtgaacaacccagtatttcagatatcaaggagaagagtaagtttcgcatgtcagaattgtctagctcccgccccaaaagaagaaaaactgctgtccagtacatagaaagcagtgattcagaggaaattgaaacaagtgaattgccgcagaaaatgaaaggcaaactgaaaaatgtacagtctgaaactaaaggcagggcgaaagcaggatcttctaaggttatagaagatgtggcatttgcatgtgcattaacttcatctgttcctacaacaaaaaagaaaatgttgaaaaagggagcttgtgcagtggaggggtcaaagaaaactgatgttgaggagagaccaagaacaacactgatcatctgtccgctttctgtgttaagcaactggattgaccagtttggacaacatataaaatcagatgtacacttgaatttttatgtttattatggtcctgatcgtattagagaaccggccttactttcaaaacaggatattgttttgactacgtataatattttaactcatgactatggaactaaaggagatagtccattacatagcataaggtggctaagagtgatcctggatgaaggacatgccatacgaaatccaaatgctcagcagacaaaagctgtacttgacttagaatcagaaagaagatgggttttgacaggtactccaatccagaattctttaaaggacttgtggtctcttctttcctttttaaaacttaaaccatttattgatagagaatggtggcatagaacaatacagcgtcctgtcacaatgggagatgaaggaggacttaggcgtttacagtccctaattaaaaatattacacttagaagaacaaagacaagcaaaattaaaggaaaacctgttttggagttaccagaacgtaaagtatttattcagcacattacactttcagatgaagagagaaagatttatcagtctgtgaaaaatgaaggcagagccactattggaaggtattttaatgaagggactgtcctggcacattatgcagatgtcctgggtcttttgcttagactgcggcaaatttgttgccatacttaccttcttacaaatgcagtgtcttccaatggcccctcaggaaatgatacacctgaagaactgagaaagaagttaataaggaagatgaagttaattctgagctcaggttcagatgaggaatgtgcaatttgcctggattctttaacagttcctgtgataacacattgtgcacatgtattttgtaaaccctgtatttgccaagtcattcagaatgagcagccacatgctaaatgccctttatgcagaaatgatatacatgaagataatttattagaatgtcctccagaagaattagcacgtgacagtgagaaaaagtctgatatggaatggacatccagttcaaagattaatgcgctaatgcacgcattgactgacttaagaaagaagaatcccaacataaaaagtttggttgtttctcagtttacaacattcctgtctttaatagaaataccacttaaagcctctggatttgtgtttactcgtttggatggttccatggcccaaaagaaaagagttgaatcaattcagtgttttcaaaacactgaagcaggatctccaactataatgcttctgtccttaaaagcaggtggagttggtttgaatctgtctgcagcttctcgagtgtttttaatggatccagcctggaatcctgctgctgaagatcagtgctttgacagatgccatagacttggtcagaagcaagaagttatcatcacaaaattcattgtaaaggactctgttgaagaaaatatgctgaaaatacaaaacaaaaagagagaacttgcagcaggagcctttggaactaaaaaaccaaatgctgacgaaatgaaacaagccaaaattaatgaaatcagaacattaattgacttataatttgtgggattttagtaaggtcagtttgattggatacttaagttttagaaatgagaaaaatacagagttttagaaatgagatctagagaacacgtcttctaaaaggggcatattttatattagtgaagaggtattactgacacaatttcttctatatatgaacctatttttaatgaaacttcaaatagcaataagttccgttatatactgtggcctgaaataatttgagaaaaaaggttactttgttattcagcttttcataatatctatgctgagtattttcacgtatcttccaagtactcagctttttcgtatttcaaataaggtcagaccttttatacttttgaccaaatagttattttctatgttggacacttagttatttaccaaagcctccgatttgtgatgcagtgtttgtagtccttgtaaacaatatatacagactatacaagaattaattttattgggctttcaaaaaccatatttgcattccagaaccaaatcttaaatgagaccaaagtccaggttagcacaggtttttatttttcctacagctacattgagatatagttcacataaatgacttggagttttatgttcatgaaaaaattagggattatgttaagagtactattttttccattttagttaagtagtactacactcattgtttaaatgtaacttgctgtgtctgaggtataaatatagtctgtgggagtgagaggcaaaccagtcctacccaatttgatttgaatattttaaattatggaactgctaaatagatatttctataaatagataatttttatttatgtagctttttttggaagtaactttataaatttttataattcagaagactactatatgtgagaggcgtgatatctggatggaagttgggctggatgatctccaaagtcgtttcaactcttaaagacatcttaatcctgaatgtaaacaattgttatgtgtttagaatcagaatttgattttgaacttgagtaattcatccttacagctatctgtagaattagtcatcttttttcttttcttttttttttacttttttgttaataagcaaacttatttgctgcagaatttgggttgactcctgagcatatttaaaacaaagaagctagaaatttagcagtcagattaggtaggtggttttatttcaaagggaaactttaatccaaagaaagattaattactctaacaaacaagagaagcttcatgtttgatgatacagatttaagaatacctgagacttaagagtgttggaagtcatttgatagaaagatgagatcggagacaatgttgtgttatagggcacacattgaaggtatatgccaaatctctcaccagataagtccttttctccctgtgccgttttcttgctcaaagggaacagtgaattagccagctagaatcttcctggtccctttttgaggcagtagcaggtaaggaaagggctgattttcatcaaaaccaagacctttctgcagggatgatagtggaataataatgtgggattagcccgctagcattaggagcagttgggaagttacctggtagatcaagcattacacacaaaaaatcaagttgatcagagtatgggttctccatatagcaatacttcagtgagattaagtataaacagtttttggcaaaaaacaacacagtctactctttctgcttacaaagacaaagccttacaaactcactatgaaggtaaagggaggacagcttgcttctttgcccagacatttacaaagttgtttttaaaacacactcataagtaagtttggcaagttgtttaaaaaatgtctctttgttttgtacagttctgttagatgttgttatattttaaaagtttaatttaaaaaatttaatttgtccttcctaagaaggataaatatataaaaaagccactggaatgaaaacttcctatatgctatgctgttgtcttattattatatagaaaaataactttagaaaaatattgaagacattgtattaccacttgtgattcaaacaattttgtggttaaaactggattttaaatttaaaaatcaataaaaatttcaaatgtt

SEQ ID NO: 855 - DNA, 3896 bp, Homo sapiens
gtctgactggactcgcggcgacttacctttcagtcgtgcgctcctgatccggcgctcggaatttgtccccggcttcagggctgcggggcctggaaggaggcgtatcgaggcggctcgaaaacgatccaggggagccgaggcgctcctcttgtcatcccactcagcgccatgtcctggatgttcaagagggatccagtttggaagtacttgcagactgtccagtatggagttcatggaaattttccacgcctctcatatccaactttctttccacgttttgaattccaagatgttatccctccagatgactttctaactagtgatgaagaagtagattccgttttatttggaagtttgagaggtcatgtggttggactacgctattacacgggagtagttaataataatgaaatggttgcattacaacgagatcctaataacccttatgataagaatgcaattaaagtaaacaatgtgaatggaaatcaagttggccatttaaagaaagagcttgcaggtgctttggcctatatcatggacaacaaattggcacaaattgaaggggtagttccttttggtgcaaacaatgcttttaccatgcctctgcatatgactttttggggaaaagaagaaaatagaaaagcggtttcagatcagttgaagaaacatggatttaaattgggtcctgcaccaaaaactttaggattcaatttggaaagtggttggggctctggaagagctggaccaagctatagtatgccagtgcatgctgcagtacagatgacaactgaacagcttaaaacagaatttgacaaattgtttgaagatttaaaagaagatgataaaacccatgaaatggaaccagctgaggctattgaaacaccactgcttccacatcaaaaacaagctctagcttggatggtgtcacgggaaaatagcaaagaacttccaccattctgggaacagcgaaatgacttatactataacacaataacaaatttttctgagaaggaccgaccagaaaatgtccatggaggaattttagctgatgatatgggtttgggtaaaactcttacggccattgcagtaatccttaccaacttccatgatggcagacctcttcctattgaaagagttaaaaagaatctactgaagaaggaatataatgttaacgatgactctatgaaacttggaggaaacaataccagtgaaaaggcagatggactaagcaaagacgcatctagatgtagtgaacaacccagtatttcagatatcaaggagaagagtaagtttcgcatgtcagaattgtctagctcccgccccaaaagaagaaaaactgctgtccagtacatagaaagcagtgattcagaggaaattgaaacaagtgaattgccgcagaaaatgaaaggcaaactgaaaaatgtacagtctgaaactaaaggcagggcgaaagcaggatcttctaaggttatagaagatgtggcatttgcatgtgcattaacttcatctgttcctacaacaaaaaagaaaatgttgaaaaagggagcttgtgcagtggaggggtcaaagaaaactgatgttgaggagagaccaagaacaacactgatcatctgtccgctttctgtgttaagcaactggattgaccagtttggacaacatataaaatcagatgtacacttgaatttttatgtttattatggtcctgatcgtattagagaaccggccttactttcaaaacaggatattgttttgactacgtataatattttaactcatgactatggaactaaaggagatagtccattacatagcataaggtggctaagagtgatcctggatgaaggacatgccatacgaaatccaaatgctcagcagacaaaagctgtacttgacttagaatcagaaagaagatgggttttgacaggtactccaatccagaattctttaaaggacttgtggtctcttctttcctttttaaaacttaaaccatttattgatagagaatggtggcatagaacaatacagcgtcctgtcacaatgggagatgaaggaggacttaggcgtttacagtccctaattaaaaatattacacttagaagaacaaagacaagcaaaattaaaggaaaacctgttttggagttaccagaacgtaaagtatttattcagcacattacactttcagatgaagagagaaagatttatcagtctgtgaaaaatgaaggcagagccactattggaaggtattttaatgaagggactgtcctggcacattatgcagatgtcctgggtcttttgcttagactgcggcaaatttgttgccatacttaccttcttacaaatgcagtgtcttccaatggcccctcaggaaatgatacacctgaagaactgagaaagaagttaataaggaagatgaagttaattctgagctcaggttcagatgaggaatgtgcaatttgcctggattctttaacagttcctgtgataacacattgtgcacatgtattttgtaaaccctgtatttgccaagtcattcagaatgagcagccacatgctaaatgccctttatgcagaaatgatatacatgaagataatttattagaatgtcctccagaagaattagcacgtgacagtgagaaaaagtctgatatggaatggacatccagttcaaagattaatgcgctaatgcacgcattgactgacttaagaaagaagaatcccaacataaaaagtttggttgtttctcagtttacaacattcctgtctttaatagaaataccacttaaagcctctggatttgtgtttactcgtttggatggttccatggcccaaaagaaaagagttgaatcaattcagtgttttcaaaacactgaagcaggatctccaactataatgcttctgtccttaaaagcaggtggagttggtttgaatctgtctgcagcttctcgagtgtttttaatggatccagcctggaatcctgctgctgaagatcagtgctttgacagatgccatagacttggtcagaagcaagaagttatcatcacaaaattcattgtaaaggactctgttgaagaaaatatgctgaaaatacaaaacaaaaagagagaacttgcagcaggagcctttggaactaaaaaaccaaatgctgacgaaatgaaacaagccaaaattaatgaaatcagaacattaattgacttataatttgtgggattttagtaagaagactactatatgtgagaggcgtgatatctggatggaagttgggctggatgatctccaaagtcgtttcaactcttaaagacatcttaatcctgaatgtaaacaattgttatgtgtttagaatcagaatttgattttgaacttgagtaattcatccttacagctatctgtagaattagtcatcttttttcttttcttttttttttacttttttgttaataagcaaacttatttgctgcagaatttgggttgactcctgagcatatttaaaacaaagaagctagaaatttagcagtcagattaggtaggtggttttatttcaaagggaaactttaatccaaagaaagattaattactctaacaaacaagagaagcttcatgtttgatgatacagatttaagaatacctgagacttaagagtgttggaagtcatttgatagaaagatgagatcggagacaatgttgtgttatagggcacacattgaaggtatatgccaaatctctcaccagataagtccttttctccctgtgccgttttcttgctcaaagggaacagtgaattagccagctagaatcttcctggtccctttttgaggcagtagcaggtaaggaaagggctgattttcatcaaaaccaagacctttctgcagggatgatagtggaataataatgtgggatta

SEQ ID NO: 856 - DNA, 1403 bp, Homo sapiens
acagagcgacgctggtctcccagattgttgcagaaggagacggcgtcgacgtctgactggactcgcggcgacttacctttcagtcgtgcgctcctgatccggcgctcggaatttgtccccggcttcagggctgcggggcctggaaggaggcgtatcgaggcggctcgaaaacgatccaggggagccgaggcgctcctcttgtcatcccactcagcgccatgtcctggatgttcaagagggatccagtttggaagtacttgcagactgtccagtatggagttcatggaaattttccacgcctctcatatccaactttctttccacgttttgaattccaagatgttatccctccagatgactttctaactagtgatgaagaagtagattccgttttatttggaagtttgagaggtcatgtggttggactacgctattacacgggagtagttaataataatgaaatggttgcattacaacgagatcctaataacccttatgataagaatgcaattaaagtaaacaatgtgaatggaaatcaagttggccatttaaagaaagagcttgcaggtgctttggcctatatcatggacaacaaattggcacaaattgaaggggtagttccttttggtgcaaacaatgcttttaccatgcctctgcatatgactttttggggaaaagaagaaaatagaaaagcggtttcagatcagttgaagaaacatggatttaaattgggtcctgcaccaaaaactttaggattcaatttggaaagtggttggggctctggaagagctggaccaagctatagtatgccagtgcatgctgcagtacagatgacaactgaacagcttaaaacagaatttgacaaattgtttgaagatttaaaagaagatgataaaacccatgaaatggaaccagctgaggctattgaaacaccactgcttccacatcaaaaacaagctctagcttggatggtgtcacgggaaaatagcaaagaacttccaccattctgggaacagcgaaatgacttatactataacacaataacaaatttttctgagaaggaccgaccagaaaatgtccatggaggaattttagctgatgatatgggtttgggtaaaactcttacggccattgcagtaatccttaccaacttccatgatggcagacctcttcctattgaaagagttaaaaagaatctactgaagaaggaatataatgttaacgatgactctatgaaacttggaggaaacaataccagtgaaaaggcagatggactaagcaaagacgcatctagatgtagtgaacaacccagtatttcagatatcaaggagaagagtaagtttcgcatgtcagaattgtctagctcccgccccaaaagtcaaaaaaaaaagaaaaagagagag

SEQ ID NO: 857 - DNA, 1598 bp, Homo sapiens
acagagcgacgctggtctcccagattgttgcagaaggagacggcgtcgacgtctgactggactcgcggcgacttacctttcagtcgtgcgctcctgatccggcgctcggaatttgtccccggcttcagggctgcggggcctggaaggaggcgtatcgaggcggctcgaaaacgatccaggggagccgaggcgctcctcttgtcatcccactcagcgccatgtcctggatgttcaagagggatccagtttggaagtacttgcagactgtccagtatggagttcatggaaattttccacgcctctcatatccaactttctttccacgttttgaattccaagatgttatccctccagatgactttctaactagtgatgaagaagtagattccgttttatttggaagtttgagaggtcatgtggttggactacgctattacacgggagtagttaataataatgaaatggttgcattacaacgagatcctaataacccttatgataagaatgcaattaaagtaaacaatgtgaatggaaatcaagttggccatttaaagaaagagcttgcaggtgctttggcctatatcatggacaacaaattggcacaaattgaaggggtagttccttttggtgcaaacaatgcttttaccatgcctctgcatatgactttttggggaaaagaagaaaatagaaaagcggtttcagatcagttgaagaaacatggatttaaattgggtcctgcaccaaaaactttaggattcaatttggaaagtggttggggctctggaagagctggaccaagctatagtatgccagtgcatgctgcagtacagatgacaactgaacagcttaaaacagaatttgacaaattgtttgaagatttaaaagaagatgataaaacccatgaaatggaaccagctgaggctattgaaacaccactgcttccacatcaaaaacaagctctagcttggatggtgtcacgggaaaatagcaaagaacttccaccattctgggaacagcgaaatgacttatactataacacaataacaaatttttctgagaaggaccgaccagaaaatgtccatggaggaattttagctgatgatatgggtttgggtaaaactcttacggccattgcagtaatccttaccaacttccatgatggcagacctcttcctattgaaagagttaaaaagaatctactgaagaaggaatataatgttaacgatgactctatgaaacttggaggaaacaataccagtgaaaaggcagatggactaagcaaagacgcatctagatgtagtgaacaacccagtatttcagatatcaaggagaagagtaagtttcgcatgtcagaattgtctagctcccgccccaaaagaagaaaaactgctgtccagtacatagaaagcagtgattcagaggaaattgaaacaagtgaattgccgcagaaaatgaaaggcaaactgaaaaatgtacagtctgaaactaaaggcagggcgaaagcaggatcttctaaggttatagaagatgtggcatttgcatgtgcattaacttcatctgttcctacaacaaaaaagaaaatgttgaaaaaggttaaa

SEQ ID NO: 858 - DNA, 3633 bp, Homo sapiens
acagagcgacgctggtctcccagattgttgcagaaggagacggcgtcgacgtctgactggactcgcggcgacttacctttcagtcgtgcgctcctgatccggcgctcggaatttgtccccggcttcagggctgcggggcctggaaggaggcgtatcgaggcggctcgaaaacgatccaggggagccgaggcgctcctcttgtcatcccactcagcgccatgtcctggatgttcaagagggatccagtttggaagtacttgcagactgtccagtatggagttcatggaaattttccacgcctctcatatccaactttctttccacgttttgaattccaagatgttatccctccagatgactttctaactagtgatgaagaagtagattccgttttatttggaagtttgagaggtcatgtggttggactacgctattacacgggagtagttaataataatgaaatggttgcattacaacgagatcctaataacccttatgataagaatgcaattaaagtaaacaatgtgaatggaaatcaagttggccatttaaagaaagagcttgcaggtgctttggcctatatcatggacaacaaattggcacaaattgaaggggtagttccttttggtgcaaacaatgcttttaccatgcctctgcatatgactttttggggaaaagaagaaaatagaaaagcggtttcagatcagttgaagaaacatggatttaaattgggtcctgcaccaaaaactttaggattcaatttggaaagtggttggggctctggaagagctggaccaagctatagtatgccagtgcatgctgcagtacagatgacaactgaacagcttaaaacagaatttgacaaattgtttgaagatttaaaagaagatgataaaacccatgaaatggaaccagctgaggctattgaaacaccactgcttccacatcaaaaacaagctctagcttggatggtgtcacgggaaaatagcaaagaacttccaccattctgggaacagcgaaatgacttatactataacacaataacaaatttttctgagaaggaccgaccagaaaatgtccatggaggaattttagctgatgatatgggtttgggtaaaactcttacggccattgcagtaatccttaccaacttccatgatggcagacctcttcctattgaaagagttaaaaagaatctactgaagaaggaatataatgttaacgatgactctatgaaacttggaggaaacaataccagtgaaaaggcagatggactaagcaaagacgcatctagatgtagtgaacaacccagtatttcagatatcaaggagaagagtaagtttcgcatgtcagaattgtctagctcccgccccaaaagaagaaaaactgctgtccagtacatagaaagcagtgattcagaggaaattgaaacaagtgaattgccgcagaaaatgaaaggcaaactgaaaaatgtacagtctgaaactaaaggcagggcgaaagcaggatcttctaaggttatagaagatgtggcatttgcatgtgcattaacttcatctgttcctacaacaaaaaagaaaatgttgaaaaagggagcttgtgcagtggaggggtcaaagaaaactgatgttgaggagagaccaagaacaacactgatcatctgtccgctttctgtgttaagcaactggattgaccagtttggacaacatataaaatcagatgtacacttgaatttttatgtttattatggtcctgatcgtattagagaaccggccttactttcaaaacaggatattgttttgactacgtataatattttaactcatgactatggaactaaaggagatagtccattacatagcataaggtggctaagagtgatcctggatgaaggacatgccatacgaaatccaaatgctcagcagacaaaagctgtacttgacttagaatcagaaagaagatgggttttgacaggtactccaatccagaattctttaaaggacttgtggtctcttctttcctttttaaaacttaaaccatttattgatagagaatggtggcatagaacaatacagcgtcctgtcacaatgggagatgaaggaggacttaggcgtttacagtccctaattaaaaatattacacttagaagaacaaagacaagcaaaattaaaggaaaacctgttttggagttaccagaacgtaaagtatttattcagcacattacactttcagatgaagagagaaagatttatcagtctgtgaaaaatgaaggcagagccactattggaaggtattttaatgaagggactgtcctggcacattatgcagatgtcctgggtcttttgcttagactgcggcaaatttgttgccatacttaccttcttacaaatgcagtgtcttccaatggcccctcaggaaatgatacacctgaagaactgagaaagaagttaataaggaagatgaagttaattctgagctcaggttcagatgaggaatgtgcaatttgcctggattctttaacagttcctgtgataacacattgtgcacatgtattttgtaaaccctgtatttgccaagtcattcagaatgagcagccacatgctaaatgccctttatgcagaaatgatatacatgaagataatttattagaatgtcctccagaagaattagcacgtgacagtgagaaaaagtctgatatggaatggacatccagttcaaagattaatgcgctaatgcacgcattgactgacttaagaaagaagaatcccaacataaaaagtttggttgtttctcagtttacaacattcctgtctttaatagaaataccacttaaagcctctggatttgtgtttactcgtttggatggttccatggcccaaaagaaaagagttgaatcaattcagtgttttcaaaacactgaagcaggatctccaactataatgcttctgtccttaaaagcaggtggagttggtttgaatctgtctgcagcttctcgagtgtttttaatggatccagcctggaatcctgctgctgaagatcagtgctttgacagatgccatagacttggtcagaagcaagaagttatcatcacaaaattcattgtaaaggactctgttgaagaaaatatgctgaaaatacaaaacaaaaagagagaacttgcagcaggagcctttggaactaaaaaaccaaatgctgacgaaatgaaacaagccaaaattaatgaaatcagaacattaattgacttataatttgtgggattttagtaagactactatatgtgagaggcgtgatatctggatggaagttgggctggatgatctccaaagtcgtttcaactcttaaagacatcttaatcctgaatgtaaacaattgttatgtgtttagaatcagaatttgattttgaacttgagtaattcatccttacagctatctgtagaattagtcatcttttttcttttcttttttttttacttttttgttaataagcaaacttatttgctgcagaatttgggttgactcctgagcatatttaaaacaaagaagctagaaatttagcagtcagattaggtaggtggttttatttcaaagggaaactttaatccaaagaaagattaattactctaacaaacaaga

SEQ ID NO: 859 - DNA, 984 bp, Homo sapiens
atgtcagacaagctcaaggaacgcaaagtgagtcggctgagcccaaatggcacttgcgccctggtggtggaggcatctgactcaccgacccgccacttgggtggaccgatggcagggaagtgcccgcacgggactttgagtgtggaggaatctcgagtgagaacccccgtttctcataaagtgatagaaaagcggaggagggacaggatcaaccgctgcttgaacgagctgggcaagacagtgcccatggccttggcgaagcagggcgaacctcaggaggctctggcgcagatccgcagccgcgtccgctcgctggtcctctccagcgccacagtgcccgaccagcaggcgctgggccgctgcgaggggcccttcctccttttgcagagttccgggaagctggagaaggcggagatcctcgagatgaccgttcagtacctgagagcactgcactccgctgattttccccggggaagggaaaaagcagaacttctagcggagtttgccaactacttccactatggctaccacgagtgcatgaagaacctggtgcattacctcaccacggtggagcggatggagaccaaggacacgaagtacgcgcgcatcctcgccttcttgcagtccaaggcccgcctgggcgcggagcccgcctttccgccgctgggttcgctcccggagccggatttctcctatcagctgcaccctgcggggcccgaattcgctggtcacagcccgggcgaggccgctgtgttcccgcagggctctggtgccgggcctttcccctggccgcctggcgcggcccgcagccccgcgctgccctacctgcccagcgcgccagtgccgctcgctagcccagcgcagcagcacagccccttcctgacaccggtgcagggcctggaccggcattacctcaacctgatcggccacgcgcaccccaacgcccttaacctgcacacgccccagcaccccccggtgctctga

SEQ ID NO: 860 - DNA, 846 bp, Homo sapiens
acctgggacactcgaggaggcacacgaggcggaaaagtggacgggtgccccgcgccaccgcctctcccgagggcgcgtactgaccaggatgtcagacaagctcaaggaacgcaaaagaacccccgtttctcataaagtgatagaaaagcggaggagggacaggatcaaccgctgcttgaacgagctgggcaagacagtgcccatggccttggcgaagcagagttccgggaagctggagaaggcggagatcctcgagatgaccgttcagtacctgagagcactgcactccgctgattttccccggggaagggaaaaagaacttctagcggagtttgccaactacttccactatggctaccacgagtgcatgaagaacctggtgcattacctcaccacggtggagcggatggagaccaaggacacgaagtacgcgcgcatcctcgccttcttgcagtccaaggcccgcctgggcgcggagcccgcctttccgccgctgggttcgctcccggagccggatttctcctatcagctgcaccctgcggggcccgaattcgctggtcacagcccgggcgaggccgctgtgttcccgcagggctctggtgccgggcctttcccctggccgcctggcgcggcccgcagccccgcgctgccctacctgcccagcgcgccagtgccgctcgctagcccagcgcagcagcacagccccttcctgacaccggtgcagggcctggaccggcattacctcaacctgatcggccacgcgcaccccaacgcccttaacctgcacacgccccagcaccccccggtgctctgacgcccactcgcccgccagatttctcctcgctt

SEQ ID NO: 861 - DNA, 841 bp, Homo sapiens
acctgggacactcgaggaggcacacgaggcggaaaagtggacgggtgccccgcgccaccgcctctcccgagggcgcgtactgaccaggatgtcagacaagctcaaggaacgcaaaagaacccccgtttctcataaagtgatagaaaagcggaggagggacaggatcaaccgctgcttgaacgagctgggcaagacagtgcccatggccttggcgaagcagagttccgggaagctggagaaggcggagatcctcgagatgaccgttcagtacctgagagcactgcactccgctgattttccccggggaagggaaaaagcagaacttctagcggagtttgccaactacttccactatggctaccacgagtgcatgaagaacctggtgcattacctcaccacggtggagcggatggagaccaaggacacgaagtacgcgcgcatcctcgccttcttgcagtccaaggcccgcctgggcgcggagcccgcctttccgccgctgggttcgctcccggagccggatttctcctatcagctgcaccctgcggggcccgaattcgctggtcacagcccgggcgaggccgctgtgttcccgcagggctctggtgccgggcctttcccctggccgcctggcgcggcccgcagccccgcgctgccctacctgcccagcgcgccagtgccgctcgctagcccagcgcagcagcacagccccttcctgacaccggtgcagggcctggaccggcattacctcaacctgatcggccacgcgcaccccaacgcccttaacctgcacacgccccagcaccccccggtgctctgacgcccactcgcccgccagatttct

SEQ ID NO: 862 - DNA, 2315 bp, Homo sapiens
cccggcttcgcctcccgctgccgccgccgccgccgccgcagccgctaccgccgctgcagccgctttccgcggcctgggcctctcgccgtcagcatgccacacgccttcaagcccggggacttggtgttcgctaagatgaagggctaccctcactggcctgccaggatcgacgacatcgcggatggcgccgtgaagcccccacccaacaagtaccccatctttttctttggcacacacgaaacagccttcctgggacccaaggacctgttcccctacgacaaatgtaaagacaagtacgggaagcccaacaagaggaaaggcttcaatgaagggctgtgggagatccagaacaacccccacgccagctacagcgcccctccgccagtgagctcctccgacagcgaggcccccgaggccaaccccgccgacggcagtgacgctgacgaggacgatgaggaccggggggtcatggccgtcacagcggtaaccgccacagctgccagcgacaggatggagagcgactcagactcagacaagagtagcgacaacagtggcctgaagaggaagacgcctgcgctaaagatgtcggtctcgaaacgagcccgaaaggcctccagcgacctggatcaggccagcgtgtccccatccgaagaggagaactcggaaagctcatctgagtcggagaagaccagcgaccaggacttcacacctgagaagaaagcagcggtccgggcgccacggaggggccctctggggggacggaaaaaaaagaaggcgccatcagcctccgactccgactccaaggccgattcggacggggccaagcctgagccggtggccatggcgcggtcggcgtcctcctcctcctcttcctcctcctcctccgactccgatgtgtctgtgaagaagcctccgaggggcaggaagccagcggagaagcctctcccgaagccgcgagggcggaaaccgaagcctgaacggcctccgtccagctccagcagtgacagtgacagcgacgaggtggaccgcatcagtgagtggaagcggcgggacgaggcgcggaggcgcgagctggaggcccggcggcggcgagagcaggaggaggagctgcggcgcctgcgggagcaggagaaggaggagaaggagcggaggcgcgagcgggccgaccgcggggaggctgagcggggcagcggcggcagcagcggggacgagctcagggaggacgatgagcccgtcaagaagcggggacgcaagggccggggccggggtcccccgtcctcctctgactccgagcccgaggccgagctggagagagaggccaagaaatcagcgaagaagccgcagtcctcaagcacagagcccgccaggaaacctggccagaaggagaagagagtgcggcccgaggagaagcaacaagccaagcccgtgaaggtggagcggacccggaagcggtccgagggcttctcgatggacaggaaggtagagaagaagaaagagccctccgtggaggagaagctgcagaagctgcacagtgagatcaagtttgccctaaaggtcgacagcccggacgtgaagaggtgcctgaatgccctagaggagctgggaaccctgcaggtgacctctcagatcctccagaagaacacagacgtggtggccaccttgaagaagattcgccgttacaaagcgaacaaggacgtaatggagaaggcagcagaagtctatacccggctcaagtcgcgggtcctcggcccaaagatcgaggcggtgcagaaagtgaacaaggctgggatggagaaggagaaggccgaggagaagctggccggggaggagctggccggggaggagctggccggggaggaggccccccaggagaaggcggaggacaagcccagcaccgatctctcagccccagtgaatggcgaggccacatcacagaagggggagagcgcagaggacaaggagcacgaggagggtcgggactcggaggaggggccaaggtgtggctcctctgaagacctgcacgacagcgtacgggagggtcccgacctggacaggcctgggagcgaccggcaggagcgcgagagggcacggggggactcggaggccctggacgaggagagctgagccgcgggcagccaggcccagcccccgcccgagctcaggctgcccctctccttccccggctcgcaggagagcagagcagagaactgtggggaacgctgtgctgtttgtatttgttcccttgggtttttttttcctgcctaatttctgtgatttccaaccaacatgaaatgactataaatggttttttaatg

SEQ ID NO: 863 - DNA, 1659 bp, Homo sapiens
cccggcttcgcctcccgctgccgccgccgccgccgccgcagccgctaccgccgctgcagccgctttccgcggcctgggcctctcgccgtcagcatgccacacgccttcaagcccggggacttggtgttcgctaagatgaagggctaccctcactggcctgccaggatcgacgacatcgcggatggcgccgtgaagcccccacccaacaagtaccccatctttttctttggcacacacgaaacagccttcctgggacccaaggacctgttcccctacgacaaatgtaaagacaagtacgggaagcccaacaagaggaaaggcttcaatgaagggctgtgggagatccagaacaacccccacgccagctacagcgcccctccgccagtgagctcctccgacagcgaggcccccgaggccaaccccgccgacggcagtgacgctgacgaggacgatgaggaccggggggtcatggccgtcacagcggtaaccgccacagctgccagcgacaggatggagagcgactcagactcagacaagagtagcgacaacagtggcctgaagaggaagacgcctgcgctaaagatgtcggtctcgaaacgagcccgaaaggcctccagcgacctggatcaggccagcgtgtccccatccgaagaggagaactcggaaagctcatctgagtcggagaagaccagcgaccaggacttcacacctgagaagaaagcagcggtccgggcgccacggaggggccctctggggggacggaaaaaaaagaaggcgccatcagcctccgactccgactccaaggccgattcggacggggccaagcctgagccggtggccatggcgcggtcggcgtcctcctcctcctcttcctcctcctcctccgactccgatgtgtctgtgaagaagcctccgaggggcaggaagccagcggagaagcctctcccgaagccgcgagggcggaaaccgaagcctgaacggcctccgtccagctccagcagtgacagtgacagcgacgaggtggaccgcatcagtgagtggaagcggcgggacgaggcgcggaggcgcgagctggaggcccggcggcggcgagagcaggaggaggagctgcggcgcctgcgggagcaggagaaggaggagaaggagcggaggcgcgagcgggccgaccgcggggaggctgagcggggcagcggcggcagcagcggggacgagctcagggaggacgatgagcccgtcaagaagcggggacgcaagggccggggccggggtcccccgtcctcctctgactccgagcccgaggccgagctggagagagaggccaagaaatcagcgaagaagccgcagtcctcaagcacagagcccgccaggaaacctggccagaaggagaagagagtgcggcccgaggagaagcaacaagccaagctggagtgcaatggcgtgatctcagctcactgcaacctccgcctcccgggttcaagcgattctcctgcctcagccctcccgagtagctgggattacaggcacccgccaccacgcctggctaatttttgttgctttagtagacacggggtttcatcatgttggccaggctggtctcgatctcctgaccccgtgatctgcccgcctcagcctcccaaagtgctgggattacaagtgtga

SEQ ID NO: 864 - DNA, 3938 bp, Homo sapiens
gttctccgcccccgccgccgccattacggagctcccagtggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaatgggtggatggaacagatctctgggaaagggttcagtggcaccttccagctctgttttccctattatcccagcccaggagttctgtttccgaagaaagagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgccttttttttttcttccaattttatctaaacagttgcagagatttttatatttgtagaaagcatcaagaacggtatgccagtcaggtcctggaagtaaaatggaggcacaatatagcactgactgagttgtaaagcctcctgcctggagacttcagttatagctgtaataattaatcttatttataaaagccactccactaaccttttctctccaactgtaaacacagagacagctttgggaataagccaaaaacagggtgatctcattagattttgaagatatatgactcctttgggctacatttcatattgatcaatttctaggtatttttcactggcccaaagtattgcattcccttaacagcaagcacaagttctctatatcacttgttttttgttgttgttgttgttgtcgtcgttgttttgagacggagtcttgctcaggtgccccggagtgcagtggtgcaatctcagctcactgcaacctccacctcctgggttcaagcaattctcctgcttcagcctcccgagtagctgggattacaggtgtgtaccaccacgcctggcaatttttttgtatttttagtagagatggggtttcgccgtgttggtcaggctggtctcgaactcctgacctcaggtgatccgcctgcctcggcctcccaaagtgctgggattacaggagtgagccactgtgcctggcctatcccacttggtttttgactgaaggggaagtgtagaaatatattgatttgtgatttctggtgtcacctgtgttaccaaaaatcaaaacaaatcttttttattttttattattattattatttttgagacagagtctcgctctgtcgcccagtgtggagtgcagtggtgtgatcttggctcactgcaaactccgcctcccaggttcaagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaagctgctgaaccgtagcttata

SEQ ID NO: 865 - DNA, 928 bp, Homo sapiens
gcggagcgccgaggctcgcgttccgccgctgcttccgtcgccggggcgggcgccgcggtgtccctgccgagcgtgagccccgaactgtcaccgcgccgagccccagcctcatccgtcggtgtccgcggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggagagagctgatagtattcattccactcttttcataattggtcagaacagttagaaattgcttttaactatagtcatgcattgcttaacaatgggtatacattctgagagatacatctttaggcgatttcatcatcgtgccaacatcataaagtgtacttacacaaacctacgtggtacagcctactacatacctaggctttatgggatagtctgttgcttctaggctacaaacctgtacagcatgttactgtactaaatactgtaggcagttataacacaacggtaagtatttgtgtatttaaacatagaaaaggtacagtaaaaatataatataaaagataaaaaatggta

SEQ ID NO: 866 - DNA, 4822 bp, Homo sapiens
tttttttttttttttgagatggagtcttactctgtcacccaggttggagtgtggagtgcagtggcgcgatctgggctcactgcaacctccacctcccaggttcaagcgattctcctgcctcaacctgccaagtagctgggactacaggcgtgcacctccacacctagctaatttttgtattttcaggagagacgggggtttcaccatgttggccaggatggtctcaatcttttgaccttgtgatccgcccaccttggcctcccaaagtgctgggattacaggcatgagtcaccgcgcccagccaatatgctatatttttgtatgactggcagcactgtaggtttgtttacaccaatgtcaccacaaacaagtgagtaacgtgctgcgctgtgatattaccacagctatcatgttaaccaggtaataggaggttttcagttccattataatcttaagggaccaccattgtatatgtggtctgttgaccaaatattgttacacagcacatgaccataaaagaataacttagtaataactataccttctagctataatcttcagggtattctttatctgagtttcataagtatagctaaggtctgtggaatttatagcaactatcgtgtgtgggtgtgggtgtgtttgtgtgtgtgtgtgtgtgtttaatggagatggcgtctcactatgttggctaggttgggcttgaactcctggcctcaagctgtcctccctcctcagcctcctaaattgctgggattacaggcatgagccactgcacccagcctatcgtctgttgttaaatgttctaatgcacctattaggtgcacagagtactgttatatactcagaataaaatttacataatgctttaaatctcacaaaattgttttgataaacatactcttataattcttgcaacaccttgggaaatagttggttctatattactgttttatagctgaggagaaagactcacatcatttactaagatcatatagctagctagtaaatgtttgagtgaaaatacaaacaaaggttttctgactttaagagcttgagttttttccactataccatattgcatctgttgtaattgttaactaatgtgcattttaaaattctcatttgtcttatgtactgagcccttataccagtgctaatttatgtgactcctttctcctgcagctaagagaaaaatacctttttaattcatttatagtacccagtttttaaagaagatttattttgtaaaattttgcttatggtacatgtcatcttagcctgtaaataaattaaagcattaatttttatccctccctggtcttttcctccttctgactttatacgtctttctagagagcttatcttctataataacaattctttgttttaaagtgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaatgggtggatggaacagatctctgggaaagggttcagtggcaccttccagctctgttttccctattatcccagcccaggagttctgtttccgaagaaagagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgccttttttttttcttccaattttatctaaacagttgcagagatttttatatttgtagaaagcatcaagaacggtatgccagtcaggtcctggaagtaaaatggaggcacaatatagcactgactgagttgtaaagcctcctgcctggagacttcagttatagctgtaataattaatcttatttataaaagccactccactaaccttttctctccaactgtaaacacagagacagctttgggaataagccaaaaacagggtgatctcattagattttgaagatatatgactcctttgggctacatttcatattgatcaatttctaggtatttttcactggcccaaagtattgcattcccttaacagcaagcacaagttctctatatcacttgttttttgttgttgttgttgttgtcgtcgttgttttgagacggagtcttgctcaggtgccccggagtgcagtggtgcaatctcagctcactgcaacctccacctcctgggttcaagcaattctcctgcttcagcctcccgagtagctgggattacaggtgtgtaccaccacgcctggcaatttttttgtatttttagtagagatggggtttcgccgtgttggtcaggctggtctcgaactcctgacctcaggtgatccgcctgcctcggcctcccaaagtgctgggattacaggagtgagccactgtgcctggcctatcccacttggtttttgactgaaggggaagtgtagaaatatattgatttgtgatttctggtgtcacctgtgttaccaaaaatcaaaacaaatcttttttattttttattattattattatttttgagacagagtctcgctctgtcgcccagtgtggagtgcagtggtgtgatcttggctcactgcaaactccgcctcccaggttcaagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaa

SEQ ID NO: 867 - DNA, 4313 bp, Homo sapiens
cgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcggtaggtcgtcagaaagttacagtcgcccatctgagcgtttgtaagagatggaggcaggagtggtgaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaaaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaatgggtggatggaacagatctctgggaaagggttcagtggcaccttccagctctgttttccctattatcccagcccaggagttctgtttccgaagaaagagccagatgattctagagatgaggatgaagatgaagatgagtcatcagaagaagactctgaggatgaagagccgccacctaagagaaggttgcagaagaaaaccccagccaagtccccagggaaggccgcatctgtgaagcagagagggtccaaacctgcacctaaagtctcagctgcccagcgggggaaagctaggcccttgcctaagaaagcacctcctaaggccaaaacgcctgccaagaagaccagaccctcatccacagtcatcaagaaacctagtggtggctcctcaaagaagcctgcaaccagtgcaagaaaggaagtaaaattgccgggcaagggcaaatccaccatgaagaagtctttcagagtgaaaaagtaaattttataggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgccttttttttttcttccaattttatctaaacagttgcagagatttttatatttgtagaaagcatcaagaacggtatgccagtcaggtcctggaagtaaaatggaggcacaatatagcactgactgagttgtaaagcctcctgcctggagacttcagttatagctgtaataattaatcttatttataaaagccactccactaaccttttctctccaactgtaaacacagagacagctttgggaataagccaaaaacagggtgatctcattagattttgaagatatatgactcctttgggctacatttcatattgatcaatttctaggtatttttcactggcccaaagtattgcattcccttaacagcaagcacaagttctctatatcacttgttttttgttgttgttgttgttgtcgtcgttgttttgagacggagtcttgctcaggtgccccggagtgcagtggtgcaatctcagctcactgcaacctccacctcctgggttcaagcaattctcctgcttcagcctcccgagtagctgggattacaggtgtgtaccaccacgcctggcaatttttttgtatttttagtagagatggggtttcgccgtgttggtcaggctggtctcgaactcctgacctcaggtgatccgcctgcctcggcctcccaaagtgctgggattacaggagtgagccactgtgcctggcctatcccacttggtttttgactgaaggggaagtgtagaaatatattgatttgtgatttctggtgtcacctgtgttaccaaaaatcaaaacaaatcttttttattttttattattattattatttttgagacagagtctcgctctgtcgcccagtgtggagtgcagtggtgtgatcttggctcactgcaaactccgcctcccaggttcaagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaa

SEQ ID NO: 868 - DNA, 727 bp, Homo sapiens
agtggtgagtgtgcggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctc

SEQ ID NO: 869 - DNA, 572 bp, Homo sapiens
gcggtggggtttgaatgagagcggtgcctcggtaggtcgtcagaaagttacagtcgcccatctgagcgtttgtaagagatggaggcaggagtggtgaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaa

SEQ ID NO: 870 - DNA, 538 bp, Homo sapiens
agtggtgagtgtgcggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcgaaggtagaagatagcaccatgccgattcgtcgaactgtgaattctacccgggaaactcctcccaaaagcaagcttgctgaaggggaggaagaaaagccagaaccagacataagttcagaggaatctgtctccactgta

SEQ ID NO: 871 - DNA, 759 bp, Homo sapiens
aaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccagctgaagaaatcaggggagaaacccctgcttggtggaagcctgatggaatatgcaatcttgtctgccattgctgccatgaatgagccgaagacctgctctaccactgctctgaagaagtatgtcctagagaatcacccaggaaccaattctaactatcaaatgcatttgctgaaaaaaaccctgcagaaatgcgaaaagaat

SEQ ID NO: 872 - DNA, 970 bp, Homo sapiens
gcggcagagctcggcggctgggactggaggacagcggtggcggaggcgactagcggcggcgggagcggcgccgagaggccgtgcgggacgcgggcgccaggaccggccgaacgcagagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacag

SEQ ID NO: 873 - DNA, 473 bp, Homo sapiens
aggggggcggggcggcagagctcggcggctgggactggaggacagcggtggcggaggcgactagcggcggcgggagcggcgccgagaggccgtgcgggacgcgggcgccaggaccggccgaacgcagaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaat

SEQ ID NO: 874 - DNA, 1159 bp, Homo sapiens
cggaggcgactagcggcggcgggagcggcgccgagaggccgtgcgggacgcgggcgccaggaccggccgaacgcagaggttgattcttcaccacactgaaaccattaggaaaaatccttgtggttaacagcagaggcttcagagtgtaacctgtactcgggcctagaaattatttaaaatggcgactgatacgtctcaaggtgaactcgtccatcctaaggcactcccacttatagtaggagctcagctgatccacgcggacaagttaggtgagaaggtagaagatagcaccatgccgattcgtcgaactgtgaattctacccgggaaactcctcccaaaagcaagcttgctgaaggggaggaagaaaagccagaaccagacataagttcagaggaatctgtctccactgtagaagaacaagagaatgaaactccacctgctacttcgagtgaggcagagcagccaaagggggaacctgagaatgaagagaaggaagaaaataagtcttctgaggaaaccaaaaaggatgagaaagatcagtctaaagaaaaggagaagaaagtgaaaaaaacaattccttcctgggctaccctttctgccagccagctagccagggcccagaaacaaacaccgatggcttcttccccacgtcccaagatggatgcaatcttaactgaggccattaaggcatgcttccagaagagtggtgcatcagtggttgctattcgaaaatacatcatccataagtatccttctctggagctggagagaaggggttatctccttaaacaagcactgaaaagagaattaaatagaggagtcatcaaacaggttaaaggaaaaggtgcttctggaagttttgttgtggttcagaaatcaagaaaaacacctcagaaatccagaaacagaaagaataggagctctgcagtggatccagaaccacaagtaaaattggaggatgtcctcccactggcctttactcgcctttgtgaacctaaagaagcttcctacagtctcatcaggaaatatgtgtctcagtattatcctaagcttagagtggacatcaggcctcagctgttgaagaacgctctgcagagagcagtagagaggggccagttagaacagataactggcaaaggtgcttcggggacattccag

SEQ ID NO: 875 - DNA, 557 bp, Homo sapiens
attacggagctcccagtggtgagtgtgcggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcggtaggtcgtcagaaagttacagtcgcccatctgagcgtttgtaagagatggaggcaggagtggtgagaaggtagaagatagcaccatgccgattcgtcgaactgtgaattctacccgggaaactcctcccaaaagcaagcttg

SEQ ID NO: 876 - DNA, 2965 bp, Homo sapiens
gcccagataggggagcggaggtggcggcggcggcggtagcggtggccttggttgtcttccagtctcctcggctcgccctttagccggcaccgctccccttccctcccccttcctctcttccttccttccctccccttccctttttcccttccccgtcggtgagcggcgggggtggctccagcaacggctgggcccaagctgtgtagaggccttaaccaacgataacggcggcgacggcgaaacctcggagctcgcagggcgggggcaaggcccgggccttggagatggagaattctcagttgtgtaagctgttcatcggcggcctcaatgtgcagacgagtgagtcgggcctgcgcggccactttgaggcctttgggactctgacggactgcgtggtggtggtgaatccccagaccaagcgctcccgttgctttggcttcgtgacctactccaatgtggaggaggcggacgccgccatggccgcctcgccccatgccgtggacggcaacactgtggagctgaagcgggcggtgtcccgggaggattcggcgcggcccggtgcccacgccaaggttaagaagctctttgtcggaggccttaaaggagacgtggctgagggcgacctgatcgagcacttctcgcagtttggcaccgtggaaaaggccgagattattgccgacaagcagtccggcaagaagcgtggattcggcttcgtgtatttccagaatcacgacgcggcagacaaggccgcggtggtcaagttccatccgattcagggccatcgcgtggaggtgaagaaagcagtccccaaggaggatatctactccggtgggggtggaggcggctcccgatcctcccggggcggccgaggcggccgggggcgcggcggtggtcgagaccagaacggcctttccaagggcggcggcggcggttacaacagctacggtggttacggcggcggcggaggcggcggctacaatgcctacggaggcggcggcggcggttcgtcctacggtgggagcgactacggtaacggcttcggcggcttcggcagctacagccagcatcagtcctcctatgggcccatgaagagcggcggcggcggcggcggtggaggcagtagctggggcggtcgcagtaatagtggaccttacagaggcggctatggcggtgggggtggctatggaggcagctccttctaaaagaaaatttaaaatgcctgggagtggctataggggtagctctttccaacagcccaagtggggtcaactcctaagccccaccccctcacacacaccgccttccctgttttgcccttgggggagccacttctaaggctgcttacccttgggggtgttcctctatttgcctgccacctctcttgtctctccctctgaagatggactcggccccacatacacatttttgtgttacagtcattgatggactctatttttttattattacttggaccttggtcgtttttatactagcaaaatgtcttgttttaatttgtgttttttggggggagggagggagtgaacttgctgattctgtagcaaaacctgggtgggggttggggtggggggtagtttactttgttgtaaggacttgataacctggctacagcgttttctatgaaatctacttggatcccatgcctgaaatttggaagcatatgtacaaaaatcatttttacgttttatttttaataaatcattgtgtttgaccgtacatgtctaacattttttttctaggatccattccgtaccgttttttaagggatatttgtttaagactttacgtgttaattctttattcttgatgtgtacttagagaaacttaagaggtcctgtggtttttttcccctctcctgttgccctgctagttgcgtgttgaattatatcccttacaggcaaaacttttgaagtggtggatgtggctttttaaactcttaagtttctgtgcatccatctcttgtactaagcgaattgtttatcatcttgacatggttggtcatttctatgacaatttacttcaaactgtgtactgtgtagttctatatagtttgtgttaagcatgtcattcatataaactgtttaaaatttttcagatggcctagtttcatccctcttactggtttgtctgtaatgaatggttaaaaataagggttatattttaccctcaaatgcgtttttgtactttcagagcaggtttaaacgttttttttttttttttcctatatccgaactgttggcctcatggaaatccctttcccgatctttgtagcaccatctactggcagaatggcagagtagctgcgaaacaatttgtttaaaaacttgcttaagacaattgcatcagatttggaagttttgccatcaaaattctttgcagaattggaagttaacacatttgcttgtaactgagatgggcttcacaggaatgtagttgccagttcatatcacaatagccctttctatatgaggtttgaaaatgtaaactgctatgcatagcttgggcaatagccctaaattgctatgacaactaatgaaccagctacgtatactggtattttaggtgcaagttgtaaagcaaaatatctgtgtattctgcttggttaacaaatgtatatttgtagccctttcctgcaatagcattcaagttgttgtttataagagaagaacaaaagtgataataggtgaaaattgcctttctggatagaaatagagaatagcaacgtttatggatatcacaaataaagaattcaattctttacatgattgagtgagagtatgtataacctggtgggtgggttcagagtaccttttaatctagtatgcttaacttgatgttaatatttaacttaaatatttgacttacatgttgacgttgaaggctcaaagctatactaagaagctttctgaaagattgggctttaaaataaaataatattttaatattg

SEQ ID NO: 877 - DNA, 1164 bp, Homo sapiens
gaagagacgaagactgagcggttgtggccgcgttgccgacctccagcagcagtcggcttctctacgcagaacccgggagtaggagactcagaatcgaatctcttctccctccccttcttgtatacttttttttgctttacagttttcggctttgtgagaaaccttaccatcaaacacgatggccagcaacgttaccaacaagacagatcctcttttcagctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccaggtgaaaaccacgggaaaggaaagaaaaaggtggtggaggggggctcagggacacatggagtgcctctaactccatcctgtttgtgtctgtttctcacagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggt

SEQ ID NO: 878 - DNA, 3248 bp, Homo sapiens
aggaatggggcggggactaggccttcgcctcggcggcagaggagactcgggggccattttgtgaagagacgaagactgagcggttgtggccgcgttgccgacctccagcagcagtcggcttctctacgcagaacccgggagtaggagactcagaatcgaatctcttctccctccccttcttgtatacttttttttgctttacagttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacgggtcagtaacagaacacccttctccgtcccctctactcagctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaaaataatctcttgttatgcagggagtacagttcttttcattcatacataagttcagtagttgcttccctaactgcaaaggcaatctcatttagttgagtagctcttgaaagcagctttgagttagaagtatgtgtgttacaccctcacattagtgtgctgtgtggggcagttcaacacaaatgtaacaatgtatttttgtgaatgagagttggcatgtcaaatgcatcctctagaaaaataattagtgttatagtcttaagatttgttttctaaagttgatactgtgggttatttttgtgaacagcctgatgtttgggaccttttttcctcaaaataaacaagtccttattaaaccaggaatttggagaaaaaaaaaaccctggttttttatttttgtattttattattgtttacttcaaactttgttttacagcgtcctccacaaaacctctagaatgcactagatatatttttcttggagtcataatcatgatgcataccaacacaacactactcaaattatatttcattgagatgcatgttgcattgaggagtcaacttgacatagagtggagactttttcaaaatggcttttacatcctaatgaaagtttgggaagtatatcctctctgccttttcatcagtgctttgtggtccagctggcaccctttctgaggtttgtgttttgtgctaaatggttttgtccttaaataggagaggctcaaaaacatcaagatttcaggaaaatggcgacagctgcataatggaacccccctgcttctattttgttcttttaattactatttatagccccagttaccttctgaattctgaagtgtatatacctccatgttcctgaaaacaagaaaactcttacttcctgatattccatagactgccttcccaggtgattgagaacatagagaatgttacacatttattttactctaaatgatcttttacccctgttagctaatctttgtgttttcctcaactttattaattacagtgattgcatttttagcatccagttgtaagatgaatatattaaacagctaccagtgttggtgatacctcatccttgaaaggcttagttcatttgtgttttatacttcagtttttccagcatagcagaaaatgccgcttataatttttgtgcacacaaaccttggattcccctgtaaagttgctattgtttcatagcatgcggcactggccttttttcatcctactcattacaggcaaaactcatgtcttatttatgaggattttatagatcattttctgtaacaggtgacaaaagcagaaaagaatgaagaggctgaagtatgaactacccttggagcccatatacatgatataggcaatttcttttgtatgttaattcagtcaaaaatactacccacttgatgttttctaatctgatgtgagctcatgttacacagacttttagtaagtaacccgtgactagaaaataaactggatgcttaggagagagtgtcagatgtataagatgctaataaaacctgtttaatattattgttagctgtaagtttttgggaaatactgaacaaattagtccacaatcaagtgtctacttttcccttcactgtagggcctctccctgcacagagcagtctgtttagctgtgaacaccacaatctgcagatgttcaagtcccttacataaaatggcatagtatttatatgtaacctatgcatattctcctgtatattttaaatcatctctacattaaaatacctgataaaatgtaaatggtatgtaaa

SEQ ID NO: 879 - DNA, 1152 bp, Homo sapiens
gccattttgtgaagagacgaagactgagcggttgtggccgcgttgccgacctccagcagcagtcggcttctctacgcagaacccgggagtaggagactcagaatcgaatctcttctccctccccttcttgtatacttttttttgctttacagttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaaaataatctcttgttatgcagggagtacagttcttttcattcatacataagttcagtagttgcttccctaactgcaaaggcaatctcatttagttgagtagctcttgaaagcagctttgagttagaagtatgtgtgttacaccctcacattagtgtgctgtgtggggcagttcaacacaaatgtaacaatgtatttttgtgaatgagagttggcatgtcaaatgcatcctctagaaaaataattagtgttatagtcttaagatttgttttctaaagttgatactgtgggttatttttgtgaacagcctgatgtttgggaccttttttcctcaaaataaacaagtccttattaaacc

SEQ ID NO: 880 - DNA, 1559 bp, Homo sapiens
cattttgtgaagagacgaagactgagcggttgtggccgcgttgccgacctccagcagcagtcggcttctctacgcagaacccgggagtaggagactcagaatcgaatctcttctccctccccttcttgggcagcaaggcgaaccccatccctactcactggagctcagctttgatttttaacctcccttccccacccttccagaacacacacattccattccaaaactgattttataaagacattttaaacataatgatgcaacttggtgtgcactacagcaaatgtacagtgagatttttttgatcttcagctacaccatcttcctcctgtttcccttgaaatcccatcctgcttttcctgtacactacccctcacaaaccacaagctgcagcaacatggatgcccagcctggagcagcagcagccaggatgacctggagccaggggggccttcggaacagatgcacacccttcctgggtgatgttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacgggtcagtaacagaacacccttctccgtcccctctactcagctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttct

SEQ ID NO: 881 - DNA, 4501 bp, Homo sapiens
ttcttgattgaaaatggtgctaaagttggtctttttatgagtggtagctcttcagtttaacataaataacatcttgggagatactgagctttttgatattgaaagatagaattggtttcttttcacatttttctttatttttaagcttatgtcttgtggcacctgtacaaaggacttggttgtggttgagctataaagttatgtatcttgaaaattgattaccaggtttgggctgtggctccaaataagaaaatgaaatgtttcaccataactgtatttcataaacaggaaaagaacattcagatgtatatttcttacaattcttcacaaactttttccgcaatttgtacattcatacagttttcacacatcaaatgtaaaaattaactgtcattcctacactgttctttttaaaaatgtatggtacttgttgctgctgtagtcattcatgtatagttggctcaaggaacacttctaaaagctcaattaaaaattttttttttgagacagggtctctctctggcctggctgaagtgcagtggcgtgatcagagctcactgcagcctcgaactcctgggctcaagtgatcctcgctcctcagactgctaagtagctgggatttcaggctaccacaccctgctaatgttttttgtttttaataaagtctcgtcatgtttcccaggctggtctcaaactactgagctcaagccgtgctctaccctggcctcccaaagtgttgggattacaggtgtgagccaccacacttggccttaaaatattttaatttcctcaaatttacaaaggagaataagacctcatggctaaattgaacagtgagtgcagctagttcattgtttgcacaaggaactacagtctaattgcagttcctattttagctgatgaaacaaccagtttgtcatggaaattattttagtgtggtattatgtaccagatttttagaatccataacttgaaattagctttacacgctacatagtaaatagtggactacagaaacaaaagtattaacataaggaccttaatttttttcacctattttatgaccttaaatattcagtatttttttaattccatctgtattttcgttttgtcagtgagtggaataatgtgctccttatttaaaacatcttttcccctaacagtagaacctattaggtcttgtggtttgatcactcactggttttgagaatagatgagtcatctctagtatagatcttcatggtaggccattcaccttcagtctattactcatagcaaaaactccacggacttttttaagtttaaaacccatgaatctgcttaggttttataatctcagtatttgacatttgctcactatttcatctctatttgttggcccggtttttctgtattttctttgcccaaactgctcattatcaagatgaacatttgggatatactctttttgagaccctcaagggcatattgacatgaatttagttaattttagtcatctattgatgttgaagaattgtgaagacagtcactggtagaggtgattctatggaggctatcccatcccagtggaatgttaatgctttaccaaaatgtgttagctgcagtagacagatgtttctgtcttgggggtttagggcacaacatttctgaggaactctgactcaatctgtcccttctcctttcacagggcagcaaggcgaaccccatccctactcactggagctcagctttgatttttaacctcccttccccacccttccagaacacacacattccattccaaaactgattttataaagacattttaaacataatgatgcaacttggtgtgcactacagcaaatgtacaggtgttttttttttaattgtttccaaaaccgggacctggatttaagatgtaatttttaaaatttctatttctattttttctgcagcagttgggttagaggaggaggagccttttagcctctcataaactgacctctctacttcctcgtgtatttttaagattgattgatgatgtggaaagggctttgcttgtctgctactgaaaactttatccttgcggtttttgtggaaactgcttttggaaagagaaaagaaatgaactttactgacttgacatttttgcacctcccgtttttctaatctgggctatttttatttttgtttttttacagtgagatttttttgatcttcagctacagtaagttattccaatttttttttaacatttttcctgactttccgctgatttcctttttattgttgttactagttactattacttattattattatattaatacttatgatggtgatgatgatgatgataatgacactgatgatttttaaccggattaaaatcgagtttttctgaatgtttctaagaatttctccggcctcctgattgactttggagttttgcatcttgggagagaaagcgaaggcattagtatttttaagtggtttgatcacgtaaaccttttctctcccaaccccacccttgccctcatccccttccccacactgaaaagaattttactggctgttaagtctatgaccttatttttcctgatctttaacttaactgttttagagcatctctggacgtctgtatttttaattttttttatttttgtttttttatttttaatctttcatttgttaaatttttaaactgtgctgcaataaaatgtgtgtggtactacttaacacttatgatcgtgatggcattttccctgaaagccatcttcctcctgtttcccttgaaatcccatcctgcttttcctgtacactacccctcacaaaccacaagctgcagcaacatggatgcccagcctggagcagcagcagccaggatgacctggagccaggggggccttcggaacagatgcacacccttcctgggtgatgttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaaaataatctcttgttatgcagggagtacagttcttttcattcatacataagttcagtagttgcttccctaactgcaaaggcaatctcatttagttgagtagctcttgaaagcagctttgagttagaagtatgtgtgttacaccctcacattagtgtgctgtgtggggcagttcaacacaaatgtaacaatgtatttttgtgaatgagagttggcatgtcaaatgcatcctctagaaaaataattagtgttatagtcttaagatttgttttctaaagttgatactgtgggttatttttgtgaacagcctgatgtttgggaccttttttcctcaaaataaacaagtccttattaaaccaggaatttggag

SEQ ID NO: 882 - DNA, 1074 bp, Homo sapiens
ttttgtgaagagacgaagactgagcggttgtggccgcgttgccgacctccagcagcagtcggcttctctacgcagaacccgggagtaggagactcagaatcgaatctcttctccctccccttcttgttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacgggtcagtaacagaacacccttctccgtcccctctactcagctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcggatga

SEQ ID NO: 883 - DNA, 3187 bp, Homo sapiens
aggaatggggcggggactaggccttcgcctcggcggcagaggagactcgggggccattttgtgaagagacgaagactgagcggttgtggccgcgttgccgacctccagcagcagtcggcttctctacgcagaacccgggagtaggagactcagaatcgaatctcttctccctccccttcttgttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaaaataatctcttgttatgcagggagtacagttcttttcattcatacataagttcagtagttgcttccctaactgcaaaggcaatctcatttagttgagtagctcttgaaagcagctttgagttagaagtatgtgtgttacaccctcacattagtgtgctgtgtggggcagttcaacacaaatgtaacaatgtatttttgtgaatgagagttggcatgtcaaatgcatcctctagaaaaataattagtgttatagtcttaagatttgttttctaaagttgatactgtgggttatttttgtgaacagcctgatgtttgggaccttttttcctcaaaataaacaagtccttattaaaccaggaatttggagaaaaaaaaaaccctggttttttatttttgtattttattattgtttacttcaaactttgttttacagcgtcctccacaaaacctctagaatgcactagatatatttttcttggagtcataatcatgatgcataccaacacaacactactcaaattatatttcattgagatgcatgttgcattgaggagtcaacttgacatagagtggagactttttcaaaatggcttttacatcctaatgaaagtttgggaagtatatcctctctgccttttcatcagtgctttgtggtccagctggcaccctttctgaggtttgtgttttgtgctaaatggttttgtccttaaataggagaggctcaaaaacatcaagatttcaggaaaatggcgacagctgcataatggaacccccctgcttctattttgttcttttaattactatttatagccccagttaccttctgaattctgaagtgtatatacctccatgttcctgaaaacaagaaaactcttacttcctgatattccatagactgccttcccaggtgattgagaacatagagaatgttacacatttattttactctaaatgatcttttacccctgttagctaatctttgtgttttcctcaactttattaattacagtgattgcatttttagcatccagttgtaagatgaatatattaaacagctaccagtgttggtgatacctcatccttgaaaggcttagttcatttgtgttttatacttcagtttttccagcatagcagaaaatgccgcttataatttttgtgcacacaaaccttggattcccctgtaaagttgctattgtttcatagcatgcggcactggccttttttcatcctactcattacaggcaaaactcatgtcttatttatgaggattttatagatcattttctgtaacaggtgacaaaagcagaaaagaatgaagaggctgaagtatgaactacccttggagcccatatacatgatataggcaatttcttttgtatgttaattcagtcaaaaatactacccacttgatgttttctaatctgatgtgagctcatgttacacagacttttagtaagtaacccgtgactagaaaataaactggatgcttaggagagagtgtcagatgtataagatgctaataaaacctgtttaatattattgttagctgtaagtttttgggaaatactgaacaaattagtccacaatcaagtgtctacttttcccttcactgtagggcctctccctgcacagagcagtctgtttagctgtgaacaccacaatctgcagatgttcaagtcccttacataaaatggcatagtatttatatgtaacctatgcatattctcctgtatattttaaatcatctctacattaaaatacctgataaaatgtaaatggtatgtaaa

SEQ ID NO: 884 - DNA, 1304 bp, Homo sapiens
attttgtgaagagacgaagactgagcggttgtggccgcgttgccgacctccagcagcagtcggcttctctacgcagaacccgggagtaggagactcagaatcgaatctcttctccctccccttcttgtatacttttttttgctttacagttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacgggtcagtaacagaacacccttctccgtcccctctactcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaaaataatctcttgttatgca

SEQ ID NO: 885 - DNA, 1375 bp, Homo sapiens
agaggagactcgggggccattttgtgaagagacgaagactgagcggttgtggccgcgttgccgacctccagcagcagtcggcttctctacgcagaacccgggagtaggagactcagaatcgaatctcttctccctccccttcttgtgagatttttttgatcttcagctacattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggttttta

SEQ ID NO: 886 - DNA, 1039 bp, Homo sapiens
agaggagactcgggggccattttgtgaagagacgaagactgagcggttgtggccgcgttgccgacctccagcagcagtcggcttctctacgcagaacccgggagtaggagactcagaatcgaatctcttctccctccccttcttggttacaaaacacttgaaatatataagttagtggaactttgcttgagtgagatttttttgatcttcagctacattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcgg

SEQ ID NO: 887 - DNA, 1784 bp, Homo sapiens
cattttgtgaagagacgaagactgagcggttgtggccgcgttgccgacctccagcagcagtcggcttctctacgcagaacccgggagtaggagactcagaatcgaatctcttctccctccccttcttgtgagatttttttgatcttcagctacattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacgggtcagtaacagaacacccttctccgtcccctctactcagctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaaaataatctcttgttatgcagggagtacagttcttttcattcatacataagttcagtagttgcttccctaactgcaaaggcaatctcatttagttgagtagctcttgaaagcagctttgagttagaagtatgtgtgttacaccctcacattagtgtgctgtgtggggcagttcaacacaaatgtaacaatgtatttttgtgaatgagagttggcatgtcaaatgcatcctctagaaaaataattagtgttatagtcttaagatttgttttctaaagttgatactgtgggttatttttgtgaacagcctgatgtttgggaccttttttcctcaaaataaacaagtccttattaaaccaggaatttggagaaaaaa

SEQ ID NO: 888 - DNA, 644 bp, Homo sapiens
ggccgcgttgccgacctccagcagcagtcggcttctctacgcagaacccgggagtaggagactcagaatcgaatctcttctccctccccttcttggttacaaaacacttgaaatatataagttagtggaactttgcttgagtgagatttttttgatcttcagctacagtgtttccagtgtaaatgaattgattctatttattgccttttgaagaaaattatacttaatggttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggactatgactttcaacgggactattatgataggatgtacagttac

SEQ ID NO: 889 - DNA, 1924 bp, Homo sapiens
cattttgtgaagagacgaagactgagcggttgtggccgcgttgccgacctccagcagcagtcggcttctctacgcagaacccgggagtaggagactcagaatcgaatctcttctccctccccttcttgggcagcaaggcgaaccccatccctactcactggagctcagctttgatttttaacctcccttccccacccttccagaacacacacattccattccaaaactgattttataaagacattttaaacataatgatgcaacttggtgtgcactacagcaaatgtacagtgagatttttttgatcttcagctacattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaaaataatctcttgttatgcagggagtacagttcttttcattcatacataagttcagtagttgcttccctaactgcaaaggcaatctcatttagttgagtagctcttgaaagcagctttgagttagaagtatgtgtgttacaccctcacattagtgtgctgtgtggggcagttcaacacaaatgtaacaatgtatttttgtgaatgagagttggcatgtcaaatgcatcctctagaaaaataattagtgttatagtcttaagatttgttttctaaagttgatactgtgggttatttttgtgaacagcctgatgtttgggaccttttttcctcaaaataaacaagtccttattaaaccaggaatttggagaaaaaaaaaaccctggtttttt

SEQ ID NO: 890 - DNA, 789 bp, Homo sapiens
acgaagactgagcggttgtggccgcgttgccgacctccagcagcagtcggcttctctacgcagaacccgggagtaggagactcagaatcgaatctcttctccctccccttcttgtgagatttttttgatcttcagctacagaggacacgttactaagagtggaattaatccgtattgtgagtacgtctgtctttactgttgcctccatcttgaatttaagtcctcatattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacgggtcagtaacagaacacccttctccgtcccctctactcagctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattct

SEQ ID NO: 891 - DNA, 531 bp, Homo sapiens
atatataagttagtggaactttgcttgagtgagatttttttgatcttcagctacagaggacacgttactaagagtggaattaatccgtattgtgagtacgtctgtctttactgttgcctccatcttgaatttaagtcctcatattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggactatgactttcaacggg

SEQ ID NO: 892 - DNA, 781 bp, Homo sapiens
gaagactgagcggttgtggccgcgttgccgacctccagcagcagtcggcttctctacgcagaacccgggagtaggagactcagaatcgaatctcttctccctccccttcttggttacaaaacacttgaaatatataagttagtggaactttgcttgagtgagatttttttgatcttcagctacattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacgggtcagtaacagaacacccttctccgtcccctctactcagctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaag

SEQ ID NO: 893 - DNA, 1182 bp, Homo sapiens
gcggttgtggccgcgttgccgacctccagcagcagtcggcttctctacgcagaacccgggagtaggagactcagaatcgaatctcttctccctccccttcttgttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggactatgactttcaacgggactattatgataggatgtacagttacccagcacgtgtacctcctcctcctcctattgctcgggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaa

SEQ ID NO: 894 - DNA, 629 bp, Homo sapiens
acgaagactgagcggttgtggccgcgttgccgacctccagcagcagtcggcttctctacgcagaacccgggagtaggagactcagaatcgaatctcttctccctccccttcttgtgagatttttttgatcttcagctacagaggacacgttactaagagtggaattaatccgtattgtgagtacgtctgtctttactgttgcctccatcttgaatttaagtcctcatattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggactatgactttcaacgggactattatgatag

SEQ ID NO: 895 - DNA, 1156 bp, Homo sapiens
cgaagactgagcggttgtggccgcgttgccgacctccagcagcagtcggcttctctacgcagaacccgggagtaggagactcagaatcgaatctcttctccctccccttcttgtgagatttttttgatcttcagctacattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaactcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaa

SEQ ID NO: 896 - DNA, 1252 bp, Homo sapiens
gcctggagcagcagcagccaggatgacctggagccaggggggccttcggaacagatgcacacccttcctgggtgatgttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacggctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgac

SEQ ID NO: 897 - DNA, 1371 bp, Homo sapiens
cattttgtgaagagacgaagactgagcggttgtggccgcgttgccgacctccagcagcagtcggcttctctacgcagaacccgggagtaggagactcagaatcgaatctcttctccctccccttcttgttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacgggtcagtaacagaacacccttctccgtcccctctactcagctcctcttttgacttggactatgactttcaacgggactattatgataggatgtacagttacccagcacgtgtacctcctcctcctcctattgctcgggctgtagtgccctcgaaacgtcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggttttta

SEQ ID NO: 898 - DNA, 580 bp, Homo sapiens
gactgagcggttgtggccgcgttgccgacctccagcagcagtcggcttctctacgcagaacccgggagtaggagactcagaatcgaatctcttctccctccccttcttgggcagcaaggcgaaccccatccctactcactggagctcagctttgatttttaacctcccttccccacccttccagaacacacacattccattccaaaactgattttataaagacattttaaacataatgatgcaacttggtgtgcactacagcaaatgtacagtgagatttttttgatcttcagctacagaatactagtcaagtgactgaagattgatgtggatttgggagaggagttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctg

SEQ ID NO: 899 - DNA, 1308 bp, Homo sapiens
attttgtgaagagacgaagactgagcggttgtggccgcgttgccgacctccagcagcagtcggcttctctacgcagaacccgggagtaggagactcagaatcgaatctcttctccctccccttcttgtgagatttttttgatcttcagctacattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttagatattaacctggctgcagagccaaaagtgaaccgaggaaaagcaggtgtgaaacgatctgcagcggagatgtacgggtcagtaacagaacacccttctccgtcccctctactcagcgtgtatcaggaaacacttcacgaaggggcaaaagtggcttcaattctaagagtggacagcggggatcttccaagtctggaaagttgaaaggagatgaccttcaggccattaagaaggagctgacccagataaaacaaaaagtggattctctcctggaaaacctggaaaaaattgaaaaggaacagagcaaacaagcagtagagatgaagaatgataagtcagaagaggagcagagcagcagctccgtgaagaaagatgagactaatgtgaagatggagtctgaggggggtgcagatgactctgctgaggagggggacctactggatgatgatgataatgaagatcggggggatgaccagctggagttgatcaaggatgatgaaaaagaggctgaggaaggagaggatgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaaaataatctcttgttatgca

SEQ ID NO: 900 - DNA, 599 bp, Homo sapiens
cattttgtgaagagacgaagactgagcggttgtggccgcgttgccgacctccagcagcagtcggcttctctacgcagaacccgggagtaggagactcagaatcgaatctcttctccctccccttcttgcagttgggttagaggaggaggagccttttagcctctcataaactgacctctctacttcctcgtgtatttttaagattgattgatgatgtggaaagggctttgcttgtctgctactgaaaactttatccttgcggtttttgtggaaactgcttttggaaagagaaaagaaatgaactttactgacttgacatttttgcacctcccgtttttctaatctgggctatttttatttttgtttttttacagtgagatttttttgatcttcagctacattttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcg

SEQ ID NO: 901 - DNA, 1108 bp, Homo sapiens
ctgagctacaactacaaccagaggtctaaactacaaccagatctgaattcttgttgggagccattttgtgaagagacgaagactgagctggtttggctgcatttctggcctcgagccgcagtcagtttctccccgtagaacccggcagtaggagacttagaatcgaatctcttctccctcccgcctcctgtttttggctttttgagaaaccttatcatccaacacaatggccagcaacgttaccaacaagatggatcctcactccatgaactcccgtgtgttcattgggaatctcaacactcttgttgtcaagaaatcggatgtggaggcgatcttttccaagtatggcaaaattgcgggctgctctgttcataagggctttgccttcgttcaatatgataaggagaaaaatgcccgggctgctgtagcaggagaggatggcagaatgattgctagccaggttgtagatattaacctggctgcagagccaaaagtgaaccgaggaaacgcaggtgtgaaacgatcagcagcggagatgtacggctcctcttttgacttggactatggctttcaacgggattattatgatggaatgtacagtttcccagcacgtgtacctcctcctcctcccattgctctggctgtagtgccctcgaaacgtcaacgtctatcaggaaacacctcacgaaggggcaaaagtggcttcaattctaagagtggaaagcggggatcttccaagtctggaaagttgaaaggtgatgaccttcaggccattaagcaggagttgacccagataaaacagaaagtggattctctcctggaaaacctggaaaaaattgaaaaggaacagagcaaacaagaggtagaggtgaaaaatgctaagtcagaagaggagcagagcagtagctccatgaagaaagatgagactcatgtgaagatggagtctgaggggggtgcagaagactctgctgaggagggggacccactggatgatgatgttaatgaagatcagggggatgaccagctggagttgatcaaggatgatgaaaaagaggctgaggaaggagaggatgacagagacagcaccaatggccaggatgactcttaa

SEQ ID NO: 902 - DNA, 2339 bp, Homo sapiens
tgcgcagctccctaagcggttgtcaccgctggagacggttgggagaaccgttgtggcgagcgctacacgaggcaaacgacttctcccttctttgaactggaccccgcgagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcattgtgggag

SEQ ID NO: 903 - DNA, 1332 bp, Homo sapiens
ccgttgtggcgagcgctacacgaggcaaacgacttctcccttctttgaactggaccccgcgagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaac

SEQ ID NO: 904 - DNA, 919 bp, Homo sapiens
gtcaccgctggagacggttgggagaaccgttgtggcgagcgctacacgaggcaaacgacttctcccttctttgaactggaccccgcgagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaaggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttctt

SEQ ID NO: 905 - DNA, 2652 bp, Homo sapiens
gctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaa

SEQ ID NO: 906 - DNA, 2038 bp, Homo sapiens
ggacgcgagaaggcgggggaggggagcctgcgctcgttttctgtctagctccgaccggctgaggcggcgcggcagcggagggacggcagtctcgcgcggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaaccta

SEQ ID NO: 907 - DNA, 1589 bp, Homo sapiens
cagtcttattagttagggtttttggtggtgtgggaatttttgttttgtcttttataaacctctctcctcttaatccagatgttctgtataattatctgggttattaatttccccatttcctcaagaatttcagtaaactttgagtcaggttttgtgtctaccctcatgagccagcctgctactgaaacatcgtttgtttttcttaaaaaataaaaaaggctagaaccatcatttgaggtccttaatgttaagccacagtcagatttagagaagtccattattgtgttagtcttcagaacaacttaagcttgtttcattgagagtatgagtatagtttgtattaaattaaaatttattgcttttcccccttttccctctccttgtttttttggccatatatctccgttgcccatgtactggatcgacttacccctgcgttgcccaccatgacgttggcccatccgcccctgaacgcccatgtgaaaaccctggttggctatgcccaaaaatgtgctcgttgccaaacgggtaccatacttgacaacttctgattgaatgcccatgcccaatgccaacatccacgaacgccaatgaccaatgcagtacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacaggttgagtatcatagttgttcgtgtgtatatcagtgataatttaagatgcttacctgctctccagtaagttttttattcccctgaggatacttactgaaaataggata

SEQ ID NO: 908 - DNA, 1734 bp, Homo sapiens
gagaaggcgggggaggggagcctgcgctcgttttctgtctagctccgaccggctgaggcggcgcggcagcggagggacggcagtctcgcgcggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactactatctggtatttgtggtgtttgacagcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttg

SEQ ID NO: 909 - DNA, 2942 bp, Homo sapiens
tagggcgcgacggcggggaggacgcgagaaggcgggggaggggagcctgcgctcgttttctgtctagctccgaccggctgaggcggcgcggcagcggagggacggcagtctcgcgcggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgctagatttgatgtgtgcccgatttgaacaagggttgattgacacctgtaaaatttgttgaaacgttcctcttaaaaggaaatatagtaatcttatgt

SEQ ID NO: 910 - DNA, 2917 bp, Homo sapiens
ccctagccgcccctccccccagctagtgagtgcgcgaacgagaaaggaggagggcgctccaggcgacagcactgcagacgccattatcctctgtttctctgctgcaccgacctcgacgtcttgcctgtgtcccacttgttcgcggcctataggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgctagatttgatgtgtgcccgatttgaacaagggttgattgacacctgtaaaatttgttgaaacgttcctcttaaaaggaaatatagtaatcttatgt

SEQ ID NO: 911 - DNA, 2741 bp, Homo sapiens
gctccaggcgacagcactgcagacgccattatcctctgtttctctgctgcaccgacctcgacgtcttgcctgtgtcccacttgttcgcggcctattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatg

SEQ ID NO: 912 - DNA, 2928 bp, Homo sapiens
agggcgctccaggcgacagcactgcagacgccattatcctctgtttctctgctgcaccgacctcgacgtcttgcctgtgtcccacttgttcgcggcctataggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagggcctgcagttgccatcacccactgcaaccagccagctcccgctcgaatctgatgctgtggaatgcttaaattaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtatgcagatgttgaaggattctaatgcaagatattttttcttttttatagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattcaaaaaaaaaaaagatgaaaaaagttcctgtggatgttttgtgtagtatcttggcatttgtattgatagttaaaattcacttccaaataaataaaacacccatgatgctagatttgatgtgtgcccgatttgaacaagggttgattgacacctgtaaaatttgttgaaacgttcctcttaaaaggaaatatagtaatcttatgta

SEQ ID NO: 913 - DNA, 2555 bp, Homo sapiens
ggacgcgagaaggcgggggaggggagcctgcgctcgttttctgtctagctccgaccggctgaggcggcgcggcagcggagggacggcagtctcgcgcggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagtaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattggcaaaggtggtcagcggattaaacaaatccgtcatgagtcgggagcttcgatcaaaattgatgagcctttagaaggatccgaagatcggatcattaccattacaggaacacaggaccagatacagaatgcacagtatttgctgcagaacagtgtgaagcagtattctggaaagtttttctaagactagtgaagaactgaaggagtcctgcatctttttttttttatctgcttctgtttaaaaagccaacattcctctgcttcataggtgttctgcatttgaggtgtagtgaaatctttgctgttcaccagatgtaatgttttagttccttacaaacagggttgggggggggaagggcgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaagacagtcattttaaaatggtggctgaatttcccaacccacccccaaactaaacactaagtttaattttcagctcctctgttggacatataagtgcatctcttgttggacataggcaaaataacttggcaaacttagttctggtgatttcttgatggtttggaagtctattgctgggaagaaattccatcatacatattcatgcttataataagctggggattttttgtttgtttttgcaaatgcttgcccctacttttcaacaattttctatgttagttgtgaagaactaaggtggggagcagtactacaagttgagtaatggtatgagtatataccagaattctgattggcagcaagttttattaatcagaataacacttggttatggaagtgactaatgctgaaaaaattgattatttttattagataatttctcacctatagacttaaactgtcaatttgctctagtgtcttattagttaaactttgtaaaatatatatatacttgtttttccattgtatgcaaattgaaagaaaaagatgtaccatttctctgttgtatgttggattatgtaggaaatgtttgtgtacaattc

SEQ ID NO: 914 - DNA, 1283 bp, Homo sapiens
gaggcggcgcggcagcggagggacggcagtctcgcgcggctactgcagcactggggtgtcagttgttggtccgacccagaacgcttcagttctgctctgcaaggatatataataactgattggtgtgcccgtttaataaaagaatatggaaactgaacagccagaagaaaccttccctaacactgaaaccaatggtgaatttggtaaacgccctgcagaagatatggaagaggaacaagcatttaaaagatctagaaacactgatgagatggttgaattacgcattctgcttcagagcaagaatgctggggcagtgattggaaaaggaggcaagaatattaaggctctccgtacagactacaatgccagtgtttcagtcccagacagcagtggccccgagcgcatattgagtatcagtgctgatattgaaacaattggagaaattctgaagaaaatcatccctaccttggaagagtaccaacactataaaggaagtgactttgactgcgagttgaggctgttgattcatcagagtctagcaggaggaattattggggtcaaaggtgctaaaatcaaagaacttcgagagaacactcaaaccaccatcaagcttttccaggaatgctgtcctcattccactgacagagttgttcttattggaggaaaacccgatagggttgtagagtgcataaagatcatccttgatcttatatctgagtctcccatcaaaggacgtgcacagccttatgatcccaatttttacgatgaaacctatgattatggtggttttacaatgatgtttgatgaccgtcgcggacgcccagtgggatttcccatgcggggaagaggtggttttgacagaatgcctcctggtcggggtgggcgtcccatgcctccatctagaagagattatgatgatatgagccctcgtcgaggaccacctccccctcctcccggacgaggcggccggggtggtagcagagctcggaatcttcctcttcctccaccaccaccacctagagggggagacctcatggcctatgacagaagagggagacctggagaccgttacgacggcatggttggtttcagtgctgatgaaacttgggactctgcaatagatacatggagcccatcagaatggcagatggcttatgaaccacagggtggctccggatatgattattcctatgcagggggtcgtggctcatatggtgatcttggtggacctattattactacacaagtaactattcccaaagatttggctggatctattattg

SEQ ID NO: 915 - DNA, 2114 bp, Homo sapiens
tctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctaagcggctcaagactgacaacgccggcgaccagcacggaggcggcggcggtggcggtggaggagccggggcggcgggcggcggcggcggtggggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacacagc

SEQ ID NO: 916 - DNA, 1880 bp, Homo sapiens
ctcttttcgatccgggacggccggtcaggctcgccgccgagctggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagatcttgtattccttttttttttttttttttttttttttaaatgctaggtttgtagaggcttacttaaccttaatggaaacgctggaaatctgcagggggagggagaggggaactgttatctcccaagattaaccttcacttttaaaaaattattgtacatgtgatttttttttttcctgttcatacatttgtgctgcccatgtactcttggcacatttcaataaaattgtttggaaaataaacacagc

SEQ ID NO: 917 - DNA, 1749 bp, Homo sapiens
tcttttcgatccgggacggccggtcaggctcgccgccgagctggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccccagtatgggcaccccccaccccctcccccaccacccgagtatggccctcacgccgacagccctgtgctcatggtctatggcttggatcaatctaagatgaactgtgaccgagtcttcaatgtcttctgcttatatggcaatgtggagaaggtgaaattcatgaaaagcaagccgggggccgccatggtggagatggctgatggctacgctgtagaccgggccattacccacctcaacaacaacttcatgtttgggcagaagctgaatgtctgtgtctccaagcagccagccatcatgcctggtcagtcatacgggttggaagacgggtcttgcagttacaaagacttcagtgaatcccggaacaatcggttctccaccccagagcaggcagccaagaaccgcatccagcaccccagcaacgtgctgcacttcttcaacgccccgctggaggtgaccgaggagaacttctttgagatctgcgatgagctgggagtgaagcggccatcttctgtgaaagtattctcaggcaaaagtgagcgcagctcctctggactgctggagtgggaatccaagagcgatgccctggagactctgggcttcctgaaccattaccagatgaaaaacccaaatggtccatacccttacactctgaagttgtgtttctccactgctcagcacgcctcctaattaggtgcctaggaagagtcccatctgagcaggaagacatttctctttcctttatgccattttttgtttttgttatttgcaaaagattaaccttcacttttaaaaaattattgtacatgtgatttttttttttcctgttcatacatttgtgctgcccatgtactcttggcacatttcaataaaattgtttggaaaataaacac

SEQ ID NO: 918 - DNA, 995 bp, Homo sapiens
agtgtctgctcttttcgatccgggacggccggtcaggctcgccgccgagctggagaactacgatgacccgcacaaaacccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaagggtcgcagtgtatgtttgatgggacgccatctttcagaactgtgctaactcactgttgaagcgtccaatggtgaccctggcagcaaccccaacaaacgccagaggcagccccctctcctgggagatcaccccgcagaatatggagggccccacggtgggtaccacagccattaccatgatgagggctacgggccccccccacccccaccacccgagtatggccctcacgccgacagccctgtgctcatggtctatggcttggatcaatctaagatgaactgtgaccgagtcttcaatgtcttctgcttatatggcaatgtggagaaggtg

SEQ ID NO: 919 - DNA, 1000 bp, Homo sapiens
aagcggcgtcggcggctggagcagaggcagcagccggacgagcagcggaggcggtcgggagcgatggtgaagatggcggcggcgggcggcggaggcggcggtggccgctactacggcggcggcagtgagggcggccgggcccctgcctccccagttgtccacatcaggggcctgattgacggtgtggtggaagcagaccttgtggaggccttgcaggagtttggacccatcagctatgtggtggtaatgcctaaaaagagacaagcactggtggagtttgaagatgtgttgggggcttgcaacgcagtgaactacgcagccgacaaccaaatatacattgctggtcacccagcttttgtcaactactctaccagccagaagatctcccgccctggggactcggatgactcccggagcgtgaacagtgtgcttctctttaccatcctgaaccccatttattcgatcaccacggatgttctttacactatctgtaatccttgtggccctgtccagagaattgtcattttcaggaagaatggagttcaggcgatggtggaatttgactcagttcaaagtgcccagcgggccaaggcctctctcaatggggctgatatctattctggctgttgcactctgaagatcgaatacgcaaagcctacacgcttgaatgtgttcaagaatgatcaggatacttgggactacacaaaccccaatctcagtggacaagggtcgcagtgtatgtttgatgggacgccatctttcagaactgtgctaactcactgttgaagcgtccaatggtgaccctggcagcaaccccaacaaacgccagaggcagccccctctcctgggagatcaccccgcagaatatggagggccccacggtgggtaccacagccattaccatgatgagggctacgggccccccccacctcactacgaagggagaaggatgggtccaccagtggggggtcaccgtcggggcccaagtcgctacggcccc

SEQ ID NO: 920 - DNA, 1259 bp, Homo sapiens
ggattcgatcctgcgcgacggccgcgaaggcgggggcggaggctcggcctgcgcggctgggagcggcttaggggaggagggaagaccggaagccacggttgcgtccccatccttagattcgctcctccgggcagggagcggagacggaggaggaggagggagaggctgaatgttggctcggtaattgagaggagcggccgctccagagcttcctcccggggcgcccccctcagtccgtccgcgcttctcagccgccagtctcctggccgcgcagtccccgcggacggccgggccgcggagaccctcgcagaagaggcgctgccggcggcgaggactggccggcggcatccgaggcgcgcgccccaccgccacccccacccgcctgccagccggtccctccggccgccgccatgtcctcctcctcttcctcccccagggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatgcttatgtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgaggttgttgttggcttatgctgaaacttcttgaaagaagcccactttga

SEQ ID NO: 921 - DNA, 2523 bp, Homo sapiens
atgtcctcctcctcttcctcccccagggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatgccaactcgtctaaatgttattaggaatgacaatgacagttgggactacactaaaccatatttgggaagacgagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaattgttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgaatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaatttgttgtaagcttaaatattgaattgttttcattttaagatagaatatcataatgtagactatctacagcttcattgtagattatacagatatatgatttctaaccttattactggaatttttcttccacagtaaaaatatatttgcattcttaatgctaattatctgcaagtattttttcattgtgtaagagattaatgcaggtgaaagtattgcattttaatatagaattcctattatatgtttagatgtttaagtatgttgcagttactcatattaaacataacttgtatatttattattttaatgaagtttgagaataacgttacatatgttgaattttaagtactacagatttaactgattttatatttctgaaaggctaacagacatggatacacgtgtacagtatgcattcaaacttatttaaattggtgtatttttttttaagtcactgtccatttgtattgacatgcctctgtttctagtccagtttggagattttataaagttataacaatgagttaatgtgttcattttcatttgttgcatgtgacttaaatacagctagtatttggcattgagattttaatagaggttataattaacagttcctcttatagataataatctgggatccatgggtgggcttcagagaatctgtgtaccccctaaaattgtatgtagaattttggatatttacatttttattttttaactcttggatccatcagtaatatgtatttttctatatggtacaagatttaaggatctaattttatttttattccaaacagatagctatttgtctcaataccatttattaaacattctttctcccactg

SEQ ID NO: 922 - DNA, 1908 bp, Homo sapiens
ggtaattgagaggagcggccgctccagagcttcctcccggggcgcccccctcagtccgtccgcgcttctcagccgccagtctcctggccgcgcagtccccgcggacggccgggccgcggagaccctcgcagaagaggcgctgccggcggcgaggactggccggcggcatccgaggcgcgcgccccaccgccacccccacccgcctgccagccggtccctccggccgccgccatgtcctcctcctcttcctcccccagggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggttgatcgtctaaatgttattaggaatgacaatgacagttgggactacactaaaccatatttgggaagacgagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaattgttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgaatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaa

SEQ ID NO: 923 - DNA, 3980 bp, Homo sapiens
atcctgcgcgacggccgcgaaggcgggggcggaggctcggcctgcgcggctgggagcggcttaggggaggagggaagaccggaagccacggttgcgtccccatccttagattcgctcctccgggcagggagcggagacggaggaggaggagggagaggctgaatgttggctcgggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggttgagtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaattgttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgaatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaatttgttgtaagcttaaatattgaattgttttcattttaagatagaatatcataatgtagactatctacagcttcattgtagattatacagatatatgatttctaaccttattactggaatttttcttccacagtaaaaatatatttgcattcttaatgctaattatctgcaagtattttttcattgtgtaagagattaatgcaggtgaaagtattgcattttaatatagaattcctattatatgtttagatgtttaagtatgttgcagttactcatattaaacataacttgtatatttattattttaatgaagtttgagaataacgttacatatgttgaattttaagtactacagatttaactgattttatatttctgaaaggctaacagacatggatacacgtgtacagtatgcattcaaacttatttaaattggtgtatttttttttaagtcactgtccatttgtattgacatgcctctgtttctagtccagtttggagattttataaagttataacaatgagttaatgtgttcattttcatttgttgcatgtgacttaaatacagctagtatttggcattgagattttaatagaggttataattaacagttcctcttatagataataatctgggatccatgggtgggcttcagagaatctgtgtaccccctaaaattgtatgtagaattttggatatttacatttttattttttaactcttggatccatcagtaatatgtatttttctatatggtacaagatttaaggatctaattttatttttattccaaacagatagctatttgtctcaataccatttattaaacattctttctcccactggatctgttttttttttctttttaagataatagattttatacataggcaagtaagatttaaggaccaaacatggtattaagagactatagcacgattgttaccaagttcacagcttttttacaatagaaaaactgatgtggccattttgttttcatctttaaaagaagggagaatatgtgtcatctacctagaataactgatatcagtagttgacaatatcagttttgtaatcctgacacttttaaacaaatttgtaaatgaaagttccatttagatcttttgtaaagactttattttaaattttaatataaaaaatccttttagaaataaggcaggcatttacaattttagagctgtttaataggaagtttagatggaaactaaacacacattaacatttatttcccctcattttgatggcagtggaccagcatttagccctctaaagataaagaaaaaattaaatttaatctagaagtattttagacccttatcacagaacccagtaagttatgccaagggtaactgtgtgaactgtgttcgatactgggctatgtatgtttcttattcattgccaatttaatacctaagtttatctaactttacaataaagctttttttcccctataaatacttttctacctcttttgaaaaattgaaataccttaattttggtttatgtaatagttgtctacgttccttcctcctctgaaaattaatgtgggttgtcagaattacagactttttaatgcctaagattttaagaaataaacctgtaggtgttggcaggacttatttcatttagattttaattagtttagatgtgtagaaatgatttttatctgtaaggctctctctccaccaaaataagtgaattgtttgggagtaaactagttggtaagttgggccttgctgatagatttatacactggtgtgtaagccctatactgctgctgtcactaatgtttttgatagtttacttaggcatgactgctgttaatgaagtttgctttgtgaatactctctctttccttagccttggcaacattcttctctgtgctatctttatgcttttagaagaactagaaaaagcagatttaagaactgtaaagaaataatactagctttgagtttttaaaaaaaatattgaaatcccatctctgtatccaaatcctactacacatttgataataaatctgccaaactga

SEQ ID NO: 924 - DNA, 1687 bp, Homo sapiens
catccttagattcgctcctccgggcagggagcggagacggaggaggaggagggagaggctgaatgttggctcgggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatggttgagtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgaggtaggtattttatacattttagaatgtacttgatctgctgacaaatttttatatgcagttagattcttttttcctgagatgagctagttaattcaaatgaaaaccttgttgatgaatgcttttgttgcaaaaggccatgtaatgctggaaaataaccttgaacattagtgccccctactggtatgtactgagctatttatatttagttcaacaaggagcccacacattcaggcacgcccgcagttcaaggacttgcatttctccaagcagctctctctctttggaggagaggaaactgattcagaatattccttacaaactgcaaacttgcacactgcttctctatggaaaggactttcccccaagctggacgaggcattaagaaggatagaggactccagcaggctgactctacacttcatcatgcacaacatcggcatcagcaaaaagccctctgaaaaactcagactcgcaattcaccttgactgcatactgcatgcaccatcaccccaagtttttaaaggaggacacttaacagtacttcagaattgcatgggatgaacaccatgatagactgtgcccatttatacaagttgtatgtatatattggtctgatttcccttaaggtttcagttgtagaatttaagactttccactaacggaaactagacttcatctgcaatgttgtaaatcttaatgcccattactgtgactgtgtgcagcttagattcaaattgttaattggcaaataaccaggaccagtttattaacaggtcttgggaattgataatgctcaaccaatccacacagatagaaaaataaaaggattagaaaggtg

SEQ ID NO: 925 - DNA, 4173 bp, Homo sapiens
ggggaggagggaagaccggaagccacggttgcgtccccatccttagattcgctcctccgggcagggagcggagacggaggaggaggagggagaggctgaatgttggctcggtaattgagaggagcggccgctccagagcttcctcccggggcgcccccctcagtccgtccgcgcttctcagccgccagtctcctggccgcgcagtccccgcggacggccgggccgcggagaccctcgcagaagaggcgctgccggcggcgaggactggccggcggcatccgaggcgcgcgccccaccgccacccccacccgcctgccagccggtccctccggccgccgccatgtcctcctcctcttcctcccccagggagacgtacgaggaggaccgggagtacgagagccaggccaagcgtctcaagaccgaggagggggagatcgactactcggccgaggaaggcgagaaccgccgggaagcgacgccccggggcgggggcgatggcggcggcggcggccggagcttctctcagccggaggcaggtggaagtcatcataaagtttctgtttcacccgtcgtccatgttcgaggactctgtgaatctgtggtggaagcagacctcgtggaagcgctggaaaaatttgggacaatatgctatgtgatgatgatgccatttaaacgacaggctctagtggaatttgaaaacatagatagtgccaaagaatgtgtgacatttgctgcagatgaacccgtgtacattgctggtcaacaggcttttttcaactattctacaagcaaaaggatcactcggccaggaaatactgatgatccatcaggaggcaacaaagttcttctgctctcaattcagaatccgctttatccaattacagtggatgttttatatactgtatgcaaccctgttggcaaagtgcaacgtattgttatattcaagagaaatgggatacaagcaatgcttatgtttgaatcagtcctttgtgcccagaaagctaaagcagcactcaatggagctgatatatatgctggatgttgcacactaaaaattgaatatgcacggccaactcgtctaaatgttattaggaatgacaatgacagttgggactacactaaaccatatttgggaagacgagatagaggaaagggtcgccagagacaagccattttgggagaacacccttcttcgtttagacatgatggctatggatcccatggtccattattgcctttaccaagtcgttacagaatgggctctcgagatacacctgaacttgttgcttatccattaccacaggcttcttcctcttacatgcatggaggaaatccctctggttcagttgtaatggttagtggattacatcaactaaaaatgaattgttcaagagtcttcaacctgttctgcttatatggaaatattgagaaggtaaaatttatgaagaccattcctggtacagcactggtagaaatgggtgatgagtatgctgtagaaagagctgtcacacaccttaataatgtcaaattatttgggaaaagacttaatgtttgcgtgtctaaacaacattcagttgttccaagtcaaatatttgagctggaggatggtaccagcagctacaaagattttgcaatgagcaaaaataatcgctttacaagtgctggccaagcatctaagaatataatccagccaccctcctgtgttttgcattattataatgttccattgtgtgtcacagaagagaccttcacaaagttgtgtaatgaccatgaagttcttacattcatcaaatataaagtgtttgatgcaaaaccttcagccaaaacactttctgggctattagaatgggagtgcaaaactgatgcagtagaagcccttacggcactgaatcactatcagataagagtgccgaatggttccaatccctatacattgaagctttgcttttctacatcatcccatttataagaagagaagagcatgttagaatttatgttcacctttattacaatttcaaagctacacttcattaaaaaaaaatctaaaatggttgatctcatgttgccttgcttactttaagatcctgttctgtaataaacatattttgccttgagtaaatttgttgtaagcttaaatattgaattgttttcattttaagatagaatatcataatgtagactatctacagcttcattgtagattatacagatatatgatttctaaccttattactggaatttttcttccacagtaaaaatatatttgcattcttaatgctaattatctgcaagtattttttcattgtgtaagagattaatgcaggtgaaagtattgcattttaatatagaattcctattatatgtttagatgtttaagtatgttgcagttactcatattaaacataacttgtatatttattattttaatgaagtttgagaataacgttacatatgttgaattttaagtactacagatttaactgattttatatttctgaaaggctaacagacatggatacacgtgtacagtatgcattcaaacttatttaaattggtgtatttttttttaagtcactgtccatttgtattgacatgcctctgtttctagtccagtttggagattttataaagttataacaatgagttaatgtgttcattttcatttgttgcatgtgacttaaatacagctagtatttggcattgagattttaatagaggttataattaacagttcctcttatagataataatctgggatccatgggtgggcttcagagaatctgtgtaccccctaaaattgtatgtagaattttggatatttacatttttattttttaactcttggatccatcagtaatatgtatttttctatatggtacaagatttaaggatctaattttatttttattccaaacagatagctatttgtctcaataccatttattaaacattctttctcccactggatctgttttttttttctttttaagataatagattttatacataggcaagtaagatttaaggaccaaacatggtattaagagactatagcacgattgttaccaagttcacagcttttttacaatagaaaaactgatgtggccattttgttttcatctttaaaagaagggagaatatgtgtcatctacctagaataactgatatcagtagttgacaatatcagttttgtaatcctgacacttttaaacaaatttgtaaatgaaagttccatttagatcttttgtaaagactttattttaaattttaatataaaaaatccttttagaaataaggcaggcatttacaattttagagctgtttaataggaagtttagatggaaactaaacacacattaacatttatttcccctcattttgatggcagtggaccagcatttagccctctaaagataaagaaaaaattaaatttaatctagaagtattttagacccttatcacagaacccagtaagttatgccaagggtaactgtgtgaactgtgttcgatactgggctatgtatgtttcttattcattgccaatttaatacctaagtttatctaactttacaataaagctttttttcccctataaatacttttctacctcttttgaaaaattgaaataccttaattttggtttatgtaatagttgtctacgttccttcctcctctgaaaattaatgtgggttgtcagaattacagactttttaatgcctaagattttaagaaataaacctgtaggtgttggcaggacttatttcatttagattttaattagtttagatgtgtagaaatgatttttatctgtaaggctctctctccaccaaaataagtgaattgtttgggagtaaactagttggtaagttgggccttgctgatagatttatacactggtgtgtaagccctatactgctgctgtcactaatgtttttgatagtttacttaggcatgactgctgttaatgaagtttgctttgtgaatactctctctttccttagccttggcaacattcttctctgtgctatctttatgcttttagaagaactagaaaaagcagatttaagaactgtaaagaaataatactagctttgagtttttaaaaaaaatattgaaatcccatctctgtatccaaatcctactacacatttgataataaatctgccaaactga

SEQ ID NO: 926 - DNA, 5106 bp, Homo sapiens
acgaaggagaagcaaacactgcgcagcgggaccgtgcgcggcctccgctcctgcgtgcgtgcgctcgctcgcgcgggctcagtgctggcgcgtgaggcggaggcgggcggcggcggcggcgcctgcgcggtcggactcggtcgacggttcgcaggggaggaggcggcgggaggcggaggaggcggcggcggcgatggaggtgaagcggctgaaagtgaccgagctgcggtcggagctgcagcggcggggcctggactcgcgcggcctcaaggtggatctggcgcagcggctgcaggaggcgctggacgccgagatgctcgaggacgaggccggcggcggcggggccgggcccggcggggcctgcaaggcggagcctcggcctgtggccgcgtcgggcggcggcccgggcggggacgaggaggaggacgaagaggaggaggaggaggacgaggaggcgctgcttgaggacgaggacgaggagccaccccctgctcaagccttgggtcaggccgcgcagccgccgccggagcccccggaggcggcagccatggaggccgcggccgagccagatgcttccgagaagccggcggaggccacggccgggtcaggcggggtaaatggtggcgaagagcagggcctcggcaagagggaggaagacgaacccgaggagcggagcggggacgagacgccgggatccgaggtgccgggtgacaaggccgccgaggaacagggagatgaccaggatagtgaaaagtcaaaaccagcaggctcagatggtgagcggcggggggtaaagagacagcgggatgagaaggatgaacatggccgagcttactatgaattccgagaggaggcttaccacagccgctcaaagtctccactgcctcctgaagaagaggcaaaagatgaggaggaggatcaaactcttgtgaacctggacacgtatacctcggatctgcattttcaagtgagcaaagaccgctatggagggcagccacttttctcagagaagttccccaccctttggtctggggcaaggagtacttacggagtgacaaagggaaaagtctgctttgaggcaaaggtaacccagaatctcccaatgaaagaaggctgcacagaggtctctctccttcgagttgggtggtctgttgatttttcccgtccacagcttggtgaagatgaattctcttacggtttcgatggacgaggactcaaggcagaaaatggacaatttgaggaatttggccagacttttggggagaatgatgttattggctgctttgctaattttgagactgaagaagtagaactttccttctccaagaatggagaagacctaggtgtggcattctggatcagcaaggattccctggcagaccgggcccttctaccccatgtcctctgcaaaaattgtgttgtagaattaaacttcggtcagaaggaggagcccttcttcccaccaccagaagagtttgtgttcattcatgctgtgcctgttgaggagcgtgtacgcactgcagtccctcccaagaccatagaggaatgtgaggtgattctgatggtgggactacccggatctggaaagacccagtgggcactgaaatatgcaaaagaaaaccctgagaaaagatacaatgtcctgggagctgagactgtgctcaatcaaatgaggatgaagggtctcgaggagccagagatggaccccaaaagccgagaccttttagttcagcaagcctcccagtgccttagtaagctggtccagattgcttcccggacaaagaggaactttattcttgatcagtgtaatgtgtacaattctggccaacggcggaagctattgctgttcaagaccttctctcggaaagtggtggtggttgtccctaatgaggaagattggaagaagaggctggagttgaggaaggaagtagagggagatgatgtgcctgaatctataatgctggagatgaaagccaacttctctttgcctgaaaaatgcgactatatggatgaggtgacatatggggagctggagaaggaggaagctcagcccattgtcactaagtacaaggaggaggcaaggaagcttctgcccccctccgagaagcggacaaatcgccgaaacaaccgaaacaagcgtaaccggcagaaccgaagccggggccaaggctatgtgggcgggcagcgccgaggctacgacaaccgggcctacgggcagcagtactgggggcagcctggaaacagagggggttaccgtaatttctatgatcgatacaggggagactatgatcgattttacgggcgagattatgagtacaacagatacagagactattacagacaatacaatcgggattggcagagttactactaccaccacccccaggacagagaccgatactacaggaattactacgggtaccaagggtatcggtgaagcccctgccatggtcacctgtcagccatgaagctgaatctctgggggtgccaggcacccccgcaaaacacaaccaaggaaaacaggggctgtcggggtggggctgagctgccggggaggggtggtggggggggagggtgctcaagcaggggtgggggaggggggaggtggaaacaaacaacaaaactgtacattttttttaaagtttgttgaaaagaatattgtcttattctataaaacatttcaaacctagttagagatttgtaatcaaaaaacatttgcgcagaaagcagcacttagggctgcctgttctataccctacagtcagacaggaaaagaactgaaaatggcacccttctgacattctgaggcagctggactggcagccaagtaaaggagagtgatgaggtggtgtggggagggtggggaggcagcgcgagggtgctctccacagcaggtaggagcaggcaggagtggggacagagggagagcttgtgactgggacagtgaaaataaacgattggctcttatcaatcacttgcaccaactaaccgtttgtattttctttaccgacctttcccttttgggatatgtggtctggtgggctgggaggcttacagtgtcccaactctccattttcctgtgcctttgtgctgtttggctgaggcatggagactgccagtgggtggttctattttacaggattcccaggccaagaaagcctggggactgtccttgatggcagagcagaatagcctgccccttctatagacccattgattaattcctgtaaaatcttggggagaatgggattgcagccctcagcctaaagattgtgatttgccagtctctagtctctgtcttccaaggttgagagaggtgggaggtctctgaaatcatccctgttagagtgtctgtcctcttacagtgcgagagaaggaacgtttctcagggtttcagctcacacgaaaacacagcaggattcttttcactgcagcgggatatgtatataggtgaatcctgtggtgtgggctcacaggcccaggtgctgagaatagcaactagcaactattttctacagtgtggagggctcgtgccctgctggtttttttgatacacaggtagagaatgaatagaagaggggagggtggtgggggggggtgggaggcagctcagtggggctgctgaaccttgggaagagtgtgagtgtgaacgtgtgtaaatgtgcgtgtgaaagggagcaccccttcccgacttctagaaacaaaattccttttggggcgctttccctgtgtgtccccagagaggcctctagccaggagccttcagttgggatagtttcatttgtgactttaccaataccctcccagttcttgatagacagctgtaggttgctgggttcaagaatatgggtgggatatggaatgctctttcaatgtctagcttcagttttcattcatcctcctgctcagcactgtcagccaagagcttactcagcagacaccacatactgcagcagttcctagtgagaaaatctgtgccactagaaaatgcttcacttccatttcctcacctgggcagttctctgtttaaaattgtgggctgatttggtcttcctctcctcctcccactgttactgccctgcagcccttgttcaggtgtacagacccttattctggcctctagtgtccttgtctgtcatgacacacccttccgcccaaatacctctgaccccaaggctggaatggggctggtaggagataagtttgcttactcatagtcatgtcctttctcttggcacctgcttccctgcggtgtcctcaaatggatttctgtgtggcagtggagtgattgcatgaatttttctgtaacacattaactttgtattattattaagggagtttgagaaagctttgcttataatgtcaaggcaaggaggtaaaaactggagcccaaagaaattcccttagggcaagattatgttataatagaaaattgaatttcctgaggcagtggctgccaccccttttcagatgtttagtcctgcaaatagcatctttcttgtagtctgtgacatggatggggatgctagggcccttaggggcaaggggactaaactaaatcaagttgagtttttttccagcaggggttaggggaggtactcgctgttgatatttgacactagaaagtaatcttttttacaaaactgtttttctaggtgggtggaaagtgaaactgccacatccttgttggtttagtccaagagatcatttgcaacaacagtagatgtccgggttttgtttctgtctttttattatgaaaaactatgttaagggggaaaatgtggattatggtaaccagaggaatccctagccttgttttccttagaagacttgtttagtgttttatcagacgtctgttgtagttgtagacaggaaagcttgtgagaaaaacaccacatggagcctgtaaatgtttttgcacaacctgtaaagcattcttggaagtggccagtaaaaaggggttttaccatttaaaaaaaaaatgtaactgtgtcattgtttacatctgtaactttttcctcccctgttctcattacaccattctggcgaaaatgtaggcaaagtagcttccagttttagaataaataaccatttggattgaattca

SEQ ID NO: 927 - DNA, 2343 bp, Homo sapiens
aagtggtgtctgccagatttccccgctgtaaagttactatttgtccctttccatgttctattcattagtagtgggtggctaagtccagcccacactggagagggggagtgccatctgtttttattcctatcatttcaatttgtttaatcctcatggctttattatcacctcactactttttagagatatggttgtaatgagctagacttgcccaaagttactcagctagtaaatggcaaagctagaatttgaacttatatgtgtctggcttaaaaggccatgttctttccacttcatgttactgccaccaagtaaagaggatctcacagtctctgaggcggaagctccctctcagcttgtctggacagtgtttttcaaatccattcttggagtgtgacccatcagtgggtcatgagaagatgaacactgaagtcttggaaccctgggaatgaacctggaaaaattcaaaatatggtctagtcttaggcaagtttccttgtccggctcagctgctgagaccacatatctggaccctcagtgccctggcaacagctctgtgcaggcaggatgaagcacaggcttaggtcaagcaatcagccgtcaaaatccacactctcacctgtgagtggctgttcaaccttgaacatgttactttttatgttaatgaaactcagttttctagtcctataaatttggggctatcatcaaccattaagtgatattaaacccagtgccacacaggcaagtacctagcagtgtccaaaggcccccagaatgacactttttcatcttttctcttccctccaattgaaagactagtggaatatctgcaattactttgaccaaaagccagaagccggccagtttgagtgtagctgttacagctttgtgttctaaacctaagaaatggggacccctcacatgagagtggggaggcttctggatgtgctacaaattccatttcattttcatgaactccagtgttaattaataaaatctcaaggttctcccccctctttcgcctcacatttcttcagagaaatgaagagttccaactcatagcccaagtgctcaggttttaaattagacaactttgtcctgacaggaaccaagtcacagctgtcatacctgattacttttagagttactactaaaccctttgtatggcatgagctgccactgttcaaggcaaacagaaacacttcacattttatcatgacagccctggatctatccacctccccatgttcattatgctcagcctgtctttggaagggatgatgaggcatcctgaaaatcgtatagtgaggaaggcagaccccatggcctgtcactacagcctagggattttaagcccctaaagtgcagcaaaacccactgcctccaggaagccaaggagaattatttctgggggacatagctgcctcatagcctactatgaatgaaccatcatctttcatgagaggcaaacattgaccctcaagtaaccaaccaatacgagcacctgtacacaaatgcccacaggtgttggctgggattggctggcttgtggatgatgtcacagtttccctcctctgactcaacaatgccatcagcactgaaaaggctgagccctgactacagctcttgcagacagaaaaattcgctgcaagtacagcactttctagattgctcctggagtgtgggaacaacagtctctcctgtccacgttactgaatccagaaaaaaggtgaacttacgaacatgggaaaagaaatccagctaaagcctaaggcaaatgtctcttcttacgttcactttttgctgaattacagaaacaaattcaaggagcagcagccaaatacctatgttggctttaaagagttctctagaaagtgttcggaaaaatggagatccatctcaaagcatgaaaaggccaaatatgaagccctggccaaactcgacaaagcccgataccaggaagaaatgatgaattatgttggcaagaggaagaaacggagaaagcgggatccccaggaacccagacggcctccatcatccttcctactcttctgccaagaccactatgctcagctgaagagggagaacccgaactggtcggtggtgcaggtggccaaggccacagggaagatgtggtcaacagcgacagacctggagaagcacccttatgagcaaagagtggctctcctgagagctaagtacttcgaggaacttgaactctaccgtaaacaatgtaatgccaggaagaagtaccgaatgtcagctagaaaccggtgcagagggaaaagagtcaggcagagctgatggatccagtttgaaaaaacaaaatgccattcaaccgta

SEQ ID NO: 928 - DNA, 2505 bp, Homo sapiens
ctgtaaagttactatttgtccctttccatgttctattcattagtagtgggtggctaagtccagcccacactggagagggggagtgccatctgtttttattcctatcatttcaatttgtttaatcctcatggctttattatcacctcactactttttagagatatggttgtaatgagctagacttgcccaaagttactcagctagtaaatggcaaagctagaatttgaacttatatgtgtctggcttaaaaggccatgttctttccacttcatgttactgccaccaagtaaagaggatctcacagtctctgaggcggaagctccctctcagcttgtctggacagtgtttttcaaatccattcttggagtgtgacccatcagtgggtcatgagactgcaatcaagatgtttgaaaatactgaactcacatctgtagacgaggagttggcagatttacgacccccagcttgcagcctattttttaaaaataaggttttattggaacatagccacactcattggtttagaaaggagctgtgtcccattcatctaggcagccctgctcatgtccaaaaaatgtaagatgaacactgaagtcttggaaccctgggaatgaacctggaaaaattcaaaatatggtctagtcttaggcaagtttccttgtccggctcagctgctgagaccacatatctggaccctcagtgccctggcaacagctctgtgcaggcaggatgaagcacaggcttaggtcaagcaatcagccgtcaaaatccacactctcacctgtgagtggctgttcaaccttgaacatgttactttttatgttaatgaaactcagttttctagtcctataaatttggggctatcatcaaccattaagtgatattaaacccagtgccacacaggcaagtacctagcagtgtccaaaggcccccagaatgacactttttcatcttttctcttccctccaattgaaagactagtggaatatctgcaattactttgaccaaaagccagaagccggccagtttgagtgtagctgttacagctttgtgttctaaacctaagaaatggggacccctcacatgagagtggggaggcttctggatgtgctacaaattccatttcattttcatgaactccagtgttaattaataaaatctcaaggttctcccccctctttcgcctcacatttcttcagagaaatgaagagttccaactcatagcccaagtgctcaggttttaaattagacaactttgtcctgacaggaaccaagtcacagctgtcatacctgattacttttagagttactactaaaccctttgtatggcatgagctgccactgttcaaggcaaacagaaacacttcacattttatcatgacagccctggatctatccacctccccatgttcattatgctcagcctgtctttggaagggatgatgaggcatcctgaaaatcgtatagtgaggaaggcagaccccatggcctgtcactacagcctagggattttaagcccctaaagtgcagcaaaacccactgcctccaggaagccaaggagaattatttctgggggacatagctgcctcatagcctactatgaatgaaccatcatctttcatgagaggcaaacattgaccctcaagtaaccaaccaatacgagcacctgtacacaaatgcccacaggtgttggctgggattggctggcttgtggatgatgtcacagtttccctcctctgactcaacaatgccatcagcactgaaaaggctgagccctgactacagctcttgcagacagaaaaattcgctgcaagtacagcactttctagattgctcctggagtgtgggaacaacagtctctcctgtccacgttactgaatccagaaaaaaggtgaacttacgaacatgggaaaagaaatccagctaaagcctaaggcaaatgtctcttcttacgttcactttttgctgaattacagaaacaaattcaaggagcagcagccaaatacctatgttggctttaaagagttctctagaaagtgttcggaaaaatggagatccatctcaaagcatgaaaaggccaaatatgaagccctggccaaactcgacaaagcccgataccaggaagaaatgatgaattatgttggcaagaggaagaaacggagaaagcgggatccccaggaacccagacggcctccatcatccttcctactcttctgccaagaccactatgctcagctgaagagggagaacccgaactggtcggtggtgcaggtggccaaggccacagggaagatgtggtcaacagcgacagacctggagaagcacccttatgagcaaagagtggctctcctgagagctaagtacttcgaggaacttgaactctaccgtaaacaatgtaatgccaggaagaagtaccgaatgtcagctagaaaccggtgcagagggaaaagagtcaggcagagctgatggatccagtttgaaaaaacaaaatgccattcaaccgta

SEQ ID NO: 929 - DNA, 1964 bp, Homo sapiens
atcctcaccttccctcgccttcctgttcctggcggagccgggctccgctcgtcttctctgtcttagggctggtgctggccctgcccacgcctagggctccggcgcgtcacgggcctcagctgggattcccgcgcccctcggacggccacgagactcggacatctttccaggaacagcgtgaggaggacagaagcacccaacaggactgctcaagccacctgcgaacactgctgctaccatgcccaagagaaaggcaaaaggagatgctaaaggtgataaagcaaaggtgaaggatgagccacagaggagatcagctcggttgtctgctaaaccagctcctccaaaaccagagcccaggcctaaaaaggcctctgcaaagaagggagagaagcttcccaaagggagaaaggggaaagcagatgctggaaaggatgggaacaaccctgcaaaaaaccgagatgcctctacactccagtcccagaaagcggaaggcactggggatgccaagtgaaatgtacatttttgagagctctgtacttatagtgactctactgtttgaaatactatttttttaaatcaagttttataaaagtgtagaattttggcttttttaagttatgttgttagcacacaggacacttccttgttgtcttttgtggaaagggcaagtaccactaatagggtgtatctcagaaactgaattgaaataagggaaaataggattttctgtcctggtttttgaagattgttcttgattcccttgattcccaggagagattctctgacattcacgtgtcagccactttggcacggaagccttacagtgtggggaaccaaaacttcgtgtctcccctttccccgatgccatcagcatagacttgacttccttaaaccgagagttttgatgtggccttggcaaccctaaaatcagctgtgttaggtaacaaaactcaggctttctgttgatgacatcgagatggtgtcacttaaaagagccaagattcctgttttcagtttgtggattcatcctgctggttttactttagtccctccatgtcaaagtgggcctgagaaaagctcatacatgcctcatgtgaagtgtccaccctctctgaaaatctttcttgttcaaaacagcaacgacatatcttgttaacttttacggtgacttttggaggaggggagtttggaaattgtaaaatgttatagattgttgcctatttcctgctgaaagtaaatgtttttaaaaagtatcatataaagctgaatacaaattggtttggggggagatcctttcctacccaaagtcataaatatattctttactgccttgtggaaattttatagttttgcctttcacatttgtctttagtctgtcctgaactgatttttgtgaaaattatgagttagaaattcaacttaacatttttcatattcgaagtggttgtctctgcactatttactgaaaagttcatcctttccccagtgatttgtaacactgcctctttcataaattaaatttttgtgtatgtgtgtgggtcttttgatggtttctattctgactgacatcaatttgtctaatcttgtagcagtacagtacagtcctgattattgcaactttaggaaaaggtctgataaaaaccaagatgcctccacattttgtcataattgtaaccaatttcacctctgtctccagtatcaccacaaaattgttcttccttggagtgtcttggctattcttagccaactgttcctccatattacttctagaattagaccaacaatttataaatcaaacaaacccaagagcattgaaattttgattggatttgtattgaatttatagattaatctggtaaaccatgtcatctttacaatgttgtcttccaatacatgaatatggtacagctcttcatttacttaggcctttgaaatatctttcaataaagtttataattttctcc

SEQ ID NO: 930 - DNA, 1192 bp, Homo sapiens
gctggtgctggccctgcccacgcctagggctccggcgcgtcacgggcctcagctgggattcccgacatctttccaggaacagcgtgaggaggacagaagcacccaacaggactgctcaagccacctgcgaacactgctgctaccatgcccaagagaaaggcaaaaggagatgctaaaggtgataaagcaaaggtgaaggatgagccacagaggagatcagctcggttgtctgctaaaccagctcctccaaaaccagagcccaggcctaaaaaggcctctgcaaagaagggagagaagcttcccaaagggagaaaggggaaagcagatgctggaaaggatgggaacaaccctgcaaaaaaccgagatgcctctacactccagtcccagaaagcggaaggcactggggatgccaagtgaaatgtacatttttgagagctctgtacttatagtgactctactgtttgaaatactatttttttaaatcaagttttataaaagtgtagaattttggcttttttaagttatgttgttagcacacaggacacttccttgttgtcttttgtggaaagggcaagtaccactaatagggtgtatctcagaaactgaattgaaataagggaaaataggattttctgtcctggtttttgaagattgttcttgattcccttgattcccaggagagattctctgacattcacgtgtcagccactttggcacggaagccttacagtgtggggaaccaaaacttcgtgtctcccctttccccgatgccatcagcatagacttgacttccttaaaccgagagttttgatgtggccttggcaaccctaaaatcagctgtgttaggtaacaaaactcaggctttctgttgatgacatcgagatggtgtcacttaaaagagccaagattcctgttttcagtttgtggattcatcctgctggttttactttagtccctccatgtcaaagtgggcctgagaaaagctcatacatgcctcatgtgaagtgtccaccctctctgaaaatctttcttgttcaaaacagcaacgacatatcttgttaacttttacggtgacttttggaggaggggagtttggaaattgtaaaatgttatagattgttgcctatttcctgctgaaagtaaatgtttttaaaaagtatcatataaagctgaatacaaattggtttggggg

SEQ ID NO: 931 - DNA, 2126 bp, Homo sapiens
aatagcaccgcgagatctgttgaaacattgatttttgacgattccttccctgagaagagggcgaggagaagaagaaagaaaaaggagaactgaattgaattagattagcatgaaggaccttttcacgcggagactaaaagtactgcgcataacttcctgctcagaaatatatgcaaataagaagacagatcctgaaagagcaagctaggagagtacaggtcgtgctgcagttagttcattgaaaactcatttgctcttggagcagtcaggcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagtaaaagaagaaaatattgaagatgccacagaaaagggaggagaaaagaaagaagcagtggcagcagaagtaaaaaatgaagaagaagatcagaaagaagatgaagaagatcaaaacgaagagaaaggggaagctggaaaagaagacaaagatgaaaaaggggaagaagatggaaaagaggataaaaatggaaatgagaaaggagaagatgcaaaagagaaagaagatggaaaaaaaggtgaagacggaaaaggaaatggagaagatggaaaagagaaaggagaagatgaaaaagaggaagaagacagaaaagaaacaggagatggaaaagagaatgaagatggaaaagagaagggagataaaaaagaggggaaagatgtaaaagtcaaagaagatgaaaaagagagagaagatggaaaagaagatgaaggtggaaatgaggaagaagctggaaaagagaaagaagatttaaaagaagaggaagaaggaaaagaggaagatgagatcaaagaagatgatggaaaaaaagaggagccacagagtattgtttaaaactgccctatgtagtttcataatttggtaacatgtaccttcatgttgtaaagttaatagagataaatatttttatcaaaaattttataaacacagcctttctttagcattgatttaatttcagaacatcttcatattgattattagccataaagtttctaacatgaaacatttatctataaattttgtgattatagtagtggaatacatagaaaaaaatatgctttcaactttgtgagtgaatttcgtgttgtgtaagttatatgtcaaatctttgaattttaattttactcttttatacatgtgataatttcataaagtgagggatcccaaaaaaagagtttcatccaacattcttgttctgcaggttgcttttataaagaaggtgaactattttcatgtaatgttaagagttaaacttatctttcccaaatataactttattattagcttgggaaaaatgaaattgtattcccatttttaaaataaatacaaatgtttatttcagaagggcagttttgattatatgtgaatacacaaattttactggatttatcttaataaaaagactctgacgatgattgtgttttgttatatcttcaaaaatatagctagtgaaatattgtgcttaatttttttctattgtgttattcatgaaaatatttaatattcactgacataaaattaatataaagtaaaattcaccattttaattataataaaaataaagtatataattcaatggttgtcagtatattcacaatgttgtgtccactgtttaattccagagaatttttatcacccaaataagaaacaaagcaccaattagcagtctcttcccattttcgcccaacttatcccccacctccatcccttggcaaccactaatctgccttctatctctatggatttgcctattctgaacatttattataaatggaatcacat

SEQ ID NO: 932 - DNA, 572 bp, Homo sapiens
gaaaactcatttgctcttggagcagtcaggcagtgactgccttcggctttttttctgctgactaagatctcctatagagagctacaacaatgcccaaaagaaagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagtaaaagaagaaaatattgaagatgccacagaaaagggaggagaaaagaaagaagcagtggcagcagaagtaaaaaatgaagaagaagatcagaaagaagatgaagaagatcaaaacgaagagaaaggggaagctggaaaagaagacaaagatgaaaaaggggaagaagatggaaaagaggataaaaatggaaatgagaaaggagaagatgcaaaa

SEQ ID NO: 933 - DNA, 578 bp, Homo sapiens
tttttttccagaggagagtacaggtcgtgctgcagttagttcattgaaaactcatttgctcttggagcagtcaggcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagtaaaagaagaaaatattgaagatgccacagaaaagggaggagaaaagaaagaagcagtggcagcagaagtaaaaaatgaagaagaagatcagaaagaagatgaagaagatcaaaacgaagagaaaggggaagctggaaaagaagac

SEQ ID NO: 934 - DNA, 859 bp, Homo sapiens
gatttttgacgattccttccctgagaagagggcgaggagaagaagaaagaaaaaggagaactgaattgaattagattagcatgaaggaccttttcacgcggagactaaaagtactgcgcataacttcctgctcagaaatatatgcaaataagaagacagatcctgaaagagcaagcttatgacatccctttcccttctcaagtggacactgctatgctctcacccctcactcagaactaagagtctccagatgcttcctgcccttgaacattggaatacaagttcttcagctttgggactcttggaccttcgaccacagactgaaggctgcactgtcggcttccctatttttgaggttttggaacttggactggctttcttgctcctcagcttgcagacagcctaatgtgggacttcatcttgtgatcgtaggagagtacaggtcgtgctgcagttagttcattgaaaactcatttgctcttggagcagtcaggcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagtaaaagaa

SEQ ID NO: 935 - DNA, 742 bp, Homo sapiens
ttttttttttttccagaggagagtacaggtcgtgctgcagttagttcattgaaaactcatttgctcttggagcagtcaggcagtgactgccttcggctttttttctgctgactaagatctcctatagagagctacaacaatgcccaaaagaaagatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagtaaaagaagaaaatattgaagatgccacagaaaagggaggagaaaagaaagaagcagtggcagcagaagtaaaaaatgaagaagaagatcagaaagaagatgaagaagatcaaaacgaagagaaaggggaagctggaaaagaagacaaagatgaaaaaggggaagaagatggaaaagaggataaaaatggaaatgagaaaggagaagatgcaaaagagaaagaagatggaaaaaaaggtgaagacggaaaaggaaatggagaagatggaaaagagaaaggagaagatgaaaaagaggaagaagacagaaaagaaacaggagatggaaaagagaatgaagatggaaaagagaagggagataaaaaa

SEQ ID NO: 936 - DNA, 720 bp, Homo sapiens
gagggcgaggagaagaagaaagaaaaaggagaactgaattgaattagattagcatgaaggaccttttcacgcggagactaaaagtactgcgcataacttcctgctcagaaatatatgcaaataagaagacagatcctgaaagagcaagctatgcttcctgcccttgaacattggaatacaagttcttcagctttgggactcttggaccttcgaccacagactgaaggctgcactgtcggcttccctatttttgaggttttggaacttggactggctttcttgctcctcagcttgcagacagcctaatgtgggacttcatcttgtgatcgtaggagagtacaggtcgtgctgcagttagttcattgaaaactcatttgctcttggagcagtcaggcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagag

SEQ ID NO: 937 - DNA, 6200 bp, Homo sapiens
attgtctgaagcggcactggagacccaggaaaaatctcgctgaatccgcctgccccagcagcggcctgatctgggttccgctgattcctttcgtaaccgcaccacacccgagatgaatctacgttctgtatttactgtagaacaacaaaggattttacagcgttattatgaaaatggaatgacaaatcaaagtaaaaattgctttcagctcatattacagtgtgcacaggagactaagctggacttcagtgtagtcaggacgtgggttggcaataagagaagaaagatgagtagtaagaactctgaatctggaacagcaacaacaggaacctctttgtcagctccagacatcacagtcagaaatgtggttaatattgctcgaccctcaagccagcagtcttcttggacatctgccaataatgatgtcattgtaactggtatatacagtccagccagttcatcaagtaggcaaggaacaaacaaacatacagacacacaaattacagaagcacataaaatccctattcagaaaacagccactaaaaatgatactgagtttcagttacacattcctgtccaaagacaagtagcacactgtaaaaatgcttccctactcctaggtgaaaaaacaattattttgtcaagacagacaagtgtgctaaatgctggaaactcagtattcaatcacgcaaagaaaaactatggaaactcttcagtacaagcttctgaaatgacagtacctcaaaagccttctgtgtgccaccgaccttgtaaaattgaaccagttgggattcaaaggtcatataagcctgaacacacaggcccagcattacataacttatgtgggcaaaagccaactattagagacccttactgtagaacacaaaacttggaaatccgtgaagtgttttcattggcagttagcgattacccccagagaattctgggaggaaatgccccacagaagcctagctcagcagaaggaaattgtttgtccattgcaatggagactggagatgctgaggatgaatatgccagagaggaagagctggcatcgatgagagcacagataccaagctattcgagattttatgaaagtggcagttcccttcgagctgagaaccaaagtacaaccttgcccggaccaggaagaaatatgccaaattcacaaatggtgaatattagagatatgtcagacaatgtactgtatcaaaacagaaactaccatttgacaccacggacctcattacatacagcatctagtacaatgtacagtaataccaatccattacggagtaatttttctcctcattttgcatcatcaaaccaattgagattatcacaaaaccaaaacaattaccagatttcaggaaaccttactgtgccttggattacagggtgttctagaaaaagagcactacaggaccgcactcagttcagtgaccgagacttagccacccttaagaagtattgggacaatggcatgaccagcctgggctctgtttgtagagagaaaattgaagctgtggcaactgaattaaatgttgactgtgaaatagttcggacttggattgggaatcgaagaaggaaatatcgtttaatggggattgaagttccacctccaagaggaggccctgctgatttctctgagcagcctgagtctggttctttatctgcactcacaccaggagaggaagctgggcctgaagtaggagaggataatgacagaaatgatgaagtatccatctgtttgtctgaaggaagctctcaagaagagcccaatgaagttgttccgaatgatgcaagggctcataaggaagaggaccaccatgcagtaaccacagataatgtgaaaatagaaattattgatgatgaagaaagtgacatgataagtaattctgaagtagaacaagtaaactctttcttggattataagaatgaagaagtcaaattcattgaaaatgagctcgagattcaaaagcaaaaatactttaaacttcagacttttgttagaagcttgatattagcaatgaaagctgatgataaggaacaacagcaggcactgctgtcagatttacctcctgaattagaggaaatggatttcaatcatgcctcactggagcctgatgatacctcattcagtgtatcttctttgtcagagaaaaatgtctcagaaagtttgtgatttcagttggagggaatatatgatacagtcttttggcttcgtaacaggtgtgcatttcaagataactgcattctgttgccctggtattctttagttgggaaaacacattgttgaaacggacgtattctgtgaagaatgtacaagatataatggctacagtgcaacaaaaatgtaggtgaaatttaaaagcattgtttgagagagtatttttttaactgatggaactctggaaaaaaattatatttaagtttcagcagtttaaccctgaaattcattatgtctaatttctaaccagagacaaaataactaaagacatttcagcattgcttatcaagttgctacagcttgattagtcttgtttttgtagccattacatcttctttcttcttctctccttttcctatcatccacttacactttttctcaggaaagtggactgaacatttaaaacaaaactttaaaaaattatttaactcattatttaatgagttctctgatttagtttttaacccctatgaaaatttgacttaaactaatgactgaaaattaaatgattacaggtatgtaattgtaaattgctggtgttcttctattatctaacccaaatatttgtgtgggggtggggaagcacaatggaaaggtaatttaaccaacataacgtcaaataaattacgaagtgtacagaaacaaaatgttgtcaaaattagtcttgatggggattcttcattactacaaatgacaagtattgatacgattgacattccagtagtaaatttgtatacctgggttagatgaagtgttacacaaatattttaaatttatcaccatctttataattcttttttagttcttacatgttatgaaacaggaagtcaaggtaagctgctgagattttttaaaaatttagtcattcagctttgccacaaaatttacctcatttccatatgaggcctgtacagagccatcagccaaggatagtattcaaaaagagttatactactttggttgtaaatcacagtcttctgaattccatgaatactattctatgagtacacacctaaaatgggcaagctacccagttttctattattagtaggtaccagatggcaacacactgtagactgttctttgtagttcttcctttctggagtaccagatggtattaccaagacccatagaagaaaaaatgtcagtttctccctaagcccacagtgtcatatatttgtgacttggcagtgtgcaattgtgttgcatggttaaattactatctatacctaaaagattaatgaagtagctggatggctgtttcagccatcaagtttctgtttccaatttgtttttaatttttgttggtacctagtaggtattcagatatttttaaaaatttgtaattagagccaaatttgatcttgaaatttactagtactaacttatgaacacagaaaggcagtcataaatgtctttacccttgaagtgtcccatcctcccacacacacaaataggtaagctcccactgatagtctttcattttgtcacttatttgtttatattgctgccatactactgatatggtccctttgttagtaggaatatttcagtgttcagatatgcttccttgagccatatggagttttgcaaacaatagttagtttttcttgctgacaagtcaaattccattcagagaaagcagcagagagtaacagagcctcagatattacgattaaatgtaccagtcacaccaactcctccatgagatgaagagtcgcccccatatacaacgaagttagaaaccacttattaagtagcatgaacaaattccaggccttcaagtctctcctagggtctgcttcatagtcattgagtttatctttcaaatataattacttctgcttcaatttaagccccttcttatttggttctcattgcaaattaactataggtatattctctcctacagcttttaacactatagattttatttgtcacgcatcagccattagtcactaaatcgaaaaatacttgttgagctcctgctatagagaagacactgtgctggacattggatttctcagcaagctgtaaacatcacaaataattatttctttttaacatcttctatgatattaataaaccatatttaagtagaatttttaatagatttaaggttctgctaggtgtgattcttagaaggattcctagtccacaattttgagagaaagcatagatgatctttttgtctctgtttaacatttcatcaaaatagaaactatataaatcataacaatacatttagaactccttttgtcttgaaatttgtgtttcagcaccagaatatttttcttcaccatcattggaattaaaacacttctaaaatgaaatgtggctattctgtagcaggaactgaaggaaatacctctatctatagaaaaagaatcataattgccagattgaaattattcatggtagactttgaaaaagatgtcaaggtcaagctttgaaaagttgttatgaagaaagtatattttttacatatgtagataggagttggttttgagatatgttagagcaggaaaaattatcagcttataattactcttgtggacatcttcatggctggggataaaaattaactaactagtgtttctttctttagggctttgagattattaaaacagaccttactatctgaaggctctctcagggagacagaagccaatgtggaaaaaaacaaaaaacaaaaaacaacaacaagaaaaaacttctttttttctttcaactacatttctatgtctgctttaagcttagaacagccaagcagtttttaagccagaaatgtgtatgtaagagcacttaccttccaaaatgtgtacatatgaaaaaaaaaggaaggtattttcttcttttcagccaagctaaacttattcacaagaaaatgagaattgcaattgctctggagaataggaaaattagcacatgcaaagaaaaccttaaaagaaaattggcctcttcatggaaactggggatgttttgtcctaaggtcagttatcaacagcaggatttttgtattgccattgcaagcatgtgatagaaatgtttgttattgttggagaagaaaaggctgagacccaattataccctgtactctttattcgaccaagacctcaaaagatgtcaaagaagccatttctccaaagacagcaacatctattgtgaggcactttcatattcagcagtctgtaagtttgtaggagaaaacataagtggttaatttaaaataattttgggctctaaaatggactttgttgccttttttggtgggggtggtgggaatcggattcagcccatttccaagggatagtttcttcatctcagacaactattttgtgatcctttttaaaagacattctgaaaactttaactcctgcccttcttccgtattacagttgtgttattccagaaatattgtctacttttttaatatattagattttcattcagatcttaaacatgcaaacatgtgataggttagctttttaagggagttatcagtaccactgtatctaaatgttaggtaaatgggtagatttctctttgaagttggtattttccttggcagacagcactgtatcatgctcttcaccaagctatgctctgtaatgctataatcaaggaggctactaacttgtgaacctacagtcaacacaccattgctgaaaacaaactttgattaagaacagatttgctagggggaaaaaagagtaaagtgatattttcaagcaaatataattaaaattgtttcattaaaatatatactgagtgtatattgctccacactgaaattttattttgcattaacttgttaagtaattcattttagcaatcctgcatcccattttactagtactacctctgaaatatactgtcaccttaaaaccacatcagactgtaatgtgaatttttgtagagtttttatttaaacttttatagaggcaataaatgatttccaactaataga

SEQ ID NO: 938 - DNA, 2839 bp, Homo sapiens
attgtctgaagcggcactggagacccaggaaaaatctcgctgaatccgcctgccccagcagcggcctgatctgggttccgctgattcctttcgtaaccgcaccacacccgagctacaatctctggacaaaattttaagagaaactccctcagaactcctaaaggtaaacaaaagcaggcagattgaggatggcagtcagaatatgaagtgaccatatatggacgtgggttggcaataagagaagaaagatgagtagtaagaactctgaatctggaacagcaacaacaggaacctctttgtcagctccagacatcacagtcagaaatgtggttaatattgctcgaccctcaagccagcagtcttcttggacatctgccaataatgatgtcattgtaactggtatatacagtccagccagttcatcaagtaggcaaggaacaaacaaacatacagacacacaaattacagaagcacataaaatccctattcagaaaacagccactaaaaatgatactgagtttcagttacacattcctgtccaaagacaagtagcacactgtaaaaatgcttccctactcctaggtgaaaaaacaattattttgtcaagacagacaagtgtgctaaatgctggaaactcagtattcaatcacgcaaagaaaaactatggaaactcttcagtacaagcttctgaaatgacagtacctcaaaagccttctgtgtgccaccgaccttgtaaaattgaaccagttgggattcaaaggtcatataagcctgaacacacaggcccagcattacataacttatgtgggcaaaagccaactattagagacccttactgtagaacacaaaacttggaaatccgtgaagtgttttcattggcagttagcgattacccccagagaattctgggaggaaatgccccacagaagcctagctcagcagaaggaaattgtttgtccattgcaatggagactggagatgctgaggatgaatatgccagagaggaagagctggcatcgatgagagcacagataccaagctattcgagattttatgaaagtggcagttcccttcgagctgagaaccaaagtacaaccttgcccggaccaggaagaaatatgccaaattcacaaatggtgaatattagagatatgtcagacaatgtactgtatcaaaacagaaactaccatttgacaccacggacctcattacatacagcatctagtacaatgtacagtaataccaatccattacggagtaatttttctcctcattttgcatcatcaaaccaattgagattatcacaaaaccaaaacaattaccagatttcaggaaaccttactgtgccttggattacagggtgttctagaaaaagagcactacaggaccgcactcagttcagtgaccgagacttagccacccttaagaagtattgggacaatggcatgaccagcctgggctctgtttgtagagagaaaattgaagctgtggcaactgaattaaatgttgactgtgaaatagttcggacttggattgggaatcgaagaaggaaatatcgtttaatggggattgaagttccacctccaagaggaggccctgctgatttctctgagcagcctgagtctggttctttatctgcactcacaccaggagaggaagctgggcctgaagtaggagaggataatgacagaaatgatgaagtatccatctgtttgtctgaaggaagctctcaagaagagcccaatgaagttgttccgaatgatgcaagggctcataaggaagaggaccaccatgcagtaaccacagataatgtgaaaatagaaattattgatgatgaagaaagtgacatgataagtaattctgaagtagaacaagtaaactctttcttggattataagaatgaagaagtcaaattcattgaaaatgagctcgagattcaaaagcaaaaatactttaaacttcagacttttgttagaagcttgatattagcaatgaaagctgatgataaggaacaacagcaggcactgctgtcagatttacctcctgaattagaggaaatggatttcaatcatgcctcactggagcctgatgatacctcattcagtgtatcttctttgtcagagaaaaatgtctcagaaagtttgtgatttcagttggagggaatatatgatacagtcttttggcttcgtaacaggtgtgcatttcaagataactgcattctgttgccctggtattctttagttgggaaaacacattgttgaaacggacgtattctgtgaagaatgtacaagatataatggctacagtgcaacaaaaatgtaggtgaaatttaaaagcattgtttgagagagtatttttttaactgatggaactctggaaaaaaattatatttaagtttcagcagtttaaccctgaaattcattatgtctaatttctaaccagagacaaaataactaaagacatttcagcattgcttatcaagttgctacagcttgattagtcttgtttttgtagccattacatcttctttcttcttctctccttttcctatcatccacttacactttttctcaggaaagtggactgaacatttaaaacaaaactttaaaaaattatttaactcattatttaatgagttctctgatttagtttttaacccctatgaaaatttgacttaaactaatgactgaaaattaaatgattacaggtatgtaattgtaaattgctggtgttcttctattatctaacccaaatatttgtgtgggggtggggaagcacaatggaaaggtaatttaaccaacataacgtcaaataaattacgaagtgtacagaaacaaaa

SEQ ID NO: 939 - DNA, 786 bp, Homo sapiens
aattgatgatcggacacgctgatttcattgtctgaagcggcactggagacccaggaaaaatctcgctgaatccgcctgccccagcagcggcctgatctgggttccgctgattcctttcgtaaccgcaccacacccgagacgtgggttggcaataagagaagaaagatgagtagtaagaactctgaatctggaacagcaacaacaggaacctctttgtcagctccagacatcacagtcagaaatgtggttaatattgctcgaccctcaagccagcagtcttcttggacatctgccaataatgatgtcattgtaactggtatatacagtccagccagttcatcaagtaggcaaggaacaaacaaacatacagacacacaaattacagaagcacataaaatccctattcagaaaacagccactaaaaatgatactgagtttcagttacacattcctgtccaaagacaagtagcacactgtaaaaatgcttccctactcctaggtgaaaaaacaattattttgtcaagacagacaagtgtgctaaatgctggaaactcagtattcaatcacgcaaagaaaaactatggaaactcttcagtacaagcttctgaaatgacagtacctcaaaagccttctgtgtgccaccgaccttgtaaaattgaaccagttgggattcaaaggtcatataagcctgaacacacaggcccagcattacataacttatgtgggcaaaagccaactattagagacccttactgtagaacacaaaacttggaaatccgtgaagtg

SEQ ID NO: 940 - DNA, 2277 bp, Homo sapiens
ggcctgatctgggttccgctgattcctttcgtaaccgcaccacacccgagctacaatctctggacaaaattttaagagaaactccctcagaactcctaaaggtaaacaaaagcaggcagattgaggatggcagtcagaatatgaagtgaccatatatggatgaatctacgttctgtatttactgtagaacaacaaaggattttacagcgttattatgaaaatggaatgacaaatcaaagtaaaaattgctttcagctcatattacagtgtgcacaggagactaagctggacttcagtgtagtcaggacgtgggttggcaataagagaagaaagatgagtagtaagaactctgaatctggaacagcaacaacaggaacctctttgtcagctccagacatcacagtcagaaatgtggttaatattgctcgaccctcaagccagcagtcttcttggacatctgccaataatgatgtcattgtaactggtatatacagtccagccagttcatcaagtaggcaaggaacaaacaaacatacagacacacaaattacagaagcacataaaatccctattcagaaaacagccactaaaaatgatactgagtttcagttacacattcctgtccaaagacaagtagcacactgtaaaaatgcttccctactcctaggtgaaaaaacaattattttgtcaagacagacaagtgtgctaaatgctggaaactcagtattcaatcacgcaaagaaaaactatggaaactcttcagtacaagcttctgaaatgacagtacctcaaaagccttctgtgtgccaccgaccttgtaaaattgaaccagttgggattcaaaggtcatataagcctgaacacacaggcccagcattacataacttatgtgggcaaaagccaactattagagacccttactgtagaacacaaaacttggaaatccgtgaagtgttttcattggcagttagcgattacccccagagaattctgggaggaaatgccccacagaagcctagctcagcagaaggaaattgtttgtccattgcaatggagactggagatgctgaggatgaatatgccagagaggaagagctggcatcgatgagagcacagataccaagctattcgagattttatgaaagtggcagttcccttcgagctgagaaccaaagtacaaccttgcccggaccaggaagaaatatgccaaattcacaaatggtgaatattagagatatgtcagacaatgtactgtatcaaaacagaaactaccatttgacaccacggacctcattacatacagcatctagtacaatgtacagtaataccaatccattacggagtaatttttctcctcattttgcatcatcaaaccaattgagattatcacaaaaccaaaacaattaccagatttcaggaaaccttactgtgccttggattacagggtgttctagaaaaagagcactacaggaccgcactcagttcagtgaccgagacttagccacccttaagaagtattgggacaatggcatgaccagcctgggctctgtttgtagagagaaaattgaagctgtggcaactgaattaaatgttgactgtgaaatagttcggacttggattgggaatcgaagaaggaaatatcgtttaatggggattgaagttccacctccaagaggaggccctgctgatttctctgagcagcctgagtctggttctttatctgcactcacaccaggagaggaagctgggcctgaagtaggagaggataatgacagaaatgatgaagtatccatctgtttgtctgaaggaagctctcaagaagagcccaatgaagttgttccgaatgatgcaagggctcataaggaagaggaccaccatgcagtaaccacagataatgtgaaaatagaaattattgatgatgaagaaagtgacatgataagtaattctgaagtagaacaagtaaactctttcttggattataagaatgaagaagtcaaattcattgaaaatgagctcgagattcaaaagcaaaaatactttaaacttcagacttttgttagaagcttgatattagcaatgaaagctgatgataaggaacaacagcaggcactgctgtcagatttacctcctgaattagaggaaatggatttcaatcatgcctcactggagcctgatgatacctcattcagtgtatcttctttgtcagagaaaaatgtctcagaaagtttgtgatttcagttggagggaatatatgatacagtcttttggcttcgtaac

SEQ ID NO: 941 - DNA, 2349 bp, Homo sapiens
ggcggacgctggaaagcgccgttcctgactctaatgtacttagacacttgaagccacaaaaggatttatccccgaggttcctcatctgctcgcgaggatgccttttctcttctgccttgcgaaataacagcagcctagctgttgcccgtgaccagtgagaaaggcagcgtcgcgggctgattaggtttcacccaaagggtgccggcgccgaattggtttctaacgagaacttttaaaatgatccgttccaaaaaagggtaggagccgcgagaccctccaactgcccagagaaaacaagtctcgtctggcaaagttctcggcccacgcggtccgcggccaagggccaacggtccctcgccccacgttgccgcagcactgcgcgtgcgcgagccgctgtcaaacgcgctgacggaggccgagaagaaaaaaaggcgggagccgtcaatcccgggttgagcaaaatggcgcgggagaaggagatgcaggagttcacccgtagcttcttccgaggccgcccggacctcagcacgcttacgcattccatcgtgcggcggaggtacttagctcactcgggccgcagccacctggagcccgaggagaagcaggcactgaagcggctggtggaggaggagctgctgaagatgcaggtggatgaagccgcttccagggaagacaaactggaccttaccaagaagggcaagaggcctcccaccccttgtagcgacccggagagaaaaaggttccgcttcaattcagagtcggagtccggctctgaagcctccagcccagactactttggacccccagcaaagaatggggtggcagcagaagtcagcccagccaaagaggagaatccaaggcgagcctcaaaggcagttgaggagagcagtgatgaggaacggcagagggacctgcccgcacagaggggagaggagagcagtgaggaggaggaaaaggggtacaaggggaagactaggaagaaacctgtggtaaagaagcaggcaccaggcaaggcctcagtcagtaggaagcaggccagggaagaaagtgaggagagcgaggcagaacccgttcagaggacagcaaagaaggtggagggaaataaaggaactaaaagcctgaaggaaagtgaacaggagagtgaagaggagatcctagcccagaagaaagagcagagagaggaggaagtggaggaggaagagaaagaagaggatgaggaaaagggggattggaaacccagaaccaggagcaatggccggagaaagtcagctagggaggagaggagctgtaagcagaaaagccaggcaaagaggctcttgggagactcagacagcgaggaagagcagaaagaggcagccagcagtggggatgacagtgggagagatagagaacccccagtgcagaggaagagtgaggacaggacccagcttaagggtgggaagaggttgagtggaagcagcgaggacgaggaagacagtgggaagggggaacccacagctaaaggctctagaaagatggccagactgggcagcaccagtggtgaggaaagtgacttggagagggaggtaagtgacagcgaggcagggggaggcccccagggggagaggaagaaccgctcttccaagaagagctccaggaaaggcaggacacgaagctcctcttcctcctcagatggaagtccagaggccaaaggagggaaggctggctcaggtcgccgtggagaggaccacccggctgtgatgaggctgaagcgctacattcgggcctgtggtgcccatcgaaactacaagaagctgttgggctcctgttgctcacacaaggagcgcctgagtatcctccgggcagaactggaagcgctaggcatgaagggtaccccttccctagggaagtgtcgggccctgaaggagcagagggaggaggcagctgaggtggcctccttggatgttgcgaacatcatcagtggctcgggccggccacgcagacgtacagcctggaaccctttaggagaagcagcacccccaggggagctgtaccgacggaccctggactcagatgaagagcggccccgtcccgcacccccagactggtcacatatgcgtggcatcatcagcagtgatggcgagagtaactgagctctgccacccccaggagggacccttgatacatgtacaaagcatacatagcaccccttgccctgtgtctgtggaacagaagcagcttccttcagagaagactgcagctcccaaggacacaagctgttgggatgctacttctcagcttcacgctgtccctttaaggtgtttattttttaagactcaataaaggagtgtttttaatcacctcatcaaa

SEQ ID NO: 942 - DNA, 1404 bp, Homo sapiens
ggcggacgctggaaagcgccgttcctgactctaatgtacttagacacttgaagccacaaaaggatttatccccgaggttcctcatctgctcgcgaggatgccttttctcttctgccttgcgaaataacagcagcctagctgttgcccgtgaccagtgagaaaggcagcgtcgcgggctgattaggtttcacccaaagggtgccggcgccgaattggtttctaacgagaacttttaaaatgatccgttccaaaaaagggtaggagccgcgagaccctccaactgcccagagaaaacaagtctcgtctggcaaagttctcggcccacgcggtccgcggccaagggccaacggtccctcgccccacgttgccgcagcactgcgcgtgcgcgagccgctgtcaaacgcgctgacggaggccgagaagaaaaaaaggcgggagccgtcaatcccgggttgagcaaaatggcgcgggagaaggagatgcaggagttcacccgtagcttcttccgaggccgcccggacctcagcacgcttacgcattccatcgtgcggcggaggtacttagctcactcgggccgcagccacctggagcccgaggagaagcaggcactgaagcggctggtggaggaggagctgctgaagatgcaggtggatgaagccgcttccagggaagacaaactggaccttaccaagaagggcaagaggcctcccaccccttgtagcgacccggagagaaaaaggttccgcttcaattcagagtcggctggctcaggtcgccgtggagaggaccacccggctgtgatgaggctgaagcgctacattcgggcctgtggtgcccatcgaaactacaagaagctgttgggctcctgttgctcacacaaggagcgcctgagtatcctccgggcagaactggaagcgctaggcatgaagggtaccccttccctagggaagtgtcgggccctgaaggagcagagggaggaggcagctgaggtggcctccttggatgttgcgaacatcatcagtggctcgggccggccacgcagacgtacagcctggaaccctttaggagaagcagcacccccaggggagctgtaccgacggaccctggactcagatgaagagcggccccgtcccgcacccccagactggtcacatatgcgtggcatcatcagcagtgatggcgagagtaactgagctctgccacccccaggagggacccttgatacatgtacaaagcatacatagcaccccttgccctgtgtctgtggaacagaagcagcttccttcagagaagactgcagctcccaaggacacaagctgttgggatgctacttctcagcttcacgctgtccctttaaggtgtttattttttaagactcaataaaggagtgtttttaatcacctc

SEQ ID NO: 943 - DNA, 1659 bp, Homo sapiens
cgcgttgcgctccggctgcacggtcgcaccggcagcggctcaggctccggctcctctcccgctgcagcagccgcgctgccggccccactgggctcggatccggccccggccccctcggcaccgcctgctctggccccggccccggccccgcggaccatgcgctgggcgcccccaggggaacccgacccggccaagggcccgcaaagacgaggctcccgggccggggcccctcccggccgcccagctctcggccggcgccctgccccgcgtcccggagccgcgtgagcctgcggggccatggagcgcgcgccgcccgacgggccgctgaacgcttcgggggcgctggcgggcgaggcggcggcggcgggcggggcgcgcggcttctcggcagcctggaccgcggtgctggccgcgctcatggcgctgctcatcgtggccacggtgctgggcaacgcgctggtcatgctcgccttcgtggccgactcgagcctccgcacccagaacaacttcttcctgctcaacctcgccatctccgacttcctcgtcggcgccttctgcatcccactgtatgtaccctacgtgctgacaggccgctggaccttcggccggggcctctgcaagctgtggctggtagtggactacctgctgtgcacctcctctgccttcaacatcgtgctcatcagctacgaccgcttcctgtcggtcacccgagcggtctcataccgggcccagcagggtgacacgcggcgggcagtgcggaagatgctgctggtgtgggtgctggccttcctgctgtacggaccagccatcctgagctgggagtacctgtccgggggcagctccatccccgagggccactgctatgccgagttcttctacaactggtacttcctcatcacggcttccaccctggagttctttacgcccttcctcagcgtcaccttctttaacctcagcatctacctgaacatccagaggcgcacccgcctccggctggatggggctcgagaggcagccggccccgagccccctcccgaggcccagccctcaccacccccaccgcctggctgctggggctgctggcagaaggggcacggggaggccatgccgctgcacaggtatggggtgggtgaggcggccgtaggcgctgaggccggggaggcgaccctcgggggtggcggtgggggcggctccgtggcttcacccacctccagctccggcagctcctcgaggggcactgagaggccgcgctcactcaagaggggctccaagccgtcggcgtcctcggcctcgctggagaagcgcatgaagatggtgtcccagagcttcacccagcgctttcggctgtctcgggacaggaaagtggccaagtcgctggccgtcatcgtgagcatctttgggctctgctgggccccatacacgctgctgatgatcatccgggccgcctgccatggccactgcgtccctgactactggtacgaaacctccttctggctcctgtgggccaactcggctgtcaaccctgtcctctaccctctgtgccaccacagcttccgccgggccttcaccaagctgctctgcccccagaagctcaaaatccagccccacagctccctggagcactgctggaaaaagatgaagaagaaaacatgtctgtga

SEQ ID NO: 944 - DNA, 2659 bp, Homo sapiens
cggctgcacggtcgcaccggcagcggctcaggctccggctcctctcccgctgcagcagccgcgctgccggccccactgggctcggatccggccccggccccctcggcaccgcctgctctggccccggccccggccccgcggaccatgcgctgggcgcccccaggggaacccgacccggccaagggcccgcaaagacgaggctcccgggccggggcccctcccggccgcccagctctcggccggcgccctgccccgcgtcccggagccgcgtgagcctgcggggccatggagcgcgcgccgcccgacgggccgctgaacgcttcgggggcgctggcgggcgaggcggcggcggcgggcggggcgcgcggcttctcggcagcctggaccgcggtgctggccgcgctcatggcgctgctcatcgtggccacggtgctgggcaacgcgctggtcatgctcgccttcgtggccgactcgagcctccgcacccagaacaacttcttcctgctcaacctcgccatctccgacttcctcgtcggcgccttctgcatcccactgtatgtaccctacgtgctgacaggccgctggaccttcggccggggcctctgcaagctgtggctggtagtggactacctgctgtgcacctcctctgccttcaacatcgtgctcatcagctacgaccgcttcctgtcggtcacccgagcggtctcataccgggcccagcagggtgacacgcggcgggcagtgcggaagatgctgctggtgtgggtgctggccttcctgctgtacggaccagccatcctgagctgggagtacctgtccgggggcagctccatccccgagggccactgctatgccgagttcttctacaactggtacttcctcatcacggcttccaccctggagttctttacgcccttcctcagcgtcaccttctttaacctcagcatctacctgaacatccagaggcgcacccgcctccggctggatggggctcgagaggcagccggccccgagccccctcccgaggcccagccctcaccacccccaccgcctggctgctggggctgctggcagaaggggcacggggaggccatgccgctgcacaggtatggggtgggtgaggcggccgtaggcgctgaggccggggaggcgaccctcgggggtggcggtgggggcggctccgtggcttcacccacctccagctccggcagctcctcgaggggcactgagaggccgcgctcactcaagaggggctccaagccgtcggcgtcctcggcctcgctggagaagcgcatgaagatggtgtcccagagcttcacccagcgctttcggctgtctcgggacaggaaagtggccaagtcgctggccgtcatcgtgagcatctttgggctctgctgggccccatacacgctgctgatgatcatccgggccgcctgccatggccactgcgtccctgactactggtacgaaacctccttctggctcctgtgggccaactcggctgtcaaccctgtcctctaccctctgtgccaccacagcttccgccgggccttcaccaagctgctctgcccccagaagctcaaaatccagccccacagctccctggagcactgctggaagtgagtggcccaccagagcctccctcagccacgcctctctcagcccaggtctcctgggcatctggccctgctgccccctacccggctcgttcccccaggggtgagccccgccgtgtctgtggccctctcttaatgccacggcagccaccctgccatggaggcgccttcctgggttggccagagggcccctcactggctggactggaggctgggtggccggccctgccccccacattctggctccaccgggagggacagtctggaggtcccagacatgctgcccaccccctgctggtgcccacccttcgcagttactggttggtgttcttcccaaagcaagcacctgggtgtgctccaggcttcctgccctagcagtttgcctctgcacgtgcacacacctgcacacccctgcacacacctgcacaccgtccctctccccggacaagcccaggacactgcctttgctgccttctgtctcttgcataagcctcaggcctggccctttcacccctcttcccaccaactctctctgcccccaaaagtgtcaaggggccctaggaacctcgaagctgttctctgcttttccattctgggtgttttcagaaagatgaagaagaaaacatgtctgtgaacttgatgttcctgggatgtttaatcaagagagacaaaattgctgaggagctcagggctggattggcaggtgtgggctcccacgccctcctccctccgctaaggcttccggctgagctgtgccagctgcttctgcccaccccgcctctgggctcacaccagccctggtggccaagcctgccccggccactctgtttgctcacccaggacctctgggggttgttgggaggagggggcccggctgggcccgagggtcccaaggcgtgcaggggcggtccagaggaggtgcccgggcaggggccgcttcgccatgtgctgtgcacccgtgccacgcgctctgcatgctcctctgcctgtgcccgctgcgctgccctgcaaaccgtgaggtcacaataaagtgtattttttta

SEQ ID NO: 945 - DNA, 1545 bp, Homo sapiens
cgcgttgcgctccggctgcacggtcgcaccggcagcggctcaggctccggctcctctcccgctgcagcagccgcgctgccggccccactgggctcggatccggccccggccccctcggcaccgcctgctctggccccggccccggccccgcggaccatgcgctgggcgcccccaggggaacccgacccggccaagggcccgcaaagacgaggctcccgggccggggcccctcccggccgcccagctctcggccggcgccctgccccgcgtcccggagccgcgtgagcctgcggggccatggagcgcgcgccgcccgacgggccgctgaacgcttcgggggcgctggcgggcgaggcggcggcggcgggcggggcgcgcggcttctcggcagcctggaccgcggtgctggccgcgctcatggcgctgctcatcgtggccacggtgctgggcaacgcgctggtcatgctcgccttcgtggccgactcgagcctccgcacccagaacaacttcttcctgctcaacctcgccatctccgacttcctcgtcggcgccttctgcatcccactgtatgtaccctacgtgctgacaggccgctggaccttcggccggggcctctgcaagctgtggctggtagtggactacctgctgtgcacctcctctgccttcaacatcgtgctcatcagctacgaccgcttcctgtcggtcacccgagcggtctcataccgggcccagcagggtgacacgcggcgggcagtgcggaagatgctgctggtgtgggtgctggccttcctgctgtacggaccagccatcctgagctgggagtacctgtccgggggcagctccatccccgagggccactgctatgccgagttcttctacaactggtacttcctcatcacggcttccaccctggagttctttacgcccttcctcagcgtcaccttctttaacctcagcatctacctgaacatccagaggcgcacccgcctccggctgaaggggcacggggaggccatgccgctgcacaggtatggggtgggtgaggcggccgtaggcgctgaggccggggaggcgaccctcgggggtggcggtgggggcggctccgtggcttcacccacctccagctccggcagctcctcgaggggcactgagaggccgcgctcactcaagaggggctccaagccgtcggcgtcctcggcctcgctggagaagcgcatgaagatggtgtcccagagcttcacccagcgctttcggctgtctcgggacaggaaagtggccaagtcgctggccgtcatcgtgagcatctttgggctctgctgggccccatacacgctgctgatgatcatccgggccgcctgccatggccactgcgtccctgactactggtacgaaacctccttctggctcctgtgggccaactcggctgtcaaccctgtcctctaccctctgtgccaccacagcttccgccgggccttcaccaagctgctctgcccccagaagctcaaaatccagccccacagctccctggagcactgctggaagtga

SEQ ID NO: 946 - DNA, 500 bp, Homo sapiens
gtggttctcgtgttgctgcaatttgatgcgaggagatgtctggacgagggaagcagggaggaaaagcacgcgccaagtctaagtctcgctcttctagagcgggtttgcagtttcccgtaggccggatccatcgtctgcttcgtaagggaaactatgcagagcggataggggcaggcgcaccagtgtatttggcggcagtgttagagtatctcacagcagaaatccttgagctggcaggcaatgcgtctcgcgataacaaaaaaactcgcattattccccgccacctgcagctagcgatccgcaatgatgaggaactcaataagcttttgggcggcgtgaccattgcccagggcggagtcctgcctaacattcaggcagtgctgctgcccaagaagactgagagtcaccaccataaagcccaaagcaagtaacttaaggttgtcattggtaaaaagacttctgtgtcagaaaaaacaaaaggctcttttcagagccaccta

SEQ ID NO: 947 - DNA, 2239 bp, Homo sapiens
gtagtgagttgcgctcgctatgtctggacgtggcaagcagggaggcaaagcccgcgctaaggccaagactcgctcttctagggccggtctccagttccccgtgggccgagtgcaccgcctgctccgcaaaggcaactatgccgagcgggtcggggccggcgcgccggtgtatctggcagcggtgctggagtacctgaccgccgagatcctggaactggcgggcaacgcggcccgcgacaacaagaagacccgcatcatcccgcgtcatctccaactggccatccgcaacgacgaggagctcaacaagctgctgggcaaagtcaccatcgcacagggcggtgtcctgcccaacattcaggccgtgctactgcccaaaaagactgagagccaccacaaggcgaagggcaagtaactatctgtactagtttgtggcagctcaagtaaaatcgagtccaaaccaacggctcttttcagggccacccacgtcttctctaaaagaacttaacatttattccatgtgaaagaaagtgagacatggacaagactctagtcataaattacccatctttttgaaaacagtgtagcgaacaccgcagatttaaaagaaaaactagagggaaggtggtccagattttaccacgcttaaaagttaagatgtgaacaaatctcttaggccattacttaattttaaacttaatcagtgtgtgtccacagagcaccagtggcttcgtgagttcttgaagcactttggcccaaaagagttatcgcccgggctagaatttagcagacagctgttccacgcgggccagggcggcatgaagaagtcccgccgctacgtgcccggcacagtggccctgcgcgacgttcggcgctaccagaactccgagctgctgatcagcaagctgccgctcctgcgagagctcggcggtgacgccgctgcacgagagcgaggctgaagaactttgtgacacaatagtccacctccctgcaaaggctctgtcagagactcacatctttcctgatggatagctgtgaagcattctcttacccaccctactgcatgttgcaaagtattcctttaaaatgaagtgagtaaaatactgggatgacgttatctggagcccaagaaagatggctcatttggaaaggcctaatatcccaagttgcttacctagaagaacttgacaggatagttaataataaaccttaaaacccatgaagaaatctgaggtaaagtgttagcacacagactgttaaaatgtctgcctcacagataggagggaaaatatatagaggattataatatggttcaacaaatgttgatgagtattagaaatgtacattagaaatattagaaatgtttatgactattagaaaagtacagggtattgggcgttcctgacacaaactgaggcctcctagcaagactggcagttttctgtaaaggagggttatttactacggtagtgcaaataacttttggtgttgtagctaaataaggaatactcatgccaagattgcacaattgtgcctcctccctctgttcactgaactctgatgtaattttttttttttttttgagacggagtctcgctctgtcgcccaggctggagtgcagtggcgctatctcggctcactgcaagctccgcctcccgggttcacgccattctcctgcctcagcctcctgagtagctggggctacaggcgtctgccaccatgcccagctacttttttgtatttttagtagatacggggtttcaccgtgttagccaggatggtcttgatgtcctgacctcgtgatccaccggcctcggcctcccaaagtgctgggattaccggcgtaagccaccacgcccggcccactctgaagtaatcttaagaagacgttaactcatttttcttgtgtattgtagacacttttggctgtctggtaacatggaaaatctcagaatgatgttttaagtatataaaatgccaaacaaagttaaattacagttatcaaagtatttttaaaacttcatagtgataaatgagactatatagttatattgttaatatagttaacacattacatgatttggtgagcctaattgctgttactaattagaggagtaaaaatgtttcacgataactcagcaattgtaatgagaaatgaaacatctaatgtcttttgggttacaaagtaacaggtactgagatttgtggcctaaattcataataaagtgaaatgttcaagttc

SEQ ID NO: 948 - DNA, 457 bp, Homo sapiens
aggcgctgcctttcctcgttggctactttcagtaagttgtgaccagtatgtctggacgtggcaagcaaggcggtaaagctcgcgccaaggccaagacccgctcttctcgggctgggcttcagttccccgtgggccgagtgcaccgcctgctccgcaagggtaattatgccgagcgggttggagccggcgcgccagtgtacctggctgcggtgctggagtacctgaccgctgagatcctggagctggctggcaatgcggcccgcgacaacaagaagacccgtatcatcccgcgtcacctccaactggccatccgcaacgacgaggagctcaacaagctgctgggcaaagtcaccatcgcgcagggtggtgtcttgcccaatatccaggccgtgctgctgcctaagaagactgagagccaccataaggccaaataaggagcgaggttgtgaaaactgga

SEQ ID NO: 949 - DNA, 381 bp, Homo sapiens
atgccagagccagcgaagtctgctcccgccccgaaaaagggctccaagaaggcggtgactaaggcgcagaagaaagacggcaagaagcgcaagcgcagccgcaaggagagctattccatctatgtgtacaaggttctgaagcaggtccaccctgacaccggcatttcgtccaaggccatgggcatcatgaattcgtttgtgaacgacattttcgagcgcatcgcaggtgaggcttcccgcctggcgcattacaacaagcgctcgaccatcacctccagggagatccagacggccgtgcgcctgctgctgcctggggagttggccaagcacgccgtgtccgagggtactaaggccgtcaccaagtacaccagcgctaagtaa

SEQ ID NO: 950 - DNA, 718 bp, Homo sapiens
ctacacagtgctatgccagagccagcgaagtctgctcccgccccgaaaaagggctccaagaaggcggtgactaaggcgcagaagaaagacggcaagaagcgcaagcgcagccgcaaggagagctattccatctatgtgtacaaggttctgaagcaggtccaccctgacaccggcatttcgtccaaggccatgggcatcatgaattcgtttgtgaacgacattttcgagcgcatcgcaggtgaggcttcccgcctggcgcattacaacaagcgctcgaccatcacctccagggagatccagacggccgtgcgcctgctgctgcctggggagttggccaagcacgccgtgtccgagggtactaaggccgtcaccaagtacaccagcgctaagtaaacaggctaccctgagaggaatctacatgcagagaagttcaggagactgaactaacggaacgtcaggaagcgctgcgggctggagagctgctgttggaacagggaggagttctccgggccgcaccctgcctccgtcccgcaggtggagtggctgaaacttctcagcaggcgcatctacactagtgacctgaggagagaaaccctaaccccacaatggctgcatcttctctgaagacgagactgatgctcatctttgaaatgaagggcagtgtgtgcatttctccatgaaggtatccagaaacagccatgccagagctgctgtgggg

SEQ ID NO: 951 - DNA, 381 bp, Homo sapiens
atgccggaaccagcgaagtccgctcccgcgcccaagaagggctcgaagaaagccgtgactaaggcgcagaagaaggacggcaagaagcgcaagcgcagccgcaaggagagctactccgtatacgtgtacaaggtgctgaagcaggtccaccccgacaccggcatctcctctaaggccatgggaatcatgaactccttcgtcaacgacatcttcgaacgcatcgcgggtgaggcttcccgcctggcgcattacaacaagcgctcgaccatcacctccagggagatccagacggccgtgcgcctgctgctgcccggggagttggccaagcacgccgtgtccgagggcaccaaggccgtcaccaagtacaccagcgctaagtaa

SEQ ID NO: 952 - DNA, 820 bp, Homo sapiens
ctcgatctgctgctcgtctcaggctcgtagttcgccttcaacatgccggaaccagcgaagtccgctcccgcgcccaagaagggctcgaagaaagccgtgactaaggcgcagaagaaggacggcaagaagcgcaagcgcagccgcaaggagagctactccgtatacgtgtacaaggtgctgaagcaggtccaccccgacaccggcatctcctctaaggccatgggaatcatgaactccttcgtcaacgacatcttcgaacgcatcgcgggtgaggcttcccgcctggcgcattacaacaagcgctcgaccatcacctccagggagatccagacggccgtgcgcctgctgctgcccggggagttggccaagcacgccgtgtccgagggcaccaaggccgtcaccaagtacaccagcgctaagtaaacttgccaaggagggactttctctggaatttcctgatatgaccaagaaagcttcttatcaaaagaagcacaattgccttcggttacctcattatctactgcagaaaagaagacgagaatgcaaccatacctagatggacttttccacaagctaaagctggcctcttgatctcattcagattccaaagagaatcatttacaagttaatttctgtctccttggtccattccttctctctaataatcatttactgttcctcaaagaattgtctacattacccatctcctcttttgcctctgagaaagagtatataagcttctgtaccccactggggggttggggtaatattctgtggtcctcagccctgtaccttaataaatttgtatgccttttctctt

SEQ ID NO: 953 - DNA, 974 bp, Homo sapiens
ccgcggcgcgcaatgcgagggagacgagattatgtaaatgagtggattctggctgagctatcctattggctatcgggacaaaatttgcttgagccaatcaaagtgctccgtggacaatcgccgttctgtctataaaaaggtgaagcagcggcgttttcggcgactttcccgatcgccaggcaggagtttctctcggtgactactatcgctgtcatgtctggtcgtggcaagcaaggaggcaaggcccgcgccaaggccaagtcgcgctcgtcccgcgctggccttcagttcccggtagggcgagtgcatcgcttgctgcgcaaaggcaactacgcggagcgagtgggggccggcgcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgtcttgcctaacatccaggccgtactgctccctaagaagacggagagtcaccacaaggcaaagggcaagtgaggctgacgtccggcccaagtgggcccagcccggcccgcgtctcgaaggggcacctgtgaactcaaaaggctcttttcagagccacccacgttttcaaataaaagagttgttaatgctggccactctcagtccagcgttcctcagtagtgaatagcgaacctggagctgacgggacgggacgggacgggacgggacggggcggggcggggcggggtgtgtgtgtgtgcgcgccgtcttccatctggagcacgtaactgccttggctcttcgatgagtgggtccccagtcctaggacttcccagggcaggtgcaggcaccaaacgtcctgggcgccgccacggtccgctccacacagtcacaaacaccag

SEQ ID NO: 954 - DNA, 549 bp, Homo sapiens
ccaggcaggagtttctctcggtgactactatcgctgtcatgtctggtcgtggcaagcaaggaggcaaggcccgcgccaaggccaagtcgcgctcgtcccgcgctggccttcagttcccggtagggcgagtgcatcgcttgctgcgcaaaggcaactacgcggagcgagtgggggccggcgcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgtcttgcctaacatccaggccgtactgctccctaagaagacggagagtcaccacaaggcaaagggcaagtgaggctgacgtccggcccaagtgggcccagcccggcccgcgtctcgaaggggcacctgtgaactcaaaaggctcttttcagagccacccacgttttcaaataaaagagttgttaatgctg

SEQ ID NO: 955 - DNA, 448 bp, Homo sapiens
atgtcaggacgcggaaagcagggaggcaaggcccgcgctaaggccaagtcgcgctcgtcccgcgctggtctccagttcccggtggggcgagtgcaccgcttgctgcgcaaaggcaactacgcggagcgggtcggggcaggcgccccggtgtacctggcggcggtcctcgagtacctgaccgcggaaattctggagctggcgggcaacgcggctcgggacaacaagaagacgcgcatcatccctcgccatctgcaactagccgtgaggaatgacgaagagctcaacaagttactcgggggtgtcaccattgcccagggcggcgtcttgcccaatatccaggctgtcctgttgcccaagaaaacggagagtcacaagcctggcaagaacaagtaattaagaggcttgacaccatactcattcaccccaaaggctcttttaagagccacca

SEQ ID NO: 956 - DNA, 632 bp, Homo sapiens
cttctttaagtctcttttctcttttttcgcgcaaaaatgccggatccagcgaaatccgctcctgctcccaagaagggctccaaaaaggctgttacgaaagtgcagaagaaggacggcaagaagcgcaagcgcagccgcaaggagagctactccgtttacgtgtacaaggtgctgaagcaggtccaccccgacaccggcatctcgtccaaggccatgggcatcatgaactccttcgtcaacgacatcttcgagcgcatcgcgggagaggcgtcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctcgaagtaagagtgtgcaagggacgcaatagatcaaccacctaaccccaaaggctcttttcagagccacttcagtaatcgagaaagcagctgtaaacacttgtcagagcgtttgatagcttttggtcaggtagggagtgttaccatggtcacggatgcattcgggtttaggactaaggagtttcctgtagtcctgtaatgagttggccctcagtcatccccgtc

SEQ ID NO: 957 - DNA, 1047 bp, Homo sapiens
agttcggattacttctttaagtctcttttctcttttttcgcgcaaaaatgccggatccagcgaaatccgctcctgctcccaagaagggctccaaaaaggctgttacgaaagtgcagaagaaggacggcaagaagcgcaagcgcagccgcaaggagagctactccgtttacgtgtacaaggtgctgaagcaggtccaccccgacaccggcatctcgtccaaggccatgggcatcatgaactccttcgtcaacgacatcttcgagcgcatcgcgggagaggcgtcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctcgaacccgaggaatctgtctccaactaagcctggtggcagtgaggaccgtcagccccctcccagccagctgtcagctatacctccattctgtctggttctcagggctggaatcgctgggcaggtctagctaatccttggccctcctaggaaaatattcctaaatcctgaaggcatttagctaggaaagatccagaatggacccaactcttcctgttttaccccaaaccggttggtctgctttggggattacttctcaggctaggaacctctgagtgttctgaaacgggcctgaactcttacagaagctcttgtggccctaggatgaatttagaggtctccatacccagcctggaaggtgaagaacgacccctaacgacccaccctcccaacctaatgccggttctgctccacttgtccactctggggagctgtgctttggcttggaagctctcggattgaaggatgggcccaagaccctcacaggtgaagcctcggtaggtcccagggagaagaaagattcctccaccccaccacccctctaagtccgacccacctttctccccgccagctgcatcagatccctccagggcctcattgtcagtcctgtaatcttttcatccgtgata

SEQ ID NO: 958 - DNA, 999 bp, Homo sapiens
ggtagttcggattacttctttaagtctcttttctcttttttcgcgcaaaaatgccggatccagcgaaatccgctcctgctcccaagaagggctccaaaaaggctgttacgaaagtgcagaagaaggacggcaagaagcgcaagcgcagccgcaaggagagctactccgtttacgtgtacaaggtgctgaagcaggtccaccccgacaccggcatctcgtccaaggccatgggcatcatgaactccttcgtcaacgacatcttcgagcgcatcgcgggagaggcgtcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctcgaagttaataggacccatcctttggaagtaggaaagtggcatagaaggagaagctgagttagagatcactcacccacttgcccatcaactggaactgcaagagatcagagaataaagatatcagttggtccaaggaaaataatgaggaagagagaattggggagacagaattaatgtagactctgagggatcaactcagatctcttgagtttctatttctctttctcaaaatccagtactaacagaactgaacaagctacaggtggttatcaaggaaacttcactgcggtgcgtccaggcttaatgctacctcagggttgcccttcccatccttttcataaaataagctctaataaaccatggaagcacagatacaagttgcttcatactcatgagttctacccagagttaccacaggaagacaaaactcttgactcacaacagccacagcctgtacccttctaactgtcccctctgagtccaacttaccccaaaggagcagagttgtcaagaaccacatgttgtctccaagctggtgggagcagtgaaatctgtaacatgcaagatattgaaga

SEQ ID NO: 959 - DNA, 702 bp, Homo sapiens
atggcccgtactaagcagactgcccgcaagtcgaccggcggcaaggccccgaggaagcagctggctaccaaagcggcccgcaagagcgcgccggccacgggcggggtgaagaagccgcaccgctaccggcccggcaccgtggctctgcgggagatccggcgctatcagaagtctacggagctgctgatccgcaagctgcccttccagcggctggtacgcgagatcgcgcaggagtttaagacggacctgcgcttccagagctcggccgtgatggcgctgcaggaggccagagaggcctacctggtggggctgttcgaagacacgaacctgtgcgccatccatgccaagcgcgtgaccatcatgcccaaggacatccagttggtcagccgcatccgcggggagcgggcctaagcgaaatccgctcctgctcccaagaagggctccaaaaaggctgttacgaaagtgcagaagaaggacggcgagaagcgcaagcgcagccgcaaggagagctactccgtttacgtgtaggaggtgctgaagcaggtccaccccgacaccggcatctcgtccaagaccatgggcatcatgaactccttcgtcaacgacatcttcgagcgcatcgcgggagaggcgtcccgcctggcgcactacaacaagcgctccaccatcacgtcccgcgagatccagacggccgtgcgcctg

SEQ ID NO: 960 - DNA, 496 bp, Homo sapiens
ctcgcttttcggttgccgttgtcttttttccttgactcggaaatgtccggtcgtggtaagcagggtggcaaggcgcgcgccaaggctaagtcgcgctcgtcgcgcgcggggctgcagttccccgtgggccgcgtgcaccggttgctccgcaagggcaactattcggagcgcgtgggcgccggcgccccggtctatctggccgcggtgctcgagtacttgactgccgagatcctggagcttgccggcaacgcggcgcgcgacaacaagaagacgcgcatcatcccgcgccacctgcagctggccatccgcaacgacgaggagctcaacaagctgctgggccgcgtgaccatcgcgcagggtggcgtcctgcccaacatccaggccgtactgctgcccaagaagacggagagccaccacaaggccaagggcaagtgaggccgcccgccgcccccggggcccctttgatggacataaaggctcttttcagagccaccta

SEQ ID NO: 961 - DNA, 452 bp, Homo sapiens
ctgtttggagagactcagccatcatgccagacccgtccaaatcggctcctgcgcccaagaagggttctaaaaaggctgtcaccaaggcacagaagaaggacggcaagaagcgcaagcgcggccgcaaggagagctattctatctacgtgtacaaggtgctgaagcaggtgcaccccgacaccggcatctcgtccaaggccatgggcatcatgaactccttcgtcaatgacatcttcgagcgcatcgccagcgaggcctcccgcctggcacactacaacaagcgctccaccatcacgtcccgcgaagtgcagacggccgttcgcctgctgctgcccggcgagctggccaagcacgccgtgtccgagggcaccaaggctgtcaccaagtacaccagctccaagtgaggcgttcctcggcgtcctgaacccaaaggctcttttcagagccaccca

SEQ ID NO: 962 - DNA, 3161 bp, Homo sapiens
cggagatggtctgaggtgggagaagagctgaagagacctggagccgacagacgggtgaaggccatgccgcctcctgggaaagttccccgaaaggagaatctgtggctacagtgtgagtgggggtcctgctcctttgtgtgctcaaccatggaaaagttctttgagcatgtcactcagcacctgcagcagcacctgcatggctctggggaggaggaggaagaggaagaggaggatgacccacttgaggaagaattctcctgcttgtggcaggaatgtggcttttgttctctggacagttctgctgacctcatccgccatgtctacttccactgctaccacaccaagctgaaacagtgggggctgcaggccttgcaaagccaggctgaccttggcccctgcatcctggacttccagagccggaacgtcatccctgatatccctgaccacttcctgtgtctgtgggagcactgtgagaattccttcgacaatcctgagtggttttatcggcatgtggaagcacacagtctgtgctgtgaatacgaagcagtcggcaaggacaacccggtggtgctgtgtggctggaaaggctgtacctgcaccttcaaggaccgcagtaaacttcgagagcacctccgcagccatacccaggagaaagtggtagcctgccccacctgtgggggcatgtttgccaacaataccaagttcttagatcacatccgtcgccagacctcattggatcagcagcacttccagtgttctcactgttccaagagatttgccacagagcggctattgcgggaccacatgcgcaaccatgtgaatcactataagtgccctctgtgtgacatgacctgcccgctgccttcctccctccgcaaccacatgcgctttcgtcacagtgaggaccggccctttaaatgtgactgttgtgactacagctgcaagaatcttattgacctccagaagcacctggatacccacagcgaggagccagcctacaggtgtgattttgagaactgcaccttcagtgcccgatccctctgctctatcaagtcccattaccgcaaagtacatgaaggagactctgagccaaggtacaaatgtcatgtgtgtgacaaatgcttcacacggggcaacaacctcaccgtgcaccttcgcaagaagcaccagttcaagtggccctcagggcatccccgttttcggtacaaggaacatgaagatggctatatgcggctgcagctggttcgctacgagagtgtagagctgacacagcaactgctgcggcaaccacaagagggatcgggcctgggaacgtcgctgaacgagagcagcctgcagggcattattctagaaacagtgccaggggagccaggacgtaaggaagaggaagaggagggcaagggtagcgaagggacagccctctcagcctctcaggacaaccccagttctgtcatccacgtggtgaatcagaccaatgcccaaggccagcaagagatcgtctactatgtgctgtctgaagccccaggggagcctcccccagcccctgagccaccttcagggggcatcatggaaaagcttcaaggaatagctgaggagccagagatccagatggtttgaaggccgcagagccagaccatttcttccccaggtcctgaagtttgagccaggcaagtggcagtgcccctagtgggcagccgttgccaatggatgcctttaggagtggtgccgagagcagtgtggtccactctggcctgggtttgcatcattctgcagactctaaagacttcccttttctgccagactacattttgtggggagcctgaggactctggattctttgaggggatcctggatgtgtgtgttcttgttaaagaggctgttatcaggcttaaccataaccctcaagatctgcttgacagtgattaaatccttagctcacatccattcccatctttcgggctccttaggcccaaggatggcatgtgactggtccctgcaagggtcctttctttgtcaccagccaaggcattgataaccaagtagccattttcctcttaaggtttcctctacaaccccaaggactttcatgattatcctcagggacaggattggaggcattgagcgtgtttattaacaaattgtttttggtaataaaataaatgcttggactcttatttatttcttcttacatttggtggcagtttactaggtaatgaggagatacagccacccagaagaggagctgaatagttaggcttgttccccttctggtgactcaggtggtttgttttttgtttgcttaactgtcctgttgtcttctcctcctccccttggtgaaacttcgctattctcagagcgtatgccatttccatggaggtcccaggtgtttggctgtgagtgggcagtagtggtgctatagaatgaacaagaatgggctcactgggaggatagggcagctgaccatggcctcactctgaatactgattagaacccagtgcctctagggtaggggttctttacctgggagtgggaaggaagctggggggtggagaggattgggaagcctcccagggaagggaggcaatcaagtggtccaggaaccaaactagaaaattgtgtgtctgaatgtgcattttcctggggaaaggatctgttttttgctagattatcaaagagattgaaacctcccaaaataagaatcatcatttcgtctggttcagctgcttctcagcaccctgtgtccatttttatggtctactgctatgctggagaggtcaaggaaatagtcttggggacaggaagctgcccaaaaaggatctctgggcctttttttgtaagacctaattctattactagaaaaactaaggctgaatgcagtggttcacgcctgtaatcccaacactttgggaggctgaggcgggcggatcacaaggtcaagagatggagaccatcctggccaacatggtgaaaccccgtctctactaaaaatataaaaatcagctgggcatggtggcacacatctgtagtcccagctactcgggaggctgaggcaggagaattgcttgaacccgggaggctgaggttgcagtgagccgagatcatgccactgcactccagcctggcgacacagtgagactccgtctcaaataaataaataaata

SEQ ID NO: 963 - DNA, 1466 bp, Homo sapiens
gaagagacctggagccgacagacgggtgaaggccatgccgcctcctgggaaagttccccgaaaggagaatctgtggctacagtgtgagtgggggtcctgctcctttgtgtgctcaaccatggaaaagttctttgagcatgtcactcagcacctgcagcagcacctgcatggctctggggaggaggaggaagaggaagaggaggatgacccacttgaggaagaattctcctgcttgtggcaggaatgtggcttttgttctctggacagttctgctgacctcatccgccatgtctacttccactgctaccacaccaagctgaaacagtgggggctgcaggccttgcaaagccaggctgaccttggcccctgcatcctggacttccagagccggaacgtcatccctgatatccctgaccacttcctgtgtctgtgggagcactgtgagaattccttcgacaatcctgagtggttttatcggcatgtggaagcacacagtctgtgctgtgaatacgaagcagtcggcaaggacaacccggtggtgctgtgtggctggaaaggctgtacctgcaccttcaaggaccgcagtaaacttcgagagcacctccgcagccatacccaggagaaagtggtagcctgccccacctgtgggggcatgtttgccaacaataccaagttcttagatcacatccgtcgccagacctcattggatcagcagcacttccagtgttctcactgttccaagagatttgccacagagcggctattgcgggaccacatgcgcaaccatgtgaatcactataagtgccctctgtgtgacatgacctgcccgctgccttcctccctccgcaaccacatgcgctttcgtcacagtgaggaccggccctttaaatgtgactgttgtgactacagctgcaagaatcttattgacctccagaagcacctggatacccacagcgaggagccagcctacaggtgtgattttgagaactgcaccttcagtgcccgatccctctgctctatcaagtcccattaccgcaaagtacatgaaggagactctgagccaaggtacaaatgtcatgtgtgtgacaaatgcttcacacggggcaacaacctcaccgtgcaccttcgcaagaagcaccagttcaagtggccctcagggcatccccgttttcgcctcggccatttctgtatccccctgcctgggtttgctgccctttatgctcctacctcaccaggtacaaggaacatgaagatggctatatgcggctgcagctggttcgctacgagagtgtagagctgacacagcaactgctgcggcaaccacaagagggatcgggcctgggaacgtcgctgaacgagagcagcctgcagggcattattctagaaacagtgccaggggagccaggacgtaaggaagaggaagaggagggcaagggtagcgaagggacagccctctcagcctctca

SEQ ID NO: 964 - DNA, 8148 bp, Homo sapiens
atggcggcggcggcgggcggcggcagttgccccgggcctggctccgcgcggggccgcttcccgggccggccgcggggcgccggcgggggcgggggccgcggcggacggggcaacggggccgaaagagtgcgggtagctctgcggcgcggcggtggcgcgacggggccgggcggagccgagcccggggaggacacggccctgctccgtttgctggggctccgccggggcctgcgccggctccgccgcctgtgggccggcccgcgggtccagcggggccggggacggggtcggggccggggctggggcccgagtcgaggctgcgtgccggaggaggagagcagtgacggggaatccgacgaggaggagtttcagggttttcattcagatgaagatgtggcccccagttccctgcgctctgcgctccgatcccagcgaggtcgagcgccccgaggtcggggtcgcaagcataagacgaccccccttcctcctcctcgcctagcagatgtggctcctacccccccaaagacccctgcccggaaacggggtgaggaaggcacagaacggatggtgcaggcactgactgaacttctccggcgggcccaggcaccccaagcaccccggagccgggcatgtgagccctccaccccccggcggtctcggggacggcccccaggacggccagcaggcccctgcaggaggaagcagcaagcagtagtggtggcagaagcagctgtgacaatccccaaacctgagcccccacctcctgtggttccagtgaaacatcagactggcagctggaaatgcaaggaggggcccggtccaggacctgggacccccaggcgtggaggacagtcaagccgtggaggccgtggaggcaggggccgcggccgaggtggtgggctcccctttgtgatcaagtttgtttcaagggccaaaaaagtaaagatgggacaattgtccttgggactcgaatcaggtcaaggtcaaggtcaacatgaggaaagttggcaggatgtcccccaaagaagagttggatctggacagggagggagcccttgctggaaaaagcaggaacagaagctggatgacgaggaagaagagaagaaagaagaagaagaaaaagacaaggagggagaagagaaggaagaaagagctgtagctgaggagatgatgccagctgcggaaaaggaagaggcaaagctgccaccaccgcctctgactcctccagccccttcacctcctccacccctcccacccccttcgacatctcctccacccccactctgccctccaccaccacccccagtgtccccaccacctctaccatcccctccaccgcctcctgcccaagaggagcaggaggaatcccctcctcctgtggtcccagctacgtgctccaggaagaggggccggcctcccctgactcccagccagcgggcggagcgggaagctgctcgggcagggccagagggcacctctcctcccactccaacccccagcaccgccacgggaggccctccggaagacagtcccaccgtggcccccaaaagcaccaccttcctgaagaatatccggcagtttattatgcctgtggtgagtgcccgctcctcccgtgtcatcaagacaccccggcgatttatggatgaagacccccccaaacccccaaaggtggaggtctcacctgtcctgcgacctcccattaccacctccccacctgttccccaggagccagcaccagtcccctctccaccacgtgccccaactcctccatctaccccagttccactccctgagaagagacggtccatcctaagggaacccacatttcgctggacctcactgacccgggagctgccccctcctcccccagcccctccacctcccccggccccctccccaccccctgctcctgccacctcctcccggaggcccctactccttcgggcccctcagtttaccccaagcgaagcccacctgaagatctacgaatcggtgcttactcctcctcctcttggggctcctgaagcccctgagccagagcctcctcctgccgatgactctccagctgagcctgagcctcgggcagtgggccgcaccaaccacctcagcctgcctcgattcgcccctgtggtcaccactcctgttaaggccgaggtgtcccctcacggggctccagctctgagcaacgggccacagacacaggctcagctactgcagcccctgcaggccttgcaaacccagctcctgccccaggcactaccgccaccacagccacagctgcagccaccgccgtcaccacagcagatgcctcccctggaaaaagcccggattgcgggcgtgggttccttgccgctgtctggggtagaggagaagatgttcagcctcctcaagagagccaaagtgcagctattcaagatcgatcagcagcagcagcagaaggtggcagcttccatgccgctgagccctggagggcagatggaggaggtggccggggctgtcaagcagatctccgacagaggccctgtccggtctgaagatgagtcggtggaagctaagagagagcggccctcaggtcccgagtcccctgtgcaaggtccccgcatcaaacatgtctgccgtcatgctgctgtggccctgggtcaggcccgggccatggtgcctgaagatgtccctcgcctcagtgccctccctctccgggatcggcaggacctcgccacagaggatacatcatcggcgtccgagactgagagtgtcccgtcacggtcccggcggggaaaggtggaggcagcaggccctgggggagaatcagagcccacaggttctggagggaccctggcccacacaccccggcgctcactgccctcccatcacggcaagaagatgcgcatggctcgatgtggacactgtcggggctgcctacgtgtgcaggactgtgggtcctgtgtcaactgcctagacaagcccaagtttgggggccctaacaccaagaagcagtgctgtgtataccggaagtgtgacaaaatagaggctcggaagatggaacgactggctaaaaaaggccggacgatagtgaagacgctgttgccctgggattccgatgaatctcctgaggcctcccctggtcctccaggcccacgccggggggcgggagctggggggccccgggaggaggtggtggcccacccagggcccgaggagcaggactccctcctgcagcgcaagtcagctcggcgctgcgtcaaacagcgaccctcctatgatatcttcgaggattcggatgactcggagcccgggggcccccctgctcctcggcgtcggaccccccgagaaaatgagctgccactgccagaacctgaggagcagagccggccccgcaaacctaccctgcagcctgtgttgcagctcaaggcccgaaggcgcctggacaaggatgctttggcccctggcccctttgcttcttttcccaatggctggactggaaagcagaagtctcccgatggtgtgcaccgcgtccgtgtggattttaaggaggattgtgatttagagaacgtgtggctgatggggggcctgagtgtgctcacctctgtgccagggggccccccgatggtgtgcttgctgtgtgccagcaaaggactccacgagctggtgttctgtcaagtctgctgtgacccattccacccattctgcctggaggaggccgagcggcccctgccccagcatcacgacacctggtgctgccgtcgctgcaaattctgccacgtctgtggacgcaaaggtcgtggatccaagcacctcctggagtgcgagcgctgccgccatgcataccacccggcctgtctggggcccagctatccaacccgggccacgcgcaaacggcgccactggatctgttcagcctgtgtgcgctgtaagagctgtggggcaactccaggcaagaactgggacgtcgagtggtctggagattacagcctctgccccaggtgcacccagctatatgagaaaggaaactactgcccgatctgtacacgctgctatgaagacaacgactatgagagcaagatgatgcagtgcgcacagtgcgatcactgggtgcatgccaagtgcgaggggctctcagatgaagactacgagatcctttcaggactgccagactcggtgctgtacacctgcggaccgtgtgctggggcagcgcagccccgctggcgagaggccctgagcggggccctccaggggggcctgcgccaggtgctccagggcctgctgagctccaaggtggtgggcccactgctgctctgcacccagtgtgggccagatgggaagcaactgcacccaggaccctgcggcctgcaagctgtgagtcagcgcttcgaggatggccactacaagtctgtgcacagcttcatggaggacatggtgggcatcctcatgcggcactcggaggagggagagaccccggaccgccgggctggaggccagatgaaggggctcctgctgaagctgctagaatctgcgttcggctggttcgacgcccacgaccccaagtactggcgacggagtacccggctgccaaacggagtccttcccaatgcggtgttgcccccatccctggatcatgtctatgcgcagtggagacagcaggaaccagagaccccagaatcagggcagcctccaggggatccctcagcagcattccagggcaaggatccggctgccttctcacacctggaggacccccgtcagtgtgcactctgcctcaaatacggggatgcagactccaaggaggcggggcggctcttgtacatcgggcagaacgagtggacacacgtcaactgtgccatctggtcggcggaagtcttcgaggagaacgacggctccctcaagaatgtgcatgctgctgtggcccgagggaggcagatgcgctgcgagctctgcctgaagcctggcgccacggtgggctgctgcctgtcctcctgcctcagcaacttccacttcatgtgtgcccgggccagctactgcatcttccaggatgacaagaaagtcttctgccagaaacacactgatctcctggatggcaaggaaattgtgaaccccgatggttttgatgttctccgccgagtctatgtggacttcgagggcatcaacttcaagcggaagttcttgacggggcttgaacccgatgccatcaacgtgctcattggttccatccgcattgactccctgggtactctgtctgatctctcggactgcgagggacggctcttccccattggctaccagtgctcccgtctgtactggagcacagtggatgctcggaggcgctgctggtatcggtgccgaattctggagtatcggccatgggggccgagggaagagccagctcacctggaggctgcagaggagaaccagaccattgtgcacagccccgccccttcctcagagcccccaggtggtgaggaccccccactggacacagatgttcttgtccctggagctcctgagcgccactcgcccattcagaacctggaccctccactgcggccagattcaggcagcgcccctcctccagccccccgttctttttcgggggctcgaatcaaagtgcccaactactcgccatcccggaggcccttggggggtgtctcctttggccccctgccctcccctggaagtccatcttcactgacccaccacatccccacagtgggagacccggacttcccagctccccccagacgttcccgtcgtcccagccctttggctcccaggccgcctccatcacggtgggcctcccctcctctaaaaacctcccctcagctcagggtgccccctcctacctcagtcgtcacagccctcacacctacctcaggggagctggctccccctggcccggccccatctccaccaccccctgaagacctgggcccagacttcgaggacatggaggtggtgtcaggactgagtgctgctgacctggacttcgcggccagcctgctggggactgagcccttccaggaagagattgtagccgctggggccatggggagcagccacgggggcccgggggacagctccgaggaggagtccagccccacctcccgctacatccacttccctgtgactgtggtgtccgcccctggtctggcccccagcgctacccctggagccccccgcattgaacagctggacggcgtggacgacggcactgacagtgaggctgaggcggtgcagcagcctcggggccagggcacgcctccttcggggccaggagtagtccgggcaggggtccttggggctgcaggggacagggcccggcctcctgaggacctgccatcggaaattgtggattttgtgttgaagaacctagggggtcctggggatggaggtgctggccctagagaggagtcactccccccggcgcctcccctggctaatggcagccagccctcccaaggcctgaccgccagcccagctgaccccacccgcacatttgcctggctcccaggggccccaggggtccgggtgttaagccttggccctgcccctgagccccccaaacccgccacatccaaaatcatacttgtcaacaagctggggcaagtatttgtgaagatggctggggagggtgaacctgtcccacccccagtgaagcagccacctttgccccccaccatttcccccacggctcccacctcctggactctgcccccaggccccctcctcggcgtgctgcccgtggtcggagtggtccgccctgccccgcccccgccaccccctcccctgacgctggtgctgagcagtgggccagccagcccgccccgccaggccatccgcgtcaagagggtgtccactttctccggccggtccccgccagcacctcccccatacaaagccccccggctggatgaagatggagaggcctcagaggatacccctcaggttccagggcttggcagtggcgggtttagccgtgtgaggatgaaaacccccacagtgcgtggggtccttgacctggatcggcctggggagcccgctggggaagaaagtcctgggcccctccaggaacggtcccctttgctgccacttccggaagatggtcctccccaggtccccgatggtcccccagacctgctgcttgagtcccagtggcaccactattcaggtgaggcttcgagctctgaggaagagcctccatccccagatgataaagagaaccaggccccaaaacggactggcccacatctgcgcttcgagatcagcagtgaggatgggttcagcgttgaggcagagagcttggagggggcgtggagaactctgatcgagaaagtgcaagaggcccgagggcatgcccgactcagacatctctcctttagtggaatgagtggggcgagactcctgggcatccaccatgatgctgtcatcttcctggccgagcagctccccggagcccagcgttgccagcactataagttccgttaccaccagcagggagagggccaggaggagccgcccctgaatccccatggggctgctcgggcagaggtctatctccggaagtgcacctttgacatgttcaacttcctggcctcccagcaccgggtgctccctgagggggccacctgtgatgaggaagaggatgaggtgcagctcaggtcaaccagacgtgccaccagcctggagctgcccatggccatgcgttttcgtcaccttaagaagacgtccaaagaagctgtgggtgtctacagatcagccatccacgggcgaggcctgttctgtaagcgcaacatcgacgcgggggagatggtcatcgagtactctggcattgtcatccgctcggtgttgactgacaagcgggagaagttctacgatgggaagggcatcgggtgctatatgttccgcatggatgactttgatgtagtggacgccacgatgcatggcaatgccgcccgcttcatcaaccactcctgtgagcccaactgcttctctcgggtcatccacgtggagggccagaaacacattgttatcttcgccctgcgccgcatcctgcgtggtgaggagctcacctacgactacaagttccccatcgaggatgccagcaacaagctgccctgcaactgtggcgccaagcgctgccgtcggttccttaactga

SEQ ID NO: 965 - DNA, 1749 bp, Homo sapiens
atggcggcggcggcgggcggcggcagttgccccgggcctggctccgcgcggggccgcttcccgggccggccgcggggcgccggcgggggcgggggccgcggcggacggggcaacggggccgaaagagtgcgggtagctctgcggcgcggcggtggcgcgacggggccgggcggagccgagcccggggaggacacggccctgctccgtttgctggggctccgccggggcctgcgccggctccgccgcctgtgggccggcccgcgggtccagcggggccggggacggggtcggggccggggctggggcccgagtcgaggctgcgtgccggaggaggagagcagtgacggggaatccgacgaggaggagtttcagggttttcattcagatgaagatgtggcccccagttccctgcgctctgcgctccgatcccagcgaggtcgagcgccccgaggtcggggtcgcaagcataagacgaccccccttcctcctcctcgcctagcagatgtggctcctacccccccaaagacccctgcccggaaacggggtgaggaaggcacagaacggatggtgcaggcactgactgaacttctccggcgggcccaggcaccccaagcaccccggagccgggcatgtgagccctccaccccccggcggtctcggggacggcccccaggacggccagcaggcccctgcaggaggaagcagcaagcagtagtggtggcagaagcagctgtgacaatccccaaacctgagcccccacctcctgtggttccagtgaaacatcagactggcagctggaaatgcaaggaggggcccggtccaggacctgggacccccaggcgtggaggacagtcaagccgtggaggccgtggaggcaggggccgcggccgaggtggtgggctcccctttgtgatcaagtttgtttcaagggccaaaaaagtaaagatgggacaattgtccttgggactcgaatcaggtcaaggtcaaggtcaacatgaggaaagttggcaggatgtcccccaaagaagagttggatctggacagggagggagcccttgctggaaaaagcaggaacagaagctggatgacgaggaagaagagaagaaagaagaagaagaaaaagacaaggagggagaagagaaggaagaaagagctgtagctgaggagatgatgccagctgcggaaaaggaagaggcaaagctgccaccaccgcctctgactcctccagccccttcacctcctccacccctcccacccccttcgacatctcctccacccccactctgccctccaccaccacccccagtgtccccaccacctctaccatcccctccaccgcctcctgcccaagaggagcaggaggaatcccctcctcctgtggtcccagctacgtgctccaggaagaggggccggcctcccctgactcccagccagcgggcggagcgggaagctgctcgggcagggccagagggcacctctcctcccactccaacccccagcaccgccacgggaggccctccggaagacagtcccaccgtggcccccaaaagcaccaccttcctgaagaatatccggcagtttattatgcctgtgcccctgagccagagcctcctcctgccgatgactctccagctgagcctgagcctcgggcagtgggccgcaccaaccacctcagcctgcctcgattcgcccctgtggtcaccactcctgttaaggccgaggtgtcccctcacggggctccagctctga

SEQ ID NO: 966 - DNA, 8469 bp, Homo sapiens
atggcggcggcggcgggcggcggcagttgccccgggcctggctccgcgcggggccgcttcccgggccggccgcggggcgccggcgggggcgggggccgcggcggacggggcaacggggccgaaagagtgcgggtagctctgcggcgcggcggtggcgcgacggggccgggcggagccgagcccggggaggacacggccctgctccgtttgctggggctccgccggggcctgcgccggctccgccgcctgtgggccggcccgcgggtccagcggggccggggacggggtcggggccggggctggggcccgagtcgaggctgcgtgccggaggaggagagcagtgacggggaatccgacgaggaggagtttcagggttttcattcagatgaagatgtggcccccagttccctgcgctctgcgctccgatcccagcgaggtcgagcgccccgaggtcggggtcgcaagcataagacgaccccccttcctcctcctcgcctagcagatgtggctcctacccccccaaagacccctgcccggaaacggggtgaggaaggcacagaacggatggtgcaggcactgactgaacttctccggcgggcccaggcaccccaagcaccccggagccgggcatgtgagccctccaccccccggcggtctcggggacggcccccaggacggccagcaggcccctgcaggaggaagcagcaagcagtagtggtggcagaagcagctgtgacaatccccaaacctgagcccccacctcctgtggttccagtgaaacatcagactggcagctggaaatgcaaggaggggcccggtccaggacctgggacccccaggcgtggaggacagtcaagccgtggaggccgtggaggcaggggccgcggccgaggtggtgggctcccctttgtgatcaagtttgtttcaagggccaaaaaagtaaagatgggacaattgtccttgggactcgaatcaggtcaaggtcaaggtcaacatgaggaaagttggcaggatgtcccccaaagaagagttggatctggacagggagggagcccttgctggaaaaagcaggaacagaagctggatgacgaggaagaagagaagaaagaagaagaagaaaaagacaaggagggagaagagaaggaagaaagagctgtagctgaggagatgatgccagctgcggaaaaggaagaggcaaagctgccaccaccgcctctgactcctccagccccttcacctcctccacccctcccacccccttcgacatctcctccacccccactctgccctccaccaccacccccagtgtccccaccacctctaccatcccctccaccgcctcctgcccaagaggagcaggaggaatcccctcctcctgtggtcccagctacgtgctccaggaagaggggccggcctcccctgactcccagccagcgggcggagcgggaagctgctcgggcagggccagagggcacctctcctcccactccaacccccagcaccgccacgggaggccctccggaagacagtcccaccgtggcccccaaaagcaccaccttcctgaagaatatccggcagtttattatgcctgtggtgagtgcccgctcctcccgtgtcatcaagacaccccggcgatttatggatgaagacccccccaaacccccaaaggtggaggtctcacctgtcctgcgacctcccattaccacctccccacctgttccccaggagccagcaccagtcccctctccaccacgtgccccaactcctccatctaccccagttccactccctgagaagagacggtccatcctaagggaacccacatttcgctggacctcactgacccgggagctgccccctcctcccccagcccctccacctcccccggccccctccccaccccctgctcctgccacctcctcccggaggcccctactccttcgggcccctcagtttaccccaagcgaagcccacctgaagatctacgaatcggtgcttactcctcctcctcttggggctcctgaagcccctgagccagagcctcctcctgccgatgactctccagctgagcctgagcctcgggcagtgggccgcaccaaccacctcagcctgcctcgattcgcccctgtggtcaccactcctgttaaggccgaggtgtcccctcacggggctccagctctgagcaacgggccacagacacaggctcagctactgcagcccctgcaggccttgcaaacccagctcctgccccaggcactaccgccaccacagccacagctgcagccaccgccgtcaccacagcagatgcctcccctggaaaaagcccggattgcgggcgtgggttccttgccgctgtctggggtagaggagaagatgttcagcctcctcaagagagccaaagtgcagctattcaagatcgatcagcagcagcagcagaaggtggcagcttccatgccgctgagccctggagggcagatggaggaggtggccggggctgtcaagcagatctccgacagaggccctgtccggtctgaagatgagtcggtggaagctaagagagagcggccctcaggtcccgagtcccctgtgcaaggtccccgcatcaaacatgtctgccgtcatgctgctgtggccctgggtcaggcccgggccatggtgcctgaagatgtccctcgcctcagtgccctccctctccgggatcggcaggacctcgccacagaggatacatcatcggcgtccgagactgagagtgtcccgtcacggtcccggcggggaaaggtggaggcagcaggccctgggggagaatcagagcccacaggttctggagggaccctggcccacacaccccggcgctcactgccctcccatcacggcaagaagatgcgcatggctcgatgtggacactgtcggggctgcctacgtgtgcaggactgtgggtcctgtgtcaactgcctagacaagcccaagtttgggggccctaacaccaagaagcagtgctgtgtataccggaagtgtgacaaaatagaggctcggaagatggaacgactggctaaaaaaggccggacgatagtgaagacgctgttgccctgggattccgatgaatctcctgaggcctcccctggtcctccaggcccacgccggggggcgggagctggggggccccgggaggaggtggtggcccacccagggcccgaggagcaggactccctcctgcagcgcaagtcagctcggcgctgcgtcaaacagcgaccctcctatgatatcttcgaggattcggatgactcggagcccgggggcccccctgctcctcggcgtcggaccccccgagaaaatgagctgccactgccagaacctgaggagcagagccggccccgcaaacctaccctgcagcctgtgttgcagctcaaggcccgaaggcgcctggacaaggatgctttggcccctggcccctttgcttcttttcccaatggctggactggaaagcagaagtctcccgatggtgtgcaccgcgtccgtgtggattttaaggaggattgtgatttagagaacgtgtggctgatggggggcctgagtgtgctcacctctgtgccagggggccccccgatggtgtgcttgctgtgtgccagcaaaggactccacgagctggtgttctgtcaagtctgctgtgacccattccacccattctgcctggaggaggccgagcggcccctgccccagcatcacgacacctggtgctgccgtcgctgcaaattctgccacgtctgtggacgcaaaggtcgtggatccaagcacctcctggagtgcgagcgctgccgccatgcataccacccggcctgtctggggcccagctatccaacccgggccacgcgcaaacggcgccactggatctgttcagcctgtgtgcgctgtaagagctgtggggcaactccaggcaagaactgggacgtcgagtggtctggagattacagcctctgccccaggtgcacccagctatatgagaaaggaaactactgcccgatctgtacacgctgctatgaagacaacgactatgagagcaagatgatgcagtgcgcacagtgcgatcactgggtgcatgccaagtgcgaggggctctcagatgaagactacgagatcctttcaggactgccagactcggtgctgtacacctgcggaccgtgtgctggggcagcgcagccccgctggcgagaggccctgagcggggccctccaggggggcctgcgccaggtgctccagggcctgctgagctccaaggtggtgggcccactgctgctctgcacccagtgtgggccagatgggaagcaactgcacccaggaccctgcggcctgcaagctgtgagtcagcgcttcgaggatggccactacaagtctgtgcacagcttcatggaggacatggtgggcatcctcatgcggcactcggaggagggagagaccccggaccgccgggctggaggccagatgaaggggctcctgctgaagctgctagaatctgcgttcggctggttcgacgcccacgaccccaagtactggcgacggagtacccggctgccaaacggagtccttcccaatgcggtgttgcccccatccctggatcatgtctatgcgcagtggagacagcaggaaccagagaccccagaatcagggcagcctccaggggatccctcagcagcattccagggcaaggatccggctgccttctcacacctggaggacccccgtcagtgtgcactctgcctcaaatacggggatgcagactccaaggaggcggggcggctcttgtacatcgggcagaacgagtggacacacgtcaactgtgccatctggtcggcggaagtcttcgaggagaacgacggctccctcaagaatgtgcatgctgctgtggcccgagggaggcagatgcgctgcgagctctgcctgaagcctggcgccacggtgggctgctgcctgtcctcctgcctcagcaacttccacttcatgtgtgcccgggccagctactgcatcttccaggatgacaagaaagtcttctgccagaaacacactgatctcctggatggcaaggaaattgtgaaccccgatggttttgatgttctccgccgagtctatgtggacttcgagggcatcaacttcaagcggaagttcttgacggggcttgaacccgatgccatcaacgtgctcattggttccatccgcattgactccctgggtactctgtctgatctctcggactgcgagggacggctcttccccattggctaccagtgctcccgtctgtactggagcacagtggatgctcggaggcgctgctggtatcggtgccgaattctggagtatcggccatgggggccgagggaagagccagctcacctggaggctgcagaggagaaccagaccattgtgcacagccccgccccttcctcagagcccccaggtggtgaggaccccccactggacacagatgttcttgtccctggagctcctgagcgccactcgcccattcagaacctggaccctccactgcggccagattcaggcagcgcccctcctccagccccccgttctttttcgggggctcgaatcaaagtgcccaactactcgccatcccggaggcccttggggggtgtctcctttggccccctgccctcccctggaagtccatcttcactgacccaccacatccccacagtgggagacccggacttcccagctccccccagacgttcccgtcgtcccagccctttggctcccaggccgcctccatcacggtgggcctcccctcctctaaaaacctcccctcagctcagggtgccccctcctacctcagtcgtcacagccctcacacctacctcaggggagctggctccccctggcccggccccatctccaccaccccctgaagacctgggcccagacttcgaggacatggaggtggtgtcaggactgagtgctgctgacctggacttcgcggccagcctgctggggactgagcccttccaggaagagattgtagccgctggggccatggggagcagccacgggggcccgggggacagctccgaggaggagtccagccccacctcccgctacatccacttccctgtgactgtggtgtccgcccctggtctggcccccagcgctacccctggagccccccgcattgaacagctggacggcgtggacgacggcactgacagtgaggctgaggcggtgcagcagcctcggggccagggcacgcctccttcggggccaggagtagtccgggcaggggtccttggggctgcaggggacagggcccggcctcctgaggacctgccatcggaaattgtggattttgtgttgaagaacctagggggtcctggggatggaggtgctggccctagagaggagtcactccccccggcgcctcccctggctaatggcagccagccctcccaaggcctgaccgccagcccagctgaccccacccgcacatttgcctggctcccaggggccccaggggtccgggtgttaagccttggccctgcccctgagccccccaaacccgccacatccaaaatcatacttgtcaacaagctggggcaagtatttgtgaagatggctggggagggtgaacctgtcccacccccagtgaagcagccacctttgccccccaccatttcccccacggctcccacctcctggactctgcccccaggccccctcctcggcgtgctgcccgtggtcggagtggtccgccctgccccgcccccgccaccccctcccctgacgctggtgctgagcagtgggccagccagcccgccccgccaggccatccgcgtcaagagggtgtccactttctccggccggtccccgccagcacctcccccatacaaagccccccggctggatgaagatggagaggcctcagaggatacccctcaggttccagggcttggcagtggcgggtttagccgtgtgaggatgaaaacccccacagtgcgtggggtccttgacctggatcggcctggggagcccgctggggaagaaagtcctgggcccctccaggaacggtcccctttgctgccacttccggaagatggtcctccccaggtccccgatggtcccccagacctgctgcttgagtcccagtggcaccactattcaggtgaggcttcgagctctgaggaagagcctccatccccagatgataaagagaaccaggccccaaaacggactggcccacatctgcgcttcgagatcagcagtgaggatgggttcagcgttgaggcagagagcttggagggggcgtggagaactctgatcgagaaagtgcaagaggcccgagggcatgcccgactcagacatctctcctttagtggaatgagtggggcgagactcctgggcatccaccatgatgctgtcatcttcctggccgagcagctccccggagcccagcgttgccagcactataagttccgttaccaccagcagggagagggccaggaggagccgcccctgaatccccatggggctgctcgggcagaggtctatctccggaagtgcacctttgacatgttcaacttcctggcctcccagcaccgggtgctccctgagggggccacctgtgatgaggaagaggatgaggtgcagctcaggtcaaccagacgtgccaccagcctggagctgcccatggccatgcgttttcgtcaccttaagaagacgtccaaagaagctgtgggtgtctacagatcagccatccacgggcgaggcctgttctgtaagcgcaacatcgacgcgggggagatggtcatcgagtactctggcattgtcatccgctcggtgttgactgacaagcgggagaagttctacgatgggaagggcatcgggtgctatatgttccgcatggatgactttgatgtagtggacgccacgatgcatggcaatgccgcccgcttcatcaaccactcctgtgagcccaactgcttctctcgggtcatccacgtggagggccagaaacacattgttatcttcgccctgcgccgcatcctgcgtggtgaggagctcacctacgactacaagttccccatcgaggatgccagcaacaagctgccctgcaactgtggcgccaagcgctgccgtcggttccttaactgaggccgtggctgcccaccacgacccctcacacctcctgctgccgtcgctgccatcttgcccctagcctgggggctccctagcccctcccagagcatctcacccccaccctcatgttcagggtggatgtgggcatgcaggtgacaagggccctgcctccacccctccagcccatccagcaatcgccccctttctgccctgggggcccaggatgtagatattgtacaaaggtttctaaatcccttcttttctatgcacttttttatttaagaggtggggtcccaggtgggaacccccccacaataaagtctgtcaatgtttgga

SEQ ID NO: 967 - DNA, 2775 bp, Homo sapiens
gcagccgccgagcggccgcgatttcccggggactgctggggcgcagcggggaggcgggccggggggcggcggggcgcgagcagagcgcggttgacctccctttctctgctcagctccagcgtcatttcggcctcttagttcttctgaaccctgctcctgagctaggtaggaaacatgagcggcaccaacttggatgggaacgatgagtttgatgagcagttgcgaatgcaagaattgtacggagacggcaaggatggtgacacccagaccgatgccggcggagaacccgattctctcgggcagcagccgacggacactccctacgagtgggacctggacaaaaaggcttggttccccaagattactgaagatttcattgctacatatcaggccaattatggcttctctaacgatggcgcatctagttctaccgcaaatgttgaagatgtccatgctaggactgcagaggaacctccacaagaaaaagccccggaacccactgatgccagaaagaagggagaaaaaagaaaggctgagtcaggatggtttcatgttgaagaagacagaaatacaaatgtatacgtgtctggtttgcctccagatattacagtggatgaatttatacaacttatgtccaagtttggcattattatgagagatcctcagacagaagaatttaaggtcaaactttacaaagataatcaaggaaatcttaaaggagacggtctttgctgttatttgaaaagagaatctgtggaacttgcattaaaacttttggatgaagatgaaattagaggctacaaattacatgttgaggtggcaaagtttcaactgaagggagaatatgatgcctcaaagaagaagaagaagtgcaaagactataagaagaagctgtctatgcaacaaaagcagttggattggagacctgagaggcgagccggaccatcccggatgcgccatgagcgagttgtcatcatcaagaatatgtttcatcctatggattttgaggatgatccgttggtgctgaatgagatcagagaagaccttcgagtagagtgttcgaagtttggacaaattaggaaactccttctctttgataggcacccagatggtgtggcctctgtgtcctttcgggatccagaggaagctgattattgtattcagactctcgatggaagatggtttggtggccgtcaaatcactgcccaggcatgggatgggactacagattatcaggtggaggaaacctcaagagaaagggaggaaaggctgagaggatgggaggctttcctcaatgctcctgaggccaacagaggccttaggcgttcagattctgtctctgcttccgaaagggcagggccttctagagcaaggcatttttcagagcaccccagcacatctaaaatgaatgctcaagaaactgcaactggaatggcgtttgaagaacctatagatgagaagaagtttgaaaagacagaagatgggggagaatttgaagaaggtgcttctgaaaacaatgctaaggaaagtagccccgaaaaagaggctgaagaaggctgccctgaaaaagaatctgaagagggctgccccaaaagagggtttgaaggcagctgctcccaaaaagagtctgaagaaggcaatcccgtaagaggatctgaagaggatagtcctaaaaaagagtctaaaaagaagacactcaaaaatgattgtgaagagaatggccttgcaaaggaatctgaagatgacctcaacaaggagtctgaagaggaggttggccccacaaaagagtccgaagaagatgactcagagaaagagtctgatgaagactgctctgaaaaacagtctgaagatggctccgaaagagaatttgaagaaaatggtctcgagaaagatttggacgaggaaggttctgaaaaggagcttcatgaaaatgttcttgacaaagagttagaagaaaatgactctgaaaactccgaatttgaagatgacggctctgaaaaagtgttagatgaggaaggctctgagagagagtttgacgaagattcagatgaaaaggaagaagaggaggatacatatgaaaaagtatttgatgatgagtctgatgagaaagaggatgaagaatatgcagatgaaaaggggcttgaagctgctgataaaaaggcggaagaaggtgatgcagatgaaaagctgtttgaagagtcagatgacaaggaagatgaagatgcagatggaaaggaagttgaagatgctgacgaaaagttgttcgaagatgatgattccaatgagaagttgtttgatgaggaggaagattccagtgagaagttgtttgacgattctgatgagagggggactttgggtggttttgggagtgttgaagaagggcccctatccactggcagcagctttattctcagtagcgatgatgatgacgatgatatttaatcccttaaacttgctttttagggagagtcctccatctacatttgcctgtgcttcagggtaattactagtagtgttacatgaacatgtgcatagtggtaggatgccatcagattaaagcattgaagtgtttcattgttacctgtacctaatggttttaaatatatgttaattgattgtttagttaaaatgtcatagttacaatgcaagtaaactggatacttgttcttttgtcagatttgttaaatgcatgcagaataatatttttaagagtattgattgaagtttgtgatattcatcaataaaaatgagttgataatatgcagaaactgaaaa

SEQ ID NO: 968 - DNA, 2611 bp, Homo sapiens
gaggcgggccggggggcggcggggcgcgagcagagcgcggttgacctccctttctctgctcagctccagcgtcatttcggcctcttagttcttctgaaccctgctcctgagctaggtaggaaacatgagcggcaccaacttggatgggaacgatgagtttgatgagcagttgcgaatgcaagaattgtacggagacggcaaggatggtgacacccagaccgatgccggcggagaacccgattctctcgggcagcagccgacggacactccctacgagtgggacctggacaaaaaggcttggttccccaagattactgaagatttcattgctacatatcaggccaattatggcttctctaacgatggcgcatctagttctaccgcaaatgttgaagatgtccatgctaggactgcagaggaacctccacaagaaaaagccccggaacccactgatgccagaaagaagggagaaaaaagaaaggctgagtcaggatggtttcatgttgaagaagacagaaatacaaatgtatacgtgtctggtttgcctccagatattacagtggatgaatttatacaacttatgtccaagtttggcattattatgagagatcctcagacagaagaatttaaggtcaaactttacaaagataatcaaggaaatcttaaaggagacggtctttgctgttatttgaaaagagaatctgtggaacttgcattaaaacttttggatgaagatgaaattagaggctacaaattacatgttgaggtggcaaagtttcaactgaagggagaatatgatgcctcaaagaagaagaagaagtgcaaagactataagaagaagctgtctatgcaacaaaagcagttggattggagacctgagaggcgagccggaccatcccggatgcgccatgagcgagttgtcatcatcaagaatatgtttcatcctatggattttgaggatgatccgttggtgctgaatgagatcagagaagaccttcgagtagagtgttcgaagtttggacaaattaggaaactccttctctttgataggcacccagatggtgtggcctctgtgtcctttcgggatccagaggaagctgattattgtattcagactctcgatggaagatggtttggtggccgtcaaatcactgcccaggcatgggatgggactacagattatcaggtggaggaaacctcaagagaaagggaggaaaggctgagaggatgggaggctttcctcaatgctcctgaggccaacagaggccttaggcgttcagattctgtctctgcttccgaaagggcagggccttctagagcaaggcatttttcagagcaccccagcacatctaaaatgaatgctcaagaaactgcaactggaatggcgtttgaagaacctatagatgagaagaagtttgaaaagacagaagatgggggagaatttgaagaaggtgcttctgaaaacaatgctaaggaaagtagccccgaaaaagaggctgaagaaggctgccctgaaaaagaatctgaagagggctgccccaaaagagggtttgaaggcagctgctcccaaaaagagtctgaagaaggcaatcccgtaagaggatctgaagaggatagtcctaaaaaagagtctaaaaagaagacactcaaaaatgattgtgaagagaatggccttgcaaaggaatctgaagatgacctcaacaaggagtctgaagaggaggttggccccacaaaagagtccgaagaagatgactcagagaaagagtctgatgaagactgctctgaaaaacagtctgaagatggctccgaaagagaatttgaagaaaatggtctcgagaaagatttggacgaggaaggttctgaaaaggagcttcatgaaaatgttcttgacaaagagttagaagaaaatgactctgaaaactccgaatttgaagatgacggctctgaaaaagtgttagatgaggaaggctctgagagagagtttgacgaagattcagatgaaaaggaagaagaggaggatacatatgaaaaagtatttgatgatgagtctgatgagaaagaggatgaagatgcagatggaaaggaagttgaagatgctgacgaaaagttgttcgaagatgatgattccaatgagaagttgtttgatgaggaggaagattccagtgagaagttgtttgacgattctgatgagagggggactttgggtggttttgggagtgttgaagaagggcccctatccactggcagcagctttattctcagtagcgatgatgatgacgatgatatttaatcccttaaacttgctttttagggagagtcctccatctacatttgcctgtgcttcagggtaattactagtagtgttacatgaacatgtgcatagtggtaggatgccatcagattaaagcattgaagtgtttcattgttacctgtacctaatggttttaaatatatgttaattgattgtttagttaaaatgtcatagttacaatgcaagtaaactggatacttgttcttttgtcagatttgttaaatgcatgcagaataatatttttaagagtattgattgaagtttgtgatattcatcaataaaaatgagttgataatatgc

SEQ ID NO: 969 - DNA, 885 bp, Homo sapiens
gcgacgtcgccacgcgccgacaatggcggctgcgtcggcctgagcagggcttagtttagaagtaatttcctgacgttgccgagggagccgcagtcgcctcagatccggtcggcggcggcggcggtggcggcggcggcagcgcgcctgcgcgctcccgcagcgccctggacctagcggcggtgccgaggcccggcggagcaagccaggtaggaaacatgagcggcaccaacttggatgggaacgatgagtttgatgagcagttgcgaatgcaagaattgtacggagacggcaaggatggtgacacccagaccgatgccggcggagaacccgattctctcgggcagcagccgacggacactccctacgagtgggacctggacaaaaaggcttggttccccaagattactgaagatttcattgctacatatcaggccaattatggcttctctaacgatggcgcatctagttctaccgcaaatgttgaagatgtccatgctaggactgcagaggaacctccacaagaaaaagccccggaacccactgatgccagaaagaagggagaaaaaagaaaggctgagtcaggatggtttcatgttgaagaagacagaaatacaaatgtatacgtgtctggtttgcctccagatattacagtggatgaatttatacaacttatgtccaagtttggcattattatgagagatcctcagacagaagaatttaaggtcaaactttacaaagataatcaaggaaatcttaaaggagacggtctttgctgttatttgaaaagagaatctgtggaacttgcattaaaacttttggatgaagatgaaattagaggctacaaattacatgttgaggtggcaaagtttcaactgaagggagaat

SEQ ID NO: 970 - DNA, 1014 bp, Homo sapiens
gtcggcgcgacccgcgacgtcgccacgcgccgacaatggcggctgcgtcggcctgagcagggcttagtttagaagtaatttcctgacgttgccgagggagccgcagtcgcctcagatccggtcggcggcggcggcggtggcggcggcggcagcgcgcctgcgcgctcccgcagcgccctggacctagcggcggtgccgaggcccggcggagcaagccagctccagcgtcatttcggcctcttagttcttctgaaccctgctcctgagctaggtaggaaacatgagcggcaccaacttggatgggaacgatgagtttgatgagcagttgcgaatgcaagaattgtacggagacggcaaggatggtgacacccagaccgatgccggcggagaacccgattctctcgggcagcagccgacggacactccctacgagtgggacctggacaaaaaggcttggttccccaagattactgaagatttcattgctacatatcaggccaattatggcttctctaacgatggcgcatctagttctaccgcaaatgttgaagatgtccatgctaggactgcagaggaacctccacaagaaaaagccccggaacccactgatgccagaaagaagggagaaaaaagaaaggctgagtcaggatggtttcatgttgaagaagacagaaatacaaatgtatacgtgtctggtttgcctccagatattacagtggatgaatttatacaacttatgtccaagtttggcattattatgagagatcctcagacagaagaatttaaggtcaaactttacaaagataatcaaggaaatcttaaaggagacggtctttgctgttatttgaaaagagaatctgtggaacttgcattaaaacttttggatgaagatgaaattagaggctacaaattacatgttgaggtggcaaagtttcaactgaagggagaatatgatgcctcaaagaagaagaagaagtgcaaagactataagaagaagctgtctatgcaacaaaa

SEQ ID NO: 971 - DNA, 3019 bp, Homo sapiens
agtggccctcgccccgccccaaacccgaccccggtgggcgtcgacgcgcagcagcagcgggtccccccaaccccggcgccccgcctccccgggcctcgcgccgcatgccggcgtcggcgctttttgacgccatagtgggcgtgtcggcgcgacccgcgacgtcgccacgcgccgacaatggcggctgcgtcggcctgagcagggcttagtttagaagtaatttcctgacgttgccgagggagccgcagtcgcctcagatccggtcggcggcggcggcggtggcggcggcggcagcgcgcctgcgcgctcccgcagcgccctggacctagcggcggtgccgaggcccggcggagcaagccagctccagcgtcatttcggcctcttagttcttctgaaccctgctcctgagctaggtaggaaacatgagcggcaccaacttggatgggaacgatgagtttgatgagcagttgcgaatgcaagaattgtacggagacggcaaggatggtgacacccagaccgatgccggcggagaacccgattctctcgggcagcagccgacggacactccctacgagtgggacctggacaaaaaggcttggttccccaagattactgaagatttcattgctacatatcaggccaattatggcttctctaacgatggcgcatctagttctaccgcaaatgttgaagatgtccatgctaggactgcagaggaacctccacaagaaaaagccccggaacccactgatgccagaaagaagggagaaaaaagaaaggctgagtcaggatggtttcatgttgaagaagacagaaatacaaatgtatacgtgtctggtttgcctccagatattacagtggatgaatttatacaacttatgtccaagtttggcattattatgagagatcctcagacagaagaatttaaggtcaaactttacaaagataatcaaggaaatcttaaaggagacggtctttgctgttatttgaaaagagaatctgtggaacttgcattaaaacttttggatgaagatgaaattagaggctacaaattacatgttgaggtggcaaagtttcaactgaagggagaatatgatgcctcaaagaagaagaagaagtgcaaagactataagaagaagctgtctatgcaacaaaagcagttggattggagacctgagaggcgagccggaccatcccggatgcgccatgagcgagttgtcatcatcaagaatatgtttcatcctatggattttgaggatgatccgttggtgctgaatgagatcagagaagaccttcgagtagagtgttcgaagtttggacaaattaggaaactccttctctttgataggcacccagatggtgtggcctctgtgtcctttcgggatccagaggaagctgattattgtattcagactctcgatggaagatggtttggtggccgtcaaatcactgcccaggcatgggatgggactacagattatcaggtggaggaaacctcaagagaaagggaggaaaggctgagaggatgggaggctttcctcaatgctcctgaggccaacagaggccttaggcgttcagattctgtctctgcttccgaaagggcagggccttctagagcaaggcatttttcagagcaccccagcacatctaaaatgaatgctcaagaaactgcaactggaatggcgtttgaagaacctatagatgagaagaagtttgaaaagacagaagatgggggagaatttgaagaaggtgcttctgaaaacaatgctaaggaaagtagccccgaaaaagaggctgaagaaggctgccctgaaaaagaatctgaagagggctgccccaaaagagggtttgaaggcagctgctcccaaaaagagtctgaagaaggcaatcccgtaagaggatctgaagaggatagtcctaaaaaagagtctaaaaagaagacactcaaaaatgattgtgaagagaatggccttgcaaaggaatctgaagatgacctcaacaaggagtctgaagaggaggttggccccacaaaagagtccgaagaagatgactcagagaaagagtctgatgaagactgctctgaaaaacagtctgaagatggctccgaaagagaatttgaagaaaatggtctcgagaaagatttggacgaggaaggttctgaaaaggagcttcatgaaaatgttcttgacaaagagttagaagaaaatgactctgaaaactccgaatttgaagatgacggctctgaaaaagtgttagatgaggaaggctctgagagagagtttgacgaagattcagatgaaaaggaagaagaggaggatacatatgaaaaagtatttgatgatgagtctgatgagaaagaggatgaagaatatgcagatgaaaaggggcttgaagctgctgataaaaaggcggaagaaggtgatgcagatgaaaagctgtttgaagagtcagatgacaaggaagatgaagatgcagatggaaaggaagttgaagatgctgacgaaaagttgttcgaagatgatgattccaatgagaagttgtttgatgaggaggaagattccagtgagaagttgtttgacgattctgatgagagggggactttgggtggttttgggagtgttgaagaagggcccctatccactggcagcagctttattctcagtagcgatgatgatgacgatgatatttaatcccttaaacttgctttttagggagagtcctccatctacatttgcctgtgcttcagggtaattactagtagtgttacatgaacatgtgcatagtggtaggatgccatcagattaaagcattgaagtgtttcattgttacctgtacctaatggttttaaatatatgttaattgattgtttagttaaaatgtcatagttacaatgcaagtaaactggatacttgttcttttgtcagatttgttaaatgcatgcagaataatatttttaagagtattgattgaagtttgtgatattcatcaataaaaatgagttgataatatgcagaaactg

SEQ ID NO: 972 - DNA, 4974 bp, Homo sapiens
gccgggacgggtctccctggcgatccgtggtgtgccgctactgccggtgcagccgccaaaccggtgcctcggtgacgaccgtgtccctgccgtcttcctcgagctccccggggcttgacccccggggccctcggcaggcatcggtgaggagcctgcggagcgaacctgtgctcctattcttgcccttcaggaccccatatcgcgactccgaggaggggaagcgagaggggctgtcgcgactccgcgccgtgtgtcgccgggcggggccgcggggccggggctccttcagcccccgggatgcgcgcgcgagccctcgcctccacttccttgttgctgctgtcacgactggagccgcctctcgccgacagcggggagcgcgagtgcgccagccatccccctcgtccagccgccgggccaagcgcctccgggaatgtgagcggcgcagcttgcacgctcctccggccatggacgcatcatatgatggtactgaggtaactgtcgtgatggaggaaattgaggaagcctattgttacacctctcctgggccacccaagaagaagaaaaagtataaaatacatggagaaaagacaaagaaacccaggtctgcttaccttctgtactattacgacatctacctgaaagtgcagcaggagctcccccacctccctcagtctgagatcaataagaagattagtgagagttggaggcttctcagcgtggccgagaggagttactacttggagaaagccaaactagagaaggaaggtttggatcctaactctaagctctctgcactgactgctgtggttccggacatcccaggtttccgcaagatcctcccacgctcagattatatcatcatccccaagagcagcctgcaggaggaccggagctgccctcagctagagctatgtgtggctcagaaccagatgtccccgaaaggacctcctcttgtgtccaacactgccccggagacagtgcccagccatgcaggcatggcagagcagtgcctggctgtggaggccctggctgaggaggtgggagcccttacccagtcaggtgctgtacaggagattgccacctcagagatcctcagccaggatgtgctcctagaggacgcttccctagaagtaggggagagccaccaaccttaccagacaagcctggtaattgaagagaccttggtgaatggctcaccagacctccccactggaagcctggctgtgccccacccccaggttggggagagtgtatcagtggtaacagtcatgagggattccagtgagagtagctcctctgcaccagccacacagttcatcatgttgcctctgcctgcctactcggttgtggagaaccccacctccatcaaactgaccactacatatacccgccggggccatgggacatgcaccagcccagggtgctcctttacatatgtcaccaggcacaagccacctaagtgccctacctgtggtaacttcctaggagggaagtggatcccaaaggaaaagccagccaaagtaaaagtggaattggcttctggcgtctcttccaaaggctctgtggtgaaaagaaatcagcaacctgtcaccactgagcaaaattcctctaaggaaaatgcctccaaactgactctggagaattcggaagctgtaagccagctcctgaacgtagctcctcccagagaagtaggtgaggagagtgagtgggaggaagtgatcatctccgatgcccatgttttggttaaggaagctcccgggaattgtggtacagcagtcactaagacgccagtcgtcaaaagtggtgtgcagcctgaggtcactctggggacaactgacaatgacagtcctggagcagacgtaccaacaccatccgaggggacaagtacctccagtccactccctgctcctaaaaaacctacaggagctgacctgcttacccctgggtccagagctccagagcttaaaggcagagcacggggcaagccctcattactggctgcagcaagacccatgagagcaattttgccagccccagttaacgtggggcgaggcagcagcatgggactgcccagggccaggcaggccttttccctgagtgataagactccctctgtgaggacttgtggtctgaagccaagcacactgaagcagctgggccagcccattcaacagccatctggccctggtgaggtgaagctaccaagtggcccatccaacaggacttctcaggtgaaagttgtggaggtcaagcccgatatgtttcctccatataagtacagctgcactgtcacattggatttgggcctggctacatcaagaggccggggaaagtgcaagaatccctcttgtagctatgtctacaccaacaggcacaaacctcgaatttgtcccagctgtggtgttaaccttgccaaagaccggactgagaaaaccaccaaggctatcgaggtgagctcaccactcccagatgtactgaatgccacagagcccctgagcacagcccagagggagatccagcgccagtccacactgcagctgctgcgcaaagtcctgcagattcctgagaatgagtcagagctggctgaggtcttcgccttgattcatgaactcaacagctctcgacttatcttgtccaacgtgagtgaggagacagtcaccatcgagcaaacctcttggtcgaattattatgagtctccgtccacgcagtgccttctctgtagcagcccattattcaaagggggacaaaactccctggctgggccccaggagtgctggctgctgacagccagccgtctgcagacagtgactgcccaggtgaagatgtgtctgaacccccattgtctggccctgcacagcttcatagacatctacacaggtctctttaatgtggggaacaagctgctggtaagcctggacttgctttttgcaatcagaaatcagatcaagctcggagaggaccccagagtgtccatcaatgttgttctgaagtcggtgcaggagcagacagagaagactctgacctcggaggagctgagccagctgcaggagctgctgtgcaatggctattgggcctttgagtgcctcactgtccgagactacaatgacatgatctgtggcatctgtggtgtggcccccaaagtggaaatggctcagaggagtgaagagaatgtgctagcactgaagagcgtggagttcacctggcctgaattcctgggctctaatgaggtaaatgtggaggacttttgggccacgatggagacagaggtgattgagcaggtggcatttcctgccagcatccctatcaccaaatttgatgcgtctgttattgcccccttcttcccaccactcatgagaggagctgtggtcgtcaacactgagaaagacaaaaacctggatgtgcagccagtacctggcagtggcagtgccttggtgaggctgctccaggagggcacctgcaagcttgatgagattggctcctacagtgaagagaagctgcagcacctgctaaggcagtgtggaatcccctttggggcagaagactccaaggaccagctctgcttctccttgttggccctctacgaatctgtacagaatggagctagagctatacggcccccacgtcacttcacaggtggtaaaatctacaaggtgtgcccccatcaggtggtctgcggctccaagtatcttgtgcgaggtgagagtgcccgtgaccatgtggacctgcttgcctcttcccgccactggccgcctgtctatgtggtagatatggccacgtcagtggccctgtgtgctgacctctgctacccagagctgactaaccagatgtgggggaggaaccagggctgtttctctagccccacagagccacctgtgagtgtgtcctgcccagagctcttggaccagcattatactgtggacatgacagaaactgagcactctatccagcacccagtcaccaagactgccacgcggcgcatcgtccatgcaggcctacagcccaatcctggtgaccccagtgctgggcaccactccttggccctgtgccctgaattggcaccttacgcaaccatcctggcctccatcgtggacagcaaaccaaacggtgtccgccagcggcccattgccttcgacaatgccactcactattacctctacaaccgcctcatggacttcctcaccagccgcgaaattgtcaatcgtcagatccatgacattgtacagagctgccagcctggtgaggtggtcattcgtgacaccctctaccgccttggggttgctcagatcaagacagagacagaggaggagggtgaggaagaggaggtggccgcagtggcagaataagccaggctgttgtacagggactacaccatctctcaagccatagtaaggcccttgcctgaggcagagctatccaggggacctgcagaagtggtctcctgtggggagggcctctgactgctgggactgaccaaagagcttccattccctgagcatggtgggacccagggtcctcagttctcaaccctccaggggtcaggagtggtaccaggaaacctcttctggccccgagagagcacttgggggacacggtatgtttaatggaggggaggctgagggaaaggctcgtagctggtgggttccgtggggcctgcggtgtgggtcagggtggaggtcctgggtgggctaaggcgtgagccccagcactaggtgggaaggctgctgaggtctctcccacccctgaggagccctggtttcagccccctcagtctgatgaattgcttagcctgttgcctttgactaggggcctgggtggcctcattaactctaggggtccctttgggctcttgattctccctgaaggagggatgcatttctctcttgctcttcctgtacccacatttgggggaagctgaggagggaggaacagtcagccacagctctcttccagcactgtcctctccaccccaagctt

SEQ ID NO: 973 - DNA, 2829 bp, Homo sapiens
ggcgacgggtttggtaagtaggaaagtttcggttgaggagtaagagctgccgcgggagcagtaacccgcgcgggggaggccgacgtcggtcggagagggggtacgagagctgctggtggtgttgtcgtggccggagcggcccgcgcctgggctgccggcacttcgcggcagtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccactgatgcagtgctcattttacaatagatcatctcctgtacacatcatagccactagcaaaagtttacattcctatgcacgccctccaccagtgtcctcttcttcgaagagtgaaccagccttccctcatcaccattggaaggaggaaacaccagtaagacacgaaagggcaaatagtgagtcagaatctggcattttctgcatgtcctccctgtcagatgatgatgatttgggatggtgcaattcctggccttcaactgtctggcactgttttttgaaaggcacacgactgtgctttcataagggaagcaataaggaatggcaagatgttgaagattttgctagagctgaaggctgtgataatgaggaagatcttcaaatgggcattcacaagggctatggttctgatggtctaaagttgttatcacatgaagaaagtgtatcatttggcgagtctgtactgaagttgacttttgatcctggtacagtagaagatggtttacttaccgtagagtgtaagctggaccaccctttctatgttaaaaataaaggttggtcatcattttatccaagcttgactgtggtacagcatggcattccatgttgtgaagttcatattggcgatgtatgtctacctcctggacaccccgatgccattaattttgatgattcaggtgtttttgatacatttaaaagctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacagagccataagtgtgatccttggtgacaggtggaagaaaatgaagaatgaagagagaagaatgtacacattagaagcaaaggctttggctgaagaacagaaacgtttaaatcctgactgttggaagaggaaaagaaccaattcaggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacattttaaaccaaattgccttatttttcttccaaacttcatatatgtctatcaggtaataataggcttgaaaattgatatcctgtggtgctaaagtacagtagaaagagaggagaagtgtatacatgttttattttaaattgtacgaaaggggaatttaaaaaatatgtaactgctgtttatacattggctccttactgcttattaatctgtattgtacacatgatgaaatgaagcagaagctgggagtcggcctttcctctagtaaccaccacatggctcagcatctgtgccaaacataggcgctcctagtctggtcagtgccaagaggctaccagaacatggggcaggtggctggtgttggtgtcccagcctaagagccacctgctgcagttaccatggcatgctgagttgatgcaccaggtggcagcagccatccgttattatttccaatggagacctagcccaggccaaggtaaagttagttaatagcattgggatatagtcactgtaatggtgctattaacaaacagtcaacaccattgtattttttaacttcgtgttctgtatctcctcagccatgtatcttaaatatattttgtcatcataatctttatggtgggggcagactttgcacttactgcagtgcaacacttgcactttaattttcctccaactgtctaaaattagagcaaatacattggcaatacagctgcttttgctctgagctacaatcatggcttttcatgttacttaccaagtggtgtttctggttaggaatcacagctgtaaaattgatttcagttcatcacacttcttcatgatgttgcccctaaattttgcacactatattcttgtatattatttcaaataaatggaaaaaaaagttgcttatctctga

SEQ ID NO: 974 - DNA, 478 bp, Homo sapiens
gaaagacttggtaatggcgacgggtttggtttgtgtactgcccaaattgcatggcttgacatcatttcttaatgtcgtttttattttaagtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccac

SEQ ID NO: 975 - DNA, 573 bp, Homo sapiens
agttcgaatgaatgggctcccaggcgcctgcgcgctggggctgagccgaggggaaaaacaagcccggagtccgggctgcggtcacatgatggggggaagggaggggaacgcgatgaatggcgaaagagggtgggggatggacttggcgtgaaccgggaggcaccgctctgtgtgacccaaagaggaggcttggcaggcgattccagtctccgcctttcaacctatgctgccaccgcaggccgattgaaacaaaacaaaacaaaccaggcgaagtggacagccaggtttttgtagctttaaatgctgcgtgctgtctagggtgtttcactctccgctgtgcactctacactcgagttcattcttagggagttttcagctacagtcgtttttagaaggagcactgacagcgaggtttgtgtactgcccaaattgcatggcttgacatcatttcttaatgtcgtttttattttaagtcagagcaccataacatggtgtgggaagtgaagacaaatcagatgcctaatgcagtacagaaactcctgttggtgatggacaagagagcctcaggaatga

SEQ ID NO: 976 - DNA, 2704 bp, Homo sapiens
aacccccagggggttgaggggagggggaagacgaagcttgaaagacttggtaatggcgacgggtttgtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccactgatgcagtgctcattttacaatagatcatctcctgtacacatcatagccactagcaaaagtttacattcctatgcacgccctccaccagtgtcctcttcttcgaagagtgaaccagccttccctcatcaccattggaaggaggaaacaccagtaagacacgaaagggcaaatagtgagtcagaatctggcattttctgcatgtcctccctgtcagatgatgatgatttgggatggtgcaattcctggccttcaactgtctggcactgttttttgaaaggcacacgactgtgctttcataagggaagcaataaggaatggcaagatgttgaagattttgctagagctgaaggctgtgataatgaggaagatcttcaaatgggcattcacaagggctatggttctgatggtctaaagttgttatcacatgaagaaagtgtatcatttggcgagtctgtactgaagttgacttttgatcctggtacagtagaagatggtttacttaccgtagagtgtaagctggaccaccctttctatgttaaaaataaaggttggtcatcattttatccaagcttgactgtggtacagcatggcattccatgttgtgaagttcatattggcgatgtatgtctacctcctggacaccccgatgccattaattttgatgattcaggtgtttttgatacatttaaaagctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacagagccataagtgtgatccttggtgacaggtggaagaaaatgaagaatgaagagagaagaatgtacacattagaagcaaaggctttggctgaagaacagaaacgtttaaatcctgactgttggaagaggaaaagaaccaattcaggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacattttaaaccaaattgccttatttttcttccaaacttcatatatgtctatcaggtaataataggcttgaaaattgatatcctgtggtgctaaagtacagtagaaagagaggagaagtgtatacatgttttattttaaattgtacgaaaggggaatttaaaaaatatgtaactgctgtttatacattggctccttactgcttattaatctgtattgtacacatgatgaaatgaagcagaagctgggagtcggcctttcctctagtaaccaccacatggctcagcatctgtgccaaacataggcgctcctagtctggtcagtgccaagaggctaccagaacatggggcaggtggctggtgttggtgtcccagcctaagagccacctgctgcagttaccatggcatgctgagttgatgcaccaggtggcagcagccatccgttattatttccaatggagacctagcccaggccaaggtaaagttagttaatagcattgggatatagtcactgtaatggtgctattaacaaacagtcaacaccattgtattttttaacttcgtgttctgtatctcctcagccatgtatcttaaatatattttgtcatcataatctttatggtgggggcagactttgcacttactgcagtgcaacacttgcactttaattttcctccaactgtctaaaattagagcaaatacattggcaatacagctgcttttgctctgagctacaatcatggcttttcatgttacttaccaagtggtgtttctggttaggaatcacagctgtaaaattgatttcagttcatcacacttcttcatgatgttgcccctaaattttgcacactatattcttgtatattatttcaaataaatggaa

SEQ ID NO: 977 - DNA, 563 bp, Homo sapiens
gacgaagcttgaaagacttggtaatggcgacgggtttggagttttgggatggtggttgataactaagacaaagtgctgaagaaatgatagaagttgcaaagagacgttagtgtactatacttggtgaatgttggaaactgcaggacctgctgtagggaagaaaaaagttctagctggaaagaatgaggaaaccaaagagctctgcagagggagggggaagacaagacagactgcagctgtgcttctgtggaccccaagaacagcactgttcatacacagaggatagctctgaagagagatacctgtgtagtgcagcttctaaatttcataataaagtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctaccca

SEQ ID NO: 978 - DNA, 601 bp, Homo sapiens
gctcggcgtggtggcatgtgcctgtaatcccccctacttaggtggctgaggcgggagaatcgcttgaacccaggaggtggagtttgcagtgagccgagatcacgccactgcactgcagtctgggtgacagagtgtgactatgtctcaaaaaaaaaacaaaacaacattgtcatgtctctgatttattttaggtttgtgtactgcccaaattgcatggcttgacatcatttcttaatgtcgtttttattttaagtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggcta

SEQ ID NO: 979 - DNA, 2420 bp, Homo sapiens
aaaaacaagcccggagtccgggctgcggtcacatgatggggggaagggaggggaacgcgatgaatggcgaaagagggtgggggatggacttggcgtgaaccgggaggcaccgctctgtgtgacccaaagaggaggcttggcaggcgattccagtctccgcctttcaacctatgctgccaccgcaggccgattgaaacaaaacaaaacaaaccaggcgaagtggacagccaggtttttgtagctttaaatgctgcgtgctgtctagggtgtttcactctccgctgtgcactctacactcgagttcattcttagggagttttcagctacagtcgtttttagaaggagcactgacagcgaggagttttgggatggtggttgataactaagacaaagtgctgaagaaatgatagaagttgcaaagagacgttagtgtactatacttggtgaatgttggaaactgcaggacctgctgtagggaagaaaaaagttctagctggaaagaatgaggaaaccaaagagctctgcagagggagggggaagacaagacagactgcagctgtgcttctgtggaccccaagaacagcactgttcatacacagaggatagctctgaagagagatacctgtgtagtgcagcttctaaatttcataataaagtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccactgatgcagtgctcattttacaatagatcatctcctgtacacatcatagccactagcaaaagtttacattcctatgcacgccctccaccagtgtcctcttcttcgaagagtgaaccagccttccctcatcaccattggaaggaggaaacaccagtaagacacgaaagggcaaatagtgagtcagaatctggcattttctgcatgtcctccctgtcagatgatgatgatttgggatggtgcaattcctggccttcaactgtctggcactgttttttgaaaggcacacgactgtgctttcataagggaagcaataaggaatggcaagatgttgaagattttgctagagctgaaggctgtgataatgaggaagatcttcaaatgggcattcacaagggctatggttctgatggtctaaagttgttatcacatgaagaaagtgtatcatttggcgagtctgtactgaagttgacttttgatcctggtacagtagaagatggtttacttaccgtagagtgtaagctggaccaccctttctatgttaaaaataaaggttggtcatcattttatccaagcttgactgtggtacagcatggcattccatgttgtgaagttcatattggcgatgtatgtctacctcctggacaccccgatgccattaattttgatgattcaggtgtttttgatacatttaaaagctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacagagccataagtgtgatccttggtgacaggtggaagaaaatgaagaatgaagagagaagaatgtacacattagaagcaaaggctttggctgaagaacagaaacgtttaaatcctgactgttggaagaggaaaagaaccaattcaggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacatttt

SEQ ID NO: 980 - DNA, 702 bp, Homo sapiens
ggggaaaaacaagcccggagtccgggctgcggtcacatgatggggggaagggaggggaacgcgatgaatggcgaaagagggtgggggatggacttggcgtgaaccgggaggcaccgctctgtgtgacccaaagaggaggcttggcaggcgattccagtctccgcctttcaacctatgctgccaccgcaggccgattgaaacaaaacaaaacaaaccaggcgaagtggacagccaggtttttgtagctttaaatgctgcgtgctgtctagggtgtttcactctccgctgtgcactctacactcgagttcattcttagggagttttcagctacagtcgtttttagaaggagcactgacagcgagtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtgg

SEQ ID NO: 981 - DNA, 2332 bp, Homo sapiens
cagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccactgatgcagtgctcattttacaatagatcatctcctgtacacatcatagccactagcaaaagtttacattcctatgcacgccctccaccagtgtcctcttcttcgaagagtgaaccagccttccctcatcaccattggaaggaggaaacaccagtaagacacgaaagggcaaatagtgagtcagaatctggcattttctgcatgtcctccctgtcagatgatgatgatttgggatggtgcaattcctggccttcaactgtctggcactgttttttgaaaggcacacgactgtgctttcataagggaagcaataaggaatggcaagatgttgaagattttgctagagctgaaggctgtgataatgaggaagatcttcaaatgggcattcacaagggctatggttctgatggtctaaagttgttatcacatgaagaaagtgtatcatttggcgagtctgtactgaagttgacttttgatcctggtacagtagaagatggtttacttaccgtagagtgtaagctggaccaccctttctatgttaaaaataaaggttggtcatcattttatccaagcttgactgtggtacagcatggcattccatgttgtgaagttcatattggcgatgtatgtctacctcctggacaccccgatgccattaattttgatgattcaggtgtttttgatacatttaaaagctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacaggtaaaaatagtgataattctgattacaataaatgagtaacacttcaatacggttcatggtaactggaatagttaagtaaacttattctttaatagcttttattcaactcttaggttgacttttttgtttgtttttgagacggagtctcgctgtgtcacccaagctggagtccagtggtacgatctcagctcactgcaacctccgccttccaggttcaagtgattatcctgcctcagcctctcaagtagctgagactacaggcgcccaccaccatacctggctaattttttgtatttttagtagagacagggtttcaccatgttggccaggctgatctcgaactcctgacctcgtgatccacccaccttggcctcctaaagtgccgtgattacaggcgtgagccactgtgcccggccaggttgactttaaagtaaaaagtttaagtggaatttttagggttatatgtaattattttataatacatagacaattaggttatctaccttagtagtaaggatctaccttttattatttgtgccatagcccaggctgcagtacagcggcgcaactcactgtagcctgtatctcccaggctcaatcctcccacctcagcttcctgaatggctgggattacaggcacatgccaccacacccagttaatttttgtattttttgtagagatagggttgtgccatgttgcccaggctggtctcaaactcctgggttcaagccatctgcctgcctcccaaagtgcaagatctaccttttaaaatcatgttatttatctgttggaggacacggttctaacaattaacagttctatctttatggaacagcttttcacctgagtcaactatggattgtacggggaactggcaatttgtagcaagctgccagagttgtcaaaacggtgaacttaagagctgtcctcagtagaagctggaaataaaaatcaactcaagtccttccta

SEQ ID NO: 982 - DNA, 2574 bp, Homo sapiens
ttcttgcaaataatgtggtctcaggcaaggacacagcatcttggctgtctgctaaaaaaaaaaaatgcctagactctcagtggaaattgagtgtcaagctgcaaaatctcaaatggcagactatcatcatttaagagcgcctggacaccggaaaaggcgattccctgagcgcctggagttggagacaattcctggttcagaatttaaacatctttctaggtctgcgcggggcggccattggcggcggagtgtcacgtgaccgcgggggcgtgccaatgtgcgccctcacgggtgtcaaacccctgtcagagtgtgcgatcaagatcgtgaaacaacgcgatgcaaaaagcgacctactacgacagctcggcgatctacggtggctacccctaccaggcagccaacgggttcgcttataatgccaatcagcagccgtacccggcgtccgccgctttgggcgccgacggcgagtaccaccgacccgcctgctccctccagtctccctccagcgccgggggccaccccaaggcacacgaactgagtgaggcgtgcctgcgcaccctgagcgccccacctagccagcctccaagcctgggagagccgcccctgcacccgccgccgccccaggccgcgccccctgccccacagccgcctcagcccgcacctcagccccctgcacctacccctgccgcgcccccgcctccctcttctgcctcccctcctcagaatgccagcaacaaccctacccctgccaacgcggccaagagccccctgctcaactcacccacagtggccaaacaaatcttcccctggatgaaagagtctcgacaaaacacaaagcagaaaaccagcagctccagctcaggcgaaagctgcgctggcgacaagagcccgccggggcaggcttcgtccaagcgcgcgcgcacggcctacacgagcgcgcagctggtggagctggagaaagagttccacttcaaccgctacctgtgccggccgcgccgggtggagatggccaatctgctgaacctcactgagcgccagatcaagatctggttccagaatcgccgcatgaagtacaaaaaggatcagaagggcaagggcatgctaacgtcatcggggggccagtctccaagtcgcagccccgtgccccccggagccggtggctatctgaactctatgcattcgctggtcaacagcgtcccgtatgagccccagtcgcccccgcccttctccaagcccccccagggtacctacgggctgccccccgcctcctaccctgcgtccctgcccagctgcgcacccccgccacccccacagaagcgctacacggcggcaggggcgggcgcagggggcacccccgactatgacccgcacgctcatggcctgcagggcaacggcagctatgggaccccacacatacagggaagccccgtcttcgtggggggcagctatgtggagcccatgagcaactccgggccagccctctttggtctaactcacctcccccacgctgcctcgggcgccatggactatgggggtgccgggccgctgggcagcggccaccaccacgggccggggcctggggagccgcaccccacctacacggaccttaccggccaccatccttctcagggaagaattcaggaagcacccaagctcacccacctgtgatagtgggcttggggctacgcgccaggagagtctccccccacccaccttttttctttggttgcttttttttttttttttttttaggttcttcctgccctttccttccttccttttctctcttctccgccccgcactccgtttcccggtttcccccctcgttggtaaggcgtttttatagtttatgtgacgtagcaatcttggttgctggaatggctgtatcatagcgatatttatctcttcctgctcctcgataggccactggccctgcaccctttaccttctccactctttgatcagaaacagggtatatgaacaaattttctagtcgagttttcaatgtgaatttgttcttacattatggctcccgaggggaagcgattactttttttaattttaaattttttttttaattgcacttcttgtaaagagtgagaaaaaaaatcaaaggcgctttgaaacaggggctctctgtgcaaggatgactaagtgtacgtctttccgtgtgtgtatgctggtgaacagtcagatttatttatatttttttgcaagcattgaataatctaagttttaaatattatttatccccatccgttcgtatttatattaaagaattctgtaccctgatggttcagaagggttcttgggccttttgttcaattgtgtattggcgtacttagaattttttttatttgaaagagaaatataattcctttaaacggtaacgatacaataaaaccagagaagatccagcttttgaaaacagtgatttaggtttgtaacatccggcaaaactgaaaaaaaaaatctgtaaacgcgaaaaatactagatttgttttgagagttcttcattccttgctgctcacattctgagaaacaaaaagaaataaagtttttattctgaat

SEQ ID NO: 983 - DNA, 1951 bp, Homo sapiens
atacccaagtcggtgccactagcccaggcagagcccggcgccgcactagcgcttatctccgggccgcggctgctgccctccctcttctgcctcccctcctcagaatgccagcaacaaccctacccctgccaacgcggccaagagccccctgctcaactcacccacagtggccaaacaaatcttcccctggatgaaagagtctcgacaaaacacaaagcagaaaaccagcagctccagctcaggcgaaagctgcgctggcgacaagagcccgccggggcaggcttcgtccaagcgcgcgcgcacggcctacacgagcgcgcagctggtggagctggagaaagagttccacttcaaccgctacctgtgccggccgcgccgggtggagatggccaatctgctgaacctcactgagcgccagatcaagatctggttccagaatcgccgcatgaagtacaaaaaggatcagaagggcaagggcatgctaacgtcatcggggggccagtctccaagtcgcagccccgtgccccccggagccggtggctatctgaactctatgcattcgctggtcaacagcgtcccgtatgagccccagtcgcccccgcccttctccaagcccccccagggtacctacgggctgccccccgcctcctaccctgcgtccctgcccagctgcgcacccccgccacccccacagaagcgctacacggcggcaggggcgggcgcagggggcacccccgactatgacccgcacgctcatggcctgcagggcaacggcagctatgggaccccacacatacagggaagccccgtcttcgtggggggcagctatgtggagcccatgagcaactccgggccagccctctttggtctaactcacctcccccacgctgcctcgggcgccatggactatgggggtgccgggccgctgggcagcggccaccaccacgggccggggcctggggagccgcaccccacctacacggaccttaccggccaccatccttctcagggaagaattcaggaagcacccaagctcacccacctgtgatagtgggcttggggctacgcgccaggagagtctccccccacccaccttttttctttggttgcttttttttttttttttttttaggttcttcctgccctttccttccttccttttctctcttctccgccccgcactccgtttcccggtttcccccctcgttggtaaggcgtttttatagtttatgtgacgtagcaatcttggttgctggaatggctgtatcatagcgatatttatctcttcctgctcctcgataggccactggccctgcaccctttaccttctccactctttgatcagaaacagggtatatgaacaaattttctagtcgagttttcaatgtgaatttgttcttacattatggctcccgaggggaagcgattactttttttaattttaaattttttttttaattgcacttcttgtaaagagtgagaaaaaaaatcaaaggcgctttgaaacaggggctctctgtgcaaggatgactaagtgtacgtctttccgtgtgtgtatgctggtgaacagtcagatttatttatatttttttgcaagcattgaataatctaagttttaaatattatttatccccatccgttcgtatttatattaaagaattctgtaccctgatggttcagaagggttcttgggccttttgttcaattgtgtattggcgtacttagaattttttttatttgaaagagaaatataattcctttaaacggtaacgatacaataaaaccagagaagatccagcttttgaaaacagtgatttaggtttgtaacatccggcaaaactgaaaaaaaaaatctgtaaacgcgaaaaatactagatttgttttgagagttcttcattccttgctgctcacattctgagaaacaaaaagaaataaagtttttattctgaat

SEQ ID NO: 984 - DNA, 3250 bp, Homo sapiens
tctcactagcctcagagcactctcagaagttcagaaactaagaccagaaaagagaagatttttagacagctcatgaaacggtctgcgcggggcggccattggcggcggagtgtcacgtgaccgcgggggcgtgccaatgtgcgccctcacgggtgtcaaacccctgtcagagtgtgcgatcaagatcgtgaaacaacgcgatgcaaaaagcgacctactacgacagctcggcgatctacggtggctacccctaccaggcagccaacgggttcgcttataatgccaatcagcagccgtacccggcgtccgccgctttgggcgccgacggcgagtaccaccgacccgcctgctccctccagtctccctccagcgccgggggccaccccaaggcacacgaactgagtgaggcgtgcctgcgcaccctgagcgccccacctagccagcctccaagcctgggagagccgcccctgcacccgccgccgccccaggccgcgccccctgccccacagccgcctcagcccgcacctcagccccctgcacctacccctgccgcgcccccgcctccctcttctgcctcccctcctcagaatgccagcaacaaccctacccctgccaacgcggccaagagccccctgctcaactcacccacagtggccaaacaaatcttcccctggatgaaagagtctcgacaaaacacaaagcagaaaaccagcagctccagctcaggcgaaagctgcgctggcgacaagagcccgccggggcaggcttcgtccaagcgcgcgcgcacggcctacacgagcgcgcagctggtggagctggagaaagagttccacttcaaccgctacctgtgccggccgcgccgggtggagatggccaatctgctgaacctcactgagcgccagatcaagatctggttccagaatcgccgcatgaagtacaaaaaggatcagaagggcaagggcatgctaacgtcatcggggggccagtctccaagtcgcagccccgtgccccccggagccggtggctatctgaactctatgcattcgctggtcaacagcgtcccgtatgagccccagtcgcccccgcccttctccaagcccccccagggtacctacgggctgccccccgcctcctaccctgcgtccctgcccagctgcgcacccccgccacccccacagaagcgctacacggcggcaggggcgggcgcagggggcacccccgactatgacccgcacgctcatggcctgcagggcaacggcagctatgggaccccacacatacagggaagccccgtcttcgtggggggcagctatgtggagcccatgagcaactccgggccagccctctttggtctaactcacctcccccacgctgcctcgggcgccatggactatgggggtgccgggccgctgggcagcggccaccaccacgggccggggcctggggagccgcaccccacctacacggaccttaccggccaccatccttctcagggaagaattcaggaagcacccaagctcacccacctgtgatagtgggcttggggctacgcgccaggagagtctccccccacccaccttttttctttggttgcttttttttttttttttttttaggttcttcctgccctttccttccttccttttctctcttctccgccccgcactccgtttcccggtttcccccctcgttggtaaggcgtttttatagtttatgtgacgtagcaatcttggttgctggaatggctgtatcatagcgatatttatctcttcctgctcctcgataggccactggccctgcaccctttaccttctccactctttgatcagaaacagggtatatgaacaaattttctagtcgagttttcaatgtgaatttgttcttacattatggctcccgaggggaagcgattactttttttaattttaaattttttttttaattgcacttcttgtaaagagtgagaaaaaaaatcaaaggcgctttgaaacaggggctctctgtgcaaggatgactaagtgtacgtctttccgtgtgtgtatgctggtgaacagtcagatttatttatatttttttgcaagcattgaataatctaagttttaaatattatttatccccatccgttcgtatttatattaaagaattctgtaccctgatggttcagaagggttcttgggccttttgttcaattgtgtattggcgtacttagaattttttttatttgaaagagaaatataattcctttaaacggtaacgatacaataaaaccagagaagatccagcttttgaaaacagtgatttaggtttgtaacatccggcaaaactgaaaaaaaaaatctgtaaacgcgaaaaatactagatttgttttgagagttcttcattccttgctgctcacattctgagaaacaaaaagaaataaagtttttattctgaataatatccgtgttaagaaggggttctttggccgaagacgtgggtctgcgtggaattcaggccgaggcgagccggcagagcaggccggacgcagcagccctctggctccagcatggggcctggccaggctattcgcctggaagctcggcgaattctcaggatggcggctggggctccaggcggctgcggcagctctggtaacgccgtgcggcgggccagctgggctgcccggttcccagctgctgcggaggcaggctgagggcgcaggggctgccgagtgctgtgcacggaagaaacaaagacatcccggcccaaggcgcagcgggagcgcacaggtgccccgcggcccagccgggggataacgcagggcggtcttctgctccatgctcttcctcgggtcaaagcggaccaactaacgcctaaacctcggtattagccagccgcgcagaggatgccgagcactttccgggagcaatcggactcctggtctcctccggggatgcttcgcggtctgttatcgcgtcaggaggaaagaattgctccaaaaatctgcacgcggagcgaaacagtttgaaagggactgaggctcacccaggtctccagcaaacggaggactgaactggggagagtcaccctgagccagcccttccctggactgccggaatcccagcattagcttcctgctgaatgtagtatttggcattctctgaatttatttcctctccttcccccacccagctttctttttatggccccagggggagggggagagagcaaggagatcggtatctttgtaataaaactgcaattttataaa

SEQ ID NO: 985 - DNA, 563 bp, Homo sapiens
actaacgctggactccatttgactcttttgcaggctacgtgtgccgcctggccattcaaactgtcaattttaggtccagaagtgtccaaaccacaagttctcaaaactctctgaaaaatggctccctccgagttaagcaattctgaaaggcattctctgggaaaagtctgtggaggagagagggatcttcttgcaaataatgtggtctcaggcaaggacacagcatcttggctgtctgctaaaaaaaaaaaatgcctagactctcagtggaaattgagtgtcaagctgcaaaatctcaaatggcagactatcatcatttaagagcgcctggacaccggaaaaggcgattccctgagcgcctggagttggagacaattcctggttcagaatttaaacatctttctaggtctgcgcggggcggccattggcggcggagtgtcacgtgaccgcgggggcgtgccaatgtgcgccctcacgggtgtcaaacccctgtcagagtgtgcgatcaagatcgtgaaacaacgcgatgcaaaaagcgacctactacgacagctcggcgatct

SEQ ID NO: 986 - DNA, 503 bp, Homo sapiens
cccagtcggccctgggcgagccgtgctggagcagcgaggcggccacgctctgcgcggcggtgaccgggcctcggggtctccagcccgcctgccatctcggctgatgctgagggtccgtgcccatcccgcgccgaggggacccggccgggccgccaagccaggccgggggccagagcccgtgtcggagcctgagcccgagcctgcgctcgtcagaagttaaggtctgcgcggggcggccattggcggcggagtgtcacgtgaccgcgggggcgtgccaatgtgcgccctcacgggtgtcaaacccctgtcagagtgtgcgatcaagatcgtgaaacaacgcgatgcaaaaagcgacctactacgacagctcggcgatctacggtggctacccctaccaggcagccaacgggttcgcttataatgccaatcagcagccgtacccggcgtccgccgctttgggcgccgacggcgagtaccaccgacccgcctgctccctccagtct

SEQ ID NO: 987 - DNA, 581 bp, Homo sapiens
tccatttgactcttttgcaggctacgtgtgccgcctggccattcaaactgtcaattttaggtccagaagtgtccaaaccacaagttctcaaaactctctgaaaaatggctccctccgagttaagagcgcctggacaccggaaaaggcgattccctgagcgcctggagttggagacaattcctggttcagaatttaaacatctttctaggtctgcgcggggcggccattggcggcggagtgtcacgtgaccgcgggggcgtgccaatgtgcgccctcacgggtgtcaaacccctgtcagagtgtgcgatcaagatcgtgaaacaacgcgatgcaaaaagcgacctactacgacagctcggcgatctacggtggctacccctaccaggcagccaacgggttcgcttataatgccaatcagcagccgtacccggcgtccgccgctttgggcgccgacggcgagtaccaccgacccgcctgctccctccagtctccctccagcgccgggggccaccccaaggcacacgaactgagtgaggcgtgcctgcgcaccctgagcgccccacctagccagcctccaagcc

SEQ ID NO: 988 - DNA, 3352 bp, Homo sapiens
aacttgctcgagcagggctgggtagaccggcgcgctcccggggacggtggggggggcagtcccggtttcggccatcgctggggtgggctcggagcggccgcaccgggcagcaaccccactcccactcggaggccccctgccctctcccccacttccccccggcccatggtgcgaggctgggagccgccgcccgggctggactgcgctatctctgaagggcacaaatcagaaggcaccatgcctcctaataaagaggccagcggtctcagtagttcaccagcggggctcatctgcctccctccaatctctgaggagctacagcttgtgtggacgcaagcagcccagaccagtgagctagacagcaatgaacacctgctcaaaaccttcagctactttccctatcccagcctagcagacattgcccttctctgcctacgttatgggttgcagatggagaaagtcaagacttggtttatggcccagcgcctccgctgtggtattagctggtcatctgaagaaatagaagagactcgagcccgagtagtctaccgtcgggaccaactccatttcaaatcccttctctcttttactcatcatgcgggacggcccccagaggaggtgcctcctcctccagtgccagctccagagcaagttggtattggaataggtcctccaactcttagcaagcctacccagacgaaaggattgaaggtagagcctgaggagccctctcagatgccaccactgccacagagtcaccagaaattaaaggagtccctgatgacacctggcagtggagcattcccctaccaatcagatttttggcaacatcttcaaagcagtggcctctcaaaggagcaggcaggcaggggtcccaaccagtcacatggcataggtactgcttcctggaaccactccacaaccgtcccccagccacaagctcgggataaacccccaccaattgcattaattgccagtagttgtaaggaggagtcagcatctagtgttactccctcttcttcctctacctcttcttctttccaggtactggctaatggagctactgccgcctctaaacccctccagccactaggctgtgtcccacagtcagtgtcacccagtgaacaggcattacccccacatctggaaccagcctggccccaagggctacggcataactcagtaccaggtagagttggccccacagagtacctttccccagatatgcaacgccagcgaaagaccaagcgcaaaaccaaagagcagctggctatccttaaatccttttttttacagtgccagtgggcacggcgtgaggattaccaaaagttagaacagatcactggtttacctcggcctgagatcattcagtggtttggtgacacacgctatgccttgaagcatgggcaactaaagtggtttcgggacaacgcagtacctggtgcccctagtttccaagacccagcaattcctacaccaccaccatcaacccgctccttgaacgaaagggctgagacaccacctctgccgatccctccacccccaccggatatacaacccttggagaggtactgggcagcccaccaacagctacgggaaactgatatccctcaattgagtcaggcatcaaggcttagcacccagcaggtgctggattggtttgactctcgattacctcagccagctgaggtggtagtttgtctagatgaagaagaggaagaggaggaggaagaactgccagaagatgatgaggaagaggaggaggaggaggaggaagatgatgatgatgatgatgatgatgtgatcatacaagactgagtggggagctgggggaggggaggtctgttactgaaagatgaaccaacttagtaactgtttaaacaaagaaaccacatttttaaaattaccttgtggcagagaactaaaaagctttgtgttcttcagggtgggtggcagggggatatagtgagggtggaccagggagaatgaccatagggcactaagtaaggctgggattggatcagcagaaatccaaccctctaaccttagggtagggagtgctaaggatctggggaaaccatgggctgggaagctgctcttgctctcctcgtgtctgctgtttttttcccttggtgtactatacagaggccagatgttggcaccacctctccaggaggattggaaaggaggagtaaaggattctgatttgattgatgattccagtgcatccccaatcccaccatcttacctggaatataaggctgccttgtaccccttttctgagcacaagtctgtgcgtaatgcaactgactctcttacttttttcttagtaactgatcatttcctagacaaccaagattctcaataagtcccagtctcatcacaaatattaatatttccttttcctcataccaacttgactatgtttcacccgcttcatgactaaatcacaggtggcagaatttttcagttcttttttttttttttgaggtggagtcttgctctgtcgcccaggctgtagtgcaatggcgcaatctcagctcactgcaagctccgcctcccaggttcatgccattctcctgcctcagcctcccgagtagctgggactacaggcacctgccaccacacccggctacttttttatatttttagtagagacgggtttcatcatgttagccaggatggtcttgatctcctgacctcatgatccgcccaccttggcctcccaaagtgctgggattataggcatgagccaccgtgcccggctattttcagttcttatgctgtgaccactttgccttgtagctttttctatctttccaaaatcctcactctgttcattgtttgtctcagggaaaatcttcccccaccgagcttgtaaaaaactttaataattgggtggagaataatttagaatggatatttattggaggtggtaattagggaagatgtccttttaaacagtagaattgtgttacaaaggggtgaaagagagggaatagtttctccttgttgaagggcagtgaaggtaggtttcaggtttggttttacaaacctgttaactacctcctgtccagcttgacagagactaatttttcatctttttgctgtcaatttgtttccagaaaagagacttttccctctcttgataggatctgtcttagggacagagggaccatcgtctttaagtgaattaattattgatgttttagaatggttttcatcagttgggatcagctatatggcaaataggtatcatcaatgagttaaccatctaaaaataaaagagtggaagccctaaaatgctagaataataataaaaaggccaaaaataaaattgtttctctctcaa

SEQ ID NO: 989 - DNA, 2240 bp, Homo sapiens
atgagccgcgccgggagctgggacatggacgggctgcgggcagacggcgggggcgccggtggcgccccggcctcttcctcctcctcatcggtggcggcggcggcggcgtcaggccagtgccgcggctttctctccgcgcctgtgttcgccgggacgcattcggggcgggcggcggcggcggcagcggcggctgcggcggcggcggcggcagcctccggctttgcgtaccccgggacctctgagcgcacgggctcttcctcgtcgtcgtcctcttctgccgttgtagcggcgcgcccggaggctcccccagccaaagagtgcccagcacccacgcctgcagcggccgctgcagcgcccccgagcgctccagcgctgggctacggctaccacttcggcaacggctactacagctgccgtatgtcgcacggcgtgggcttacagcagaatgcgctcaagtcatcgccgcacgcctcgctgggaggctttcccgtggagaagtacatggacgtgtcaggcctggcgagcagcagcgtaccggccaacgaggtgccagcgcgagccaaggaggtatccttctaccagggctatacgagcccttaccagcacgtgcccggctatatcgacatggtgtccactttcggctccggggagcctcggcacgaggcctacatctccatggaggggtaccagtcctggacgctggctaacgggtggaacagccaggtgtactgcaccaaggaccagccacaggggtcccacttttggaaatcttcctttccaggggatgtggctctaaatcagccggacatgtgcgtctaccgaagagggaggaagaagagagtgccttacaccaaactgcagcttaaagaactggagaacgagtatgccattaacaaattcattaacaaggacaagcggcggcgtatctcggctgctacgaacctatctgagagacaagtgaccatttggtttcagaaccgaagagtgaaggacaagaaaattgtctccaagctcaaagatactgtctcctgatgtggtccaggttggccacagacagcttagaagccattcggttgtctccaaaaggcctttggaaagacttgaatatgtatttaattccccccaccccctgccaatggtggcaaattttgtgaattgtttttctctcttccccttatctggctctaaaaccttctgctgcccaacctgactttgtagttctgatttttacttgtttattattggttttgttcttgcctagggtttttaaaatatctgtttttaatgttttgtttctccctccaggccagtataaagggacttgaagtattttttaataatccgccccccaatgaacttcagaagtgccattctgatttaagggtttttttaaaaaattactttatttgttcattcccagcactgattatcttcataatccattaggacagaatggttttcagtcgttcatatcctgtaattaggtaattgaatcattagctctcagcagttgccctgaggcaagtggaaaggcaggcagtgctctggggtcaccgagaaagtctaaaaacaggaggctgaaggtactgtgatggctttaaaaatggccaccttattaaatagggattgtatcaatattgaaatgaagacaatctttccaactttgggtgtttcacttgctgttttaattgtttgtttttaacactttgtaggtttgtgttttcataatctttaatttgaaactcatgtgtcctcatggatcgtggatgccttcatttcttgagctctcaatgcagacatttaaatggctgcaatcagtagagtgacccgcggatggcataaatgcacctccttttcttggccttggatctatgggtctgggattgtggtcatctcctcaatcctcaaaaagaggctgaatcaatgtggccgtgggtgggaacttacatacagaacccaatgaagaacttgactgtctaaacaagggggcctcgcatggagctgtaaagcatctaacaaatatgaaaaatgtgaagttccaaggtccaagaagaaaaataatgatgtttctgaaagtgatgataaataattacttttaaagtgctgcatatttatacaattgagagattatttttgtaaatgcaatgtctgtgagctgggatacatgggcagtgcttcagacatttaaaaatcactttttactcctagggagatgccaataaacagaactcttttgtttc

SEQ ID NO: 990 - DNA, 2187 bp, Homo sapiens
gttgtataggtggcccaggctggcggcccctgaccgaaggtcgcgtcgggtcagtgtgcagcccgtggctgagaggcggctgctgaggggccgggcgggctaggggccggctagccgccgttcgcccctgctttgcatattcatgaagtctagcgaggccggtcgcccaggctagccgtggacgggtcatgaattattcatgaggaaacctctggtcccgcccagaaaggcctcgttgactattcatgagccgaggagcgggtttgggccggaaaaggccgttgacccccggtgggagggaagcgtcgacgagctgaggttggacttgttgaaataatcctgatacattcctacaatggccactgctcagctttctcactgcatcacaatacacaaggcttctaaggaaacagttttcccatcccaaatcactaatgagcatgagtcattgaaaatggtgaagaaactttttgctacttccatctcatgtataacatacctaaggggcctgtttccagagagctcttatggagaacgccatttggatgacctcagtttaaaaatcctccgagaagataaaaaatgtcccgggtcactgcatattatcagatggattcaaggttgttttgatgctttggaaaagagatacctacgtatggcagtactgacactttacacagatcccatgggatctgagaaggtgactgagatgtaccagttcaaattcaaatacacgaaagaaggagccactatggattttgacagtcatagcagcagtacaagctttgaaagtggaacaaacaatgaagatattaagaaagccagtgttctactgatccgtaaattgtatatactgatgcaggaccttgagccacttcctaataatgttgtacttactatgaaactccactactataatgcagtgaccccacatgattaccaacccctcggttttaaagaaggggtaaattcacacttcctgctgtttgacaaggagcctatcaacgtgcaagtgggatttgtctccactggctttcatagcatgaaagtaaaagtcatgacagaggctacaaaagtgattgatttggagaacaatctgtttcgggagaacagcactactgagatcgcccatcagggtctagactgtgatgaggaagaagaatgcaatgaccatattcaaagaatgaattttgtgtgcagtcagcaaagttctgagtgctccaggaagaagaggaaggtcagtgaaccagtgaaggtcttcatccctaacagaaaatgaaagctaaatattccttctacatttattttaaaataagtttattttgtaaaaacatgcataaactgtcttagcaggaaagtacattcctgttaccaaaacctttttctaaattttttgctcaattttttttgtcagttgctaagtgctaaattactggccaggtaggacgcgagtccactttgccataaggaaagcgggtcaatagggctgcctctggatagcattacttcaaagctgggttagagatgaggcaccttttatattatatttgtaaaagaaccacagcagctattttggaaagaagctgttgttctcaaaggaaagaaggatttttttgcataattaaactcttcagctatttagactactgtgaaatgttttgacttgttgtaacctgtatactggaatccctctctagctgtattaaaaattcccacagagttgcataggatgtgtggaggtgcttatccaggtgtgatttatgtgttaacctcagtcacgaggttgatcagctaattgtgggaccaaaatgtgccctgcctcaactctggccccaggccctgttctgttatccaatccgaaacacggaacatgctgcaattcaggagtctggctctcttcttaagacctatattaaatatttcccaagaagcacttcagtttatcagtctgtaacctgcaaatgatgctattagttccctccttattctggaagaatttggatagacttaattgatgattagtatgagatgaacaatagatgacttaaagtgttatttctattatttatataacatgagatttagtaacttataaaatgaggtttagtaatttaatttaaatggataggaccaataagttaaatattaagtgtgtgacttatggttaaataaaatgaaaatacaaga

SEQ ID NO: 991 - DNA, 2115 bp, Homo sapiens
actttagtgaggatttgccaattaatccctatggactttagttccctaaacagagggagagagtcttgaacctcaggattagccaatcgccaaaatgtgtccgagtacgcagggcactggacaggctgtgcagtacatcgtgtactcagctggtagaaatgaggggtggttctggcccctaaaggggtttttaatctcagcaggatcataatctaatttctcctccattggaccatcaatctgttgaggttggacttgttgaaataatcctgatacattcctacaatggccactgctcagctttctcactgcatcacaatacacaaggcttctaaggaaacagttttcccatcccaaatcactaatgagcatgagtcattgaaaatggtgaagaaactttttgctacttccatctcatgtataacatacctaaggggcctgtttccagagagctcttatggagaacgccatttggatgacctcagtttaaaaatcctccgagaagataaaaaatgtcccgggtcactgcatattatcagatggattcaaggttgttttgatgctttggaaaagagatacctacgtatggcagtactgacactttacacagatcccatgggatctgagaaggtgactgagatgtaccagttcaaattcaaatacacgaaagaaggagccactatggattttgacagtcatagcagcagtacaagctttgaaagtggaacaaacaatgaagatattaagaaagccagtgttctactgatccgtaaattgtatatactgatgcaggaccttgagccacttcctaataatgttgtacttactatgaaactccactactataatgcagtgaccccacatgattaccaacccctcggttttaaagaaggggtaaattcacacttcctgctgtttgacaaggagcctatcaacgtgcaagtgggatttgtctccactggctttcatagcatgaaagtaaaagtcatgacagaggctacaaaagtgattgatttggagaacaatctgtttcgggagaacagcactactgagatcgcccatcagggtctagactgtgatgaggaagaagaatgcaatgaccatattcaaagaatgaattttgtgtgcagtcagcaaagttctgagtgctccaggaagaagaggaaggtcagtgaaccagtgaaggtcttcatccctaacagaaaatgaaagctaaatattccttctacatttattttaaaataagtttattttgtaaaaacatgcataaactgtcttagcaggaaagtacattcctgttaccaaaacctttttctaaattttttgctcaattttttttgtcagttgctaagtgctaaattactggccaggtaggacgcgagtccactttgccataaggaaagcgggtcaatagggctgcctctggatagcattacttcaaagctgggttagagatgaggcaccttttatattatatttgtaaaagaaccacagcagctattttggaaagaagctgttgttctcaaaggaaagaaggatttttttgcataattaaactcttcagctatttagactactgtgaaatgttttgacttgttgtaacctgtatactggaatccctctctagctgtattaaaaattcccacagagttgcataggatgtgtggaggtgcttatccaggtgtgatttatgtgttaacctcagtcacgaggttgatcagctaattgtgggaccaaaatgtgccctgcctcaactctggccccaggccctgttctgttatccaatccgaaacacggaacatgctgcaattcaggagtctggctctcttcttaagacctatattaaatatttcccaagaagcacttcagtttatcagtctgtaacctgcaaatgatgctattagttccctccttattctggaagaatttggatagacttaattgatgattagtatgagatgaacaatagatgacttaaagtgttatttctattatttatataacatgagatttagtaacttataaaatgaggtttagtaatttaatttaaatggataggaccaataagttaaatattaagtgtgtgacttatggttaaataaaatgaaaatacaa

SEQ ID NO: 992 - DNA, 2023 bp, Homo sapiens
ctgcgctccctgcgccctggggatgcccctgccgccctgacgcccgccagcctgagccaccggcgcatgtgaccgcgcgtccgccccagtcccatccgtaggcgcccggcgcccggccccgcagcggcctcgttgtccccgccggcccccgcccggtctcccgcgctgccacccgccgccggccctgccgccatgcaggcgcgagcgctgctcctggccgcgttggccgcgctggcgctggcccgggagccccctgcggcgccgtgtcccgcgcgctgcgacgtgtcgcggtgtcccagcccccgctgccccggcggctacgtgcccgacctctgcaactgctgcctggtgtgcgccgccagcgagggcgagccctgtggcggccctctggactcgccttgcggcgagagcctggagtgcgtgcgcggcctatgccgctgccgctggtcgcacgccgtgtgtggcaccgacgggcacacctatgccaacgtgtgcgcgctgcaggcggccagccgccgcgcgctgcagctctccgggacgcccgtgcgccagctgcagaagggcgcctgcccgttgggtctccaccagctgagcagcccgcgctacaagttcaacttcattgctgacgtggtggagaagatcgcaccagccgtggtccacatagagctcttcctgagacacccgctgtttggccgcaacgtgcccctgtccagcggttctggcttcatcatgtcagaggccggcctgatcatcaccaatgcccacgtggtgtccagcaacagtgctgccccgggcaggcagcagctcaaggtgcagctacagaatggggactcctatgaggccaccatcaaagacatcgacaagaagtcggacattgccaccatcaagatccatcccaagaaaaagctccctgtgttgttgctgggtcactcggccgacctgcggcctggggagtttgtggtggccatcggcagtcccttcgccctacagaacacagtgacaacgggcatcgtcagcactgcccagcgggagggcagggagctgggcctccgggactccgacatggactacatccagacggatgccatcatcaactacgggaactccgggggaccactggtgaacctggatggcgaggtcattggcatcaacacgctcaaggtcacggctggcatctcctttgccatcccctcagaccgcatcacacggttcctcacagagttccaagacaagcagatcaaagccccctcactggcagttcattgagagcagggggcttcctcacgtttccccctcctccatgaccccgtcagccaagcacatggaccccagtgcagccaaggctggtgccatgagggctggtcacatgaagagctgctgttgaggatgccgccattgttcttctgtgtccattatgggaagacaatctggagccaggcagagcctgtctttcccaaagaagctgaagtcttcttctcttgaacagtggggaccatctaatctcttgagcccttttcctgttggcttctaggaagctcagagctagattcaggggtgcacccagacctgtcctagcatgctcctttccctaatgaccgagtctttcctgttgaattatcccattctccatgggtgcctttgactttggcctccttactggaaattagcggagctgctgtttgcacacactgagctgtgaggtggctttccttggaagtggatgatagtgtcctcttcccttcttgcctctctctttctcctgagacaggatccccctggggcctaggtttgctcctttgttgtacaggggctgtcccagttagtgctgacctcatcccagaaccccctgggaaatatcccctgtcctcagagctgtgtcccctccccaaggacagtgcagactaactgaggagcctgataaaccttagctgcatggcacacttgcaattttaaaatccttctgaagttgactggtgtttgtacttgcttctcttttttatttaataaaatccaatgatccaaa

SEQ ID NO: 993 - DNA, 3747 bp, Homo sapiens
gggcttggcttggagggggcaagggagggaaagagagaagggggaaacacaaaaaacttctttctttctccctccgtttatcttcagcccgacattgtcacctcctctttgaggggttagaagaagctgagatctcccgacagagctggaaatgcattgcactttgactatggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtaaactgaaatgtgacgtctgtggcatggtttgcattgggcccaatgtgcttatggtacataaaaggagtcacactggtgaacgccccttccactgtaaccagtgtggagcttcttttactcagaagggcaaccttctgagacacataaagttacactctggagagaagccgttcaaatgtcctttctgtagctacgcctgtagaagaagggacgccctcacaggacacctcaggacccattctgtgggtaaacctcacaagtgcaactactgtggacgaagctacaagcagcgcagttcactggaggagcacaaggaacgctgccacaactatctccagaatgtcagcatggaggctgctgggcaggtcatgagtcaccatgtacctcctatggaagattgtaaggaacaagagcctattatggacaacaatatttctctggtgccttttgagagacctgctgtcatagagaagctcacggggaatatgggaaaacgtaaaagctccactccacaaaagtttgtgggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactaggccttttcattccaaaggggacccctatgaagtaaagaactgcacatgaagaaatactgcacttacaatcccacctttcctcaaatgttgacataccttttattttttttaatattattactgttgataattcttattttgtggaggcagtgtcatttgctctgcctaattacgataaggaagaaacagaagagagaaggggcgggaatattgtttctttatcacctggcttgtttattttgtgggaatttaagagcagtccatttctaccaaggcatatcatgctttgaaaaatcacttgattcataaagattcacctaagagattctgatttgccactgatattcagaattatgatggaagacaggaaagttcagagttttctgggtaggactttggtggtttaaaaatggtataagtaactttattcttgaaagaagaatgtgtttcaaactgtaaaccaattttttgttcttcagagatcatggaacacaaacacattgttattttcagtgataactcctaagaggagctgagttgttgtgggttctatgtttacttcccctatggaatttataattcagtatgttttacactgtaccatatagcaaaacttttaaactacaggtagttaagggccacctacaatacatctgaggtcctgtgatcttatttttctaaacgtaagcactgtttttccatagttttgatgactggcattttatagacaccctggcagccttacttttaacacctttaaggaatagtatttttatgtagttttcagaataacatatggtctaagagtggataaaaggcagtcaataatttctgggagggacttctactttcataaatttgtttgagaggttttcttttaaagttgtaatgtgatggcagcatagtatatgtatttgtttctaaaagtatgcttacgattgtcactttatcagcatttaatcagtgttaaccagtcagcagaaaaatataattatgctaacagtagggggagaaaacccacttagaaatcccttttctggtatttctcttttcactagtttttttcaagatgtgacctcccggtgttctgtccatagttcattcatcctttactcttcgagtagaaggtcttaaaagtcttcctgtcggctgtttctttcaaaatctcctcagagcaattgctaatttggcctgaatctggtaacttgaaccctgtaaggttacagaactagggctatttattttagcatttcttcagtagtatttactactcttgttgcaaagaaaagggaatgggacttctttgtaacctgtaccttggacaacagataaaagaaacaaaaaaataagaaagtttacttttacccttcttggagtctagaatgtgacagaacccccaaaggaaagtcctgcacatttttctgtttccaaaacatttaattgtgtaagtccttgtcagaaatgaatctcaatcccttagtatagaattccccttacatggtataggttgccatatttcatgtgcagattttaatttcatttatgtgggcgctctgttttttctttgcagtccagccacattagaggggaggaaccgagtgatattgattcaagtcattttagggggacatacttggaaggcagaacttgctgcttctgtttggggaggacagacctgactgtgactggattatctgataaccatttgtgaatactgaaattctgttaggcagtaactgataactgctctaaaggatcattaaataggatgctgaaattatgtatcttaatacagtgtggtatgagaattaccaagtcaagagaattgtggacataagcaagtttggccccaatactgctcttaactcattttccagcttactatttgctatttaaatggtaggcaccagctaagcacttctaagcactaacacagctagaactaggcaaaaatggttagaactcagctctcttctactagtccctgtcataattat

SEQ ID NO: 994 - DNA, 2001 bp, Homo sapiens
gctcctcgctgaagatggaggaagtaaaaacaggattacccttagctacagatccactgccttagtttccaccaccaactgcagtgcacaaacacacgttaggcacaggaaagaaagaaagacagaggacacattaacagtaaacacaaacaaaagggtgatgggattattttactgcatgcactgctgagcccgacattgtcacctcctctttgaggggttagaagaagctgagatctcccgacagagctggaaatggtgatgaatcttttttaatcaaaggacaatttcttttcattgcactttgactatggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtgaacgccccttccactgtaaccagtgtggagcttcttttactcagaagggcaaccttctgagacacataaagttacactctggagagaagccgttcaaatgtcctttctgtagctacgcctgtagaagaagggacgccctcacaggacacctcaggacccattctgtgggtaaacctcacaagtgcaactactgtggacgaagctacaagcagcgcagttcactggaggagcacaaggaacgctgccacaactatctccagaatgtcagcatggaggctgctgggcaggtcatgagtcaccatgtacctcctatggaagattgtaaggaacaagagcctattatggacaacaatatttctctggtgccttttgagagacctgctgtcatagagaagctcacggggaatatgggaaaacgtaaaagctccactccacaaaagtttgtgggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactaggccttttcattccaaaggggacccctatgaagtaaagaactgcacatgaagaaatactgcacttacaatcccacctttcctcaaatgttgacataccttttattttttttaatattattactgttgataattcttattttgtggaggcagtgtcatttgctctgcctaattacgataaggaagaaaca

SEQ ID NO: 995 - DNA, 1146 bp, Homo sapiens
atggaaacagaggctattgatggctatataacgtgtgacaatgagctttcacccgaaagggagcactccaatatggcaattgacctcacctcaagcacacccaatggacagcatgcctcaccaagtcacatgacaagcatgggtaaacctcacaagtgcaactactgtggacgaagctacaagcagcgcagttcactggaggagcacaaggaacgctgccacaactatctccagaatgtcagcatggaggctgctgggcaggtcatgagtcaccatgtacctcctatggaagattgtaaggaacaagagcctattatggacaacaatatttctctggtgccttttgagagacctgctgtcatagagaagctcacggggaatatgggaaaacgtaaaagctccactccacaaaagtttgtgggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactag

SEQ ID NO: 996 - DNA, 1658 bp, Homo sapiens
atggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtaaactgaaatgtgacgtctgtggcatggtttgcattgggcccaatgtgcttatggtacataaaaggagtcacactggtgaacgccccttccactgtaaccagtgtggagcttcttttactcagaagggcaaccttctgagacacataaagttacactctggagagaagccgttcaaatgtcctttctgtagctacgcctgtagaagaagggacgccctcacaggacacctcaggacccattctgtgggtaaacctcacaagtgcaactactgtggacgaagctacaagcagcgcagttcactggaggagcacaaggaacgctgccacaactatctccagaatgtcagcatggaggctgctgggcaggtcatgagtcaccatgatagttagagctgattccacattagtctgtaggctgcctaaaagaatgaattggttatttgaatattttcatctcagtacctcctatggaagattgtaaggaacaagagcctattatggacaacaatatttctctggtgccttttgagagacctgctgtcatagagaagctcacggggaatatgggaaaacgtaaaagctccactccacaaaagtttgtgggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactag

SEQ ID NO: 997 - DNA, 1359 bp, Homo sapiens
atggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtgaacgccccttccactgtaaccagtgtggagcttcttttactcagaagggcaaccttctgagacacataaagttacactctggagagaagccgttcaaatgtcctttctgtagctacgcctgtagaagaagggacgccctcacaggacacctcaggacccattctgtgggtaaacctcacaagtgcaactactgtggacgaagctacaagcagcgcagttcactggaggagcacaaggaacgctgccacaactatctccagaatgtcagcatggaggctgctgggcaggtcatgagtcaccatggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactag

SEQ ID NO: 998 - DNA, 1780 bp, Homo sapiens
atggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtaaactgaaatgtgacgtctgtggcatggtttgcattgggcccaatgtgcttatggtacataaaaggagtcacactggtgaacgccccttccactgtaaccagtgtggagcttcttttactcagaagggcaaccttctgagacacataaagttacactctggagagaagccgttcaaatgtcctttctgtagctacgcctgtagaagaagggacgccctcacaggacacctcaggacccattctgtgggtaaacctcacaagtgcaactactgtggacgaagctacaagcagcgcagttcactggaggagcacaaggaacgctgccacaactatctccagaatgtcagcatggaggctgctgggcaggtcatgagtcaccatgatagttagagctgattccacattagtctgtaggctgcctaaaagaatgaattggttatttgaatattttcatctcagatcgggtaacacggagaaaatttgcaacaatatagaagacatctgttgtttttgcctgcctgacatcccttcctccttctcttgataacaagagtgcccatttacctttagagaactttccttacctcctatggaagattgtaaggaacaagagcctattatggacaacaatatttctctggtgccttttgagagacctgctgtcatagagaagctcacggggaatatgggaaaacgtaaaagctccactccacaaaagtttgtgggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactag

SEQ ID NO: 999 - DNA, 602 bp, Homo sapiens
gtttgctggatttgggcttggaatgacccacctgtaaagtgcttttccttcctcctccccttgaactctgcagggggcttggcttggagggggcaagggagggaaagagagaagggggaaacacaaaaaacttctttctttctccctccgtttatcttcagcccgacattgtcacctcctctttgaggggttagaagaagctgagatctcccgacagagctggaaatgcattgcactttgactatggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtgaacgccccttccactgtaaccagtgtgg

SEQ ID NO: 1000 - DNA, 3888 bp, Homo sapiens
gctcctcgctgaagatggaggaagtaaaaacaggattacccttagctacagatccactgccttagtttccaccaccaactgcagtgcacaaacacacgttaggcacaggaaagaaagaaagacagaggacacattaacagtaaacacaaacaaaagggtgatgggattattttactgcatgcactgctgagcccgacattgtcacctcctctttgaggggttagaagaagctgagatctcccgacagagctggaaatggtgatgaatcttttttaatcaaaggacaatttcttttcattgcactttgactatggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtaaactgaaatgtgacgtctgtggcatggtttgcattgggcccaatgtgcttatggtacataaaaggagtcacactggtgaacgccccttccactgtaaccagtgtggagcttcttttactcagaagggcaaccttctgagacacataaagttacactctggagagaagccgttcaaatgtcctttctgtagctacgcctgtagaagaagggacgccctcacaggacacctcaggacccattctgtgggtaaacctcacaagtgcaactactgtggacgaagctacaagcagcgcagttcactggaggagcacaaggaacgctgccacaactatctccagaatgtcagcatggaggctgctgggcaggtcatgagtcaccatgtacctcctatggaagattgtaaggaacaagagcctattatggacaacaatatttctctggtgccttttgagagacctgctgtcatagagaagctcacggggaatatgggaaaacgtaaaagctccactccacaaaagtttgtgggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactaggccttttcattccaaaggggacccctatgaagtaaagaactgcacatgaagaaatactgcacttacaatcccacctttcctcaaatgttgacataccttttattttttttaatattattactgttgataattcttattttgtggaggcagtgtcatttgctctgcctaattacgataaggaagaaacagaagagagaaggggcgggaatattgtttctttatcacctggcttgtttattttgtgggaatttaagagcagtccatttctaccaaggcatatcatgctttgaaaaatcacttgattcataaagattcacctaagagattctgatttgccactgatattcagaattatgatggaagacaggaaagttcagagttttctgggtaggactttggtggtttaaaaatggtataagtaactttattcttgaaagaagaatgtgtttcaaactgtaaaccaattttttgttcttcagagatcatggaacacaaacacattgttattttcagtgataactcctaagaggagctgagttgttgtgggttctatgtttacttcccctatggaatttataattcagtatgttttacactgtaccatatagcaaaacttttaaactacaggtagttaagggccacctacaatacatctgaggtcctgtgatcttatttttctaaacgtaagcactgtttttccatagttttgatgactggcattttatagacaccctggcagccttacttttaacacctttaaggaatagtatttttatgtagttttcagaataacatatggtctaagagtggataaaaggcagtcaataatttctgggagggacttctactttcataaatttgtttgagaggttttcttttaaagttgtaatgtgatggcagcatagtatatgtatttgtttctaaaagtatgcttacgattgtcactttatcagcatttaatcagtgttaaccagtcagcagaaaaatataattatgctaacagtagggggagaaaacccacttagaaatcccttttctggtatttctcttttcactagtttttttcaagatgtgacctcccggtgttctgtccatagttcattcatcctttactcttcgagtagaaggtcttaaaagtcttcctgtcggctgtttctttcaaaatctcctcagagcaattgctaatttggcctgaatctggtaacttgaaccctgtaaggttacagaactagggctatttattttagcatttcttcagtagtatttactactcttgttgcaaagaaaagggaatgggacttctttgtaacctgtaccttggacaacagataaaagaaacaaaaaaataagaaagtttacttttacccttcttggagtctagaatgtgacagaacccccaaaggaaagtcctgcacatttttctgtttccaaaacatttaattgtgtaagtccttgtcagaaatgaatctcaatcccttagtatagaattccccttacatggtataggttgccatatttcatgtgcagattttaatttcatttatgtgggcgctctgttttttctttgcagtccagccacattagaggggaggaaccgagtgatattgattcaagtcattttagggggacatacttggaaggcagaacttgctgcttctgtttggggaggacagacctgactgtgactggattatctgataaccatttgtgaatactgaaattctgttaggcagtaactgataactgctctaaaggatcattaaataggatgctgaaattatgtatcttaatacagtgtggtatgagaattaccaagtcaagagaattgtggacataagcaagtttggccccaatactgctcttaactcattttccagcttactatttgctatttaaatggtaggcaccagctaagcacttctaagcactaacacagctagaactaggcaaaaatggttagaactcagctctcttctactagtccctgtcataattat

SEQ ID NO: 1001 - DNA, 1763 bp, Homo sapiens
atggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtaaactgaaatgtgacgtctgtggcatggtttgcattgggcccaatgtgcttatggtacataaaaggagtcacactggggtggcagtggtgaaaactaccttttcagaattctgctagtattggattgcagaaaaacagagagtagcctgggtcttgacttccagccttcaaatctgaatagcatatcagaaaagaagtttgggattcagtttccacagttcttaatatagcaataatatgataagggttcaaaaggtgaacgccccttccactgtaaccagtgtggagcttcttttactcagaagggcaaccttctgagacacataaagttacactctggagagaagccgttcaaatgtcctttctgtagctacgcctgtagaagaagggacgccctcacaggacacctcaggacccattctgtgggtaaacctcacaagtgcaactactgtggacgaagctacaagcagcgcagttcactggaggagcacaaggaacgctgccacaactatctccagaatgtcagcatggaggctgctgggcaggtcatgagtcaccatgtacctcctatggaagattgtaaggaacaagagcctattatggacaacaatatttctctggtgccttttgagagacctgctgtcatagagaagctcacggggaatatgggaaaacgtaaaagctccactccacaaaagtttgtgggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactaggcc

SEQ ID NO: 1002 - DNA, 1365 bp, Homo sapiens
atggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtgaacgccccttccactgtaaccagtgtggagcttcttttactcagaagggcaaccttctgagacacataaagttacactctggagagaagccgttcaaatgtcctttctgtagctacgcctgtagaagaagggacgccctcacaggacacctcaggacccattctgtacctcctatggaagattgtaaggaacaagagcctattatggacaacaatatttctctggtgccttttgagagacctgctgtcatagagaagctcacggggaatatgggaaaacgtaaaagctccactccacaaaagtttgtgggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactag

SEQ ID NO: 1003 - DNA, 567 bp, Homo sapiens
gacatgaatgtctttctcagtctattccccaggacccctcttatcccgcttcaggtcccggtcaatgcggtgcgctttccgaaatggggccgcagagttgccggcggagaccagtaggtgggaggctccacgcacactccccgactcggccgggacgcggctcccggactccgcgcagggcgccaagatcgccgccccgctcccttcccccggcctccccaccaatcccagtttgaaagaaaacttcacgcggccgaaatgaacgtcacctcaccgctccaagcctccagccggcagaaaaccattgcactttgactatggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccc

SEQ ID NO: 1004 - DNA, 9405 bp, Homo sapiens
gggcttggcttggagggggcaagggagggaaagagagaagggggaaacacaaaaaacttctttctttctccctccgtttatcttcagcccgacattgtcacctcctctttgaggggttagaagaagctgagatctcccgacagagctggaaatgcattgcactttgactatggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtaaactgaaatgtgacgtctgtggcatggtttgcattgggcccaatgtgcttatggtacataaaaggagtcacactggtgaacgccccttccactgtaaccagtgtggagcttcttttactcagaagggcaaccttctgagacacataaagttacactctggagagaagccgttcaaatgtcctttctgtagctacgcctgtagaagaagggacgccctcacaggacacctcaggacccattctgtgggtaaacctcacaagtgcaactactgtggacgaagctacaagcagcgcagttcactggaggagcacaaggaacgctgccacaactatctccagaatgtcagcatggaggctgctgggcaggtcatgagtcaccatgtacctcctatggaagattgtaaggaacaagagcctattatggacaacaatatttctctggtgccttttgagagacctgctgtcatagagaagctcacggggaatatgggaaaacgtaaaagctccactccacaaaagtttgtgggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactaggccttttcattccaaaggggacccctatgaagtaaagaactgcacatgaagaaatactgcacttacaatcccacctttcctcaaatgttgacataccttttattttttttaatattattactgttgataattcttattttgtggaggcagtgtcatttgctctgcctaattacgataaggaagaaacagaagagagaaggggcgggaatattgtttctttatcacctggcttgtttattttgtgggaatttaagagcagtccatttctaccaaggcatatcatgctttgaaaaatcacttgattcataaagattcacctaagagattctgatttgccactgatattcagaattatgatggaagacaggaaagttcagagttttctgggtaggactttggtggtttaaaaatggtataagtaactttattcttgaaagaagaatgtgtttcaaactgtaaaccaattttttgttcttcagagatcatggaacacaaacacattgttattttcagtgataactcctaagaggagctgagttgttgtgggttctatgtttacttcccctatggaatttataattcagtatgttttacactgtaccatatagcaaaacttttaaactacaggtagttaagggccacctacaatacatctgaggtcctgtgatcttatttttctaaacgtaagcactgtttttccatagttttgatgactggcattttatagacaccctggcagccttacttttaacacctttaaggaatagtatttttatgtagttttcagaataacatatggtctaagagtggataaaaggcagtcaataatttctgggagggacttctactttcataaatttgtttgagaggttttcttttaaagttgtaatgtgatggcagcatagtatatgtatttgtttctaaaagtatgcttacgattgtcactttatcagcatttaatcagtgttaaccagtcagcagaaaaatataattatgctaacagtagggggagaaaacccacttagaaatcccttttctggtatttctcttttcactagtttttttcaagatgtgacctcccggtgttctgtccatagttcattcatcctttactcttcgagtagaaggtcttaaaagtcttcctgtcggctgtttctttcaaaatctcctcagagcaattgctaatttggcctgaatctggtaacttgaaccctgtaaggttacagaactagggctatttattttagcatttcttcagtagtatttactactcttgttgcaaagaaaagggaatgggacttctttgtaacctgtaccttggacaacagataaaagaaacaaaaaaataagaaagtttacttttacccttcttggagtctagaatgtgacagaacccccaaaggaaagtcctgcacatttttctgtttccaaaacatttaattgtgtaagtccttgtcagaaatgaatctcaatcccttagtatagaattccccttacatggtataggttgccatatttcatgtgcagattttaatttcatttatgtgggcgctctgttttttctttgcagtccagccacattagaggggaggaaccgagtgatattgattcaagtcattttagggggacatacttggaaggcagaacttgctgcttctgtttggggaggacagacctgactgtgactggattatctgataaccatttgtgaatactgaaattctgttaggcagtaactgataactgctctaaaggatcattaaataggatgctgaaattatgtatcttaatacagtgtggtatgagaattaccaagtcaagagaattgtggacataagcaagtttggccccaatactgctcttaactcattttccagcttactatttgctatttaaatggtaggcaccagctaagcacttctaagcactaacacagctagaactaggcaaaaatggttagaactcagctctcttctactagtccctgtcataattatttttgggaaaatgtccaaactgccccctttaaatctaagggaatgcaccaaaacagagatatatagaatgtcaaccatttcatttttttttttctgcatgccttggtacatagtgaacatacaacctatttaaagataaagcatgtttttgagactcgctcacccccccccacccaaccactcccaaataataattgggatgccattttttttccttttggatgaggtaaataattttaaggttcacaattttgtcttttactgcaatttaaggaaacatttggatgtcagtcaatatgttcataattttggctgtgtgcgaatttctgctggcattatctatgaattttcttcctacttatttttttttcagtatatgaacaatcatgtatctacctgccccaggatgaaactaaatttaggtggaccctaaaccttatgaagacagtgctgaggcactttccttttctgatttcatctttttgggaatctgttttattgaaggtagttagtagttgagagtgcatttgctacaagcatatacttgtatcttcctagcttcatgaggaacagaaagaggtggatatggctcagggtgtggcagggacaattgaggacaaagtcaattcaaatttgtgggtcagaaagaatttttgtggacgtagtgtttttggagaaactctggatggttatatgtgcatgccttttcttcaaaaggaaatacgcaaggttgtagcatctaaaaataaacataagagtcagacaccaaataaatcaagttttacataacagttgtatgcccagtttgtttaggtgagatttcacattacagaaagtatttgaggagcatgaaaatgggttatcttctgtattttccagtttggcaaaagttcagaatttcatcacattgctttgccctaattttgcccagaattttatcttagcctctctctgacagtgatgaatcatgctcaaaagccattctaattggacctttttaagacagggaaagggatcagtaggcggattggaagaaatttcaagtcattgaaatattccattgagatttcctaaagggacaaaattgggaaaataagaaactacgacttagatttggctacgtagtagaaagtatctcccctacatacatacaggcaattgtatgtatgaatcatagggtatatgtgtgtgtatactacacacacattcttttaaagagaattcatggaaaaaaaagcagttggagtgatcagatgtattgcaaaaacatacagagaatttaaatgacagttaataccaagaaattagttgggtttactttatcaggtcgtaataggaatcactaaagaagttactagtgtgtctttaggaccagtggcaactcttaaactaaaactttgggtccttattatctacttacagaacaaagtgaaacaaacaatgattaagctgattggatatacattcaaagatatttaatgtaaagttttttggaatacgaagaaaattcagaaaataaatattatcaacagttacttattggcaaatagagaaagacaagaatagtttagtgagcccggtattttgtttttatagtttttatctcagttgtacaactcacaaaaccatgaagtctttggtattttataaatgtttaacaaaatttacatcagattaaggcatttagatgaaaattattatgttctcactatcttccaaattttatttcatcctatctccaaaatgatttcttagggtacaaaaagagcagacggggctgtaaaaatacaagcaaaaaactgtgtgcccctagtttcaggcagaacttaaactgtcagaggtactagctacatgatttgttttttaactttggattgttcacgtccaaaaatggataaattacatttgtgtttatcatcagttgcattttatgtattattttaataaatactatctgaatgaagactattctaaaccagaaaattccccaaatccaaaagaaaaaaaaagtgggaagaggtgaaattgaagtttgtgtatatgaaagttatcttagacatatttttaattctccagtttctgcaaaataattaaaatatacagtaactggtctcctaaatcctgaatttaatgtattaaatacttatgttctttatattggtgcctttttaaaatgcattgagagtgttggttagctgttgcagctgtacaacacttttaatatgcatttttaaaaatcacttaaaattgagtactatataattcatctctgcatttttagtgcaaatctttagagcaatttctaatagagaaattttcagctcagctgttaaaaggaaaaggaaactttgaaactagactttactacctttttagtttcatagtatttctgaatatgattacaagattatgcaggtaaaatatagagtgaaactttacctgtgaattgaattataatttgtgtttttgttttgtttttaaggaagaataagttctgtatcaaacaagaatttattagataattttttggtcaataaaatacagtattcatttggattttcatctccagactagtattgttctagtcttggaatctgtattttctaatctgttagaaaatagagattgaaaattgatggaataatgtgaaaaagcaggtaattaattctccttgaacaaagcaaaactgaacagtcatatcacattgctattctccaaagcataatctcaaatggtttcatatcatggttgtgtattacttgcaatgggtgtgttaggatatgacagctttttaaaaaaatgagctgctggttatacaaagcaaatggcatatgaccaagaagctgtgatatgctagtgtttctttttatcatagtgtattactaggccaaataatgacaccttgaatatttttacatttattgcagaaaccttaaactttggaatttccataaggtttttatgtaatattctatttctagctttttagttttatcttgctgtactgtaagtttgaggatatttttcacctgcactcttaggaataagttcataattctgtttatggggctttcctcccataacactgcatttgtatattttctgtataaaatatgtgttgtgtattaacctttatcccatacagagagtggtacatgaatgactagttttctaagatgtcctttttattgtgaataaaatataaaagttaaaggccctctgctaagtcacataaagtacagcatataagttcatataggtacaaataaatgagtttgcagtgaattgggccttcaaattacctcaagtgacagatagtaagaaaagcttcttgagcaggtggaggtcactgaatcccctactatgcacttaccaagattttacttactttaatttactggaaattgattttttaaaaaatgactacactgtaacaagggaagggatctgggtttttttgttgttttattcttgttttttttaagtagttcaaattctgaaactgtgatttaaaaattttttacagtcaagcattctgattttgaacataactcccttccctttctgtgtaacaaaggtctctctgttatctcttaaattttgttacatctccctcagcctctttctttgtccgtctcccttctgtcattgtctatggatgtttacctctctgttctcctaaaagtttgaagattaggtcaactcttatttctagttcattggtaatttaatcttaatttttttttcgtgatttttgttggttgtataatctgctgacgtatttttatactcaagtgtagttttctattaaaaagaaaagtggttggattaaaaatagtaagctatgtaaccctcatgttactttcactttcaaatattgggtacctaaaacattacttcagagattatgtaatcctattatagtatgtttgctttcctttattgttggattttacattctgatttggctttcctccaaaaaatgtatatcatgaaagactagacagttatttgcaagtgtttagaaaggtgttaaaaatgtaaagcaaagagtcttaactttctcctaattgggagaaaaatgctttaacattactataataatattccaggtttggagggggtctccaggccccatatttgctgttaatagttggaccttttagaccatgtgttatttgcaatcccagaatgattgcttctgctattagttaaaaagatactattcttttctttctgtacaagtgcaatactccccttgaagtcttaaaaactatggtgatttttttttcttttctgacctattcttcctttagctaatgacaaaaagaaactcataaaagtcatagtatgttaaaggacacaacaagcaaagagaaaaacactccacaatcaaaagattacagaatgtggaaaccactagtctgatctcatggtatctttatttaagctaaatttccatggaaattagtaatcttttgcttgaaaaatgtgtcctaaagttgaactttttacagattgaatcttcttagaccctcgcccaatgctctaaattaagaacctaatacttaatatttttattttacttctccccttttagaaataaacttttaaataaaagcaaagcacttagctgagttttaaacacttacatatcacctattggagaaattttttttaaaaatatttggagcagtcctgttttcatacaaatttaagtaagaggtatttttcttatacatatttatatgtagtgtgctaattttctttttttatacctgtgtccctgtagtaaaactgctgtaatataaatacatgttttgttaaaagataacatttctttggcatttcttttaaaggcagttactgcatttctgcatttgtacagtatgtgtcttggccattttagatattctttctttaacaataccaaaggtaattagactattttaaagactaattgcttgacagtttctagggtattttgtgttttagaagcaaaaaaagaaaaaaaaataggtcaaaccagtaaacctcattttttttcaaactaataatttggggaaataaaaactattgtttaaaaaagaaatatatatatatatatataaatatatatgtaaagttaaaattccataccttgtatgtcaggtttgctaagtgtaatgtagtttttttaaggctcaaataccatacctcagaaaatgaggtttactatggaaatactgaaacagtctttgcagctgtgtgacaagtcactctactacatactgatttggagacctccgctaaatagttttatcactgcagactaaaatgtgggacttgtatcttctttgtttttaatgcacacacatacatgttctgtgcatgtatgtggttactgtgtatatgtgtatgagtgttgtatatgcatgtgtgagtgtgtgtctgtatgtgtgtacaactaaagaagctgcagaaactttgtaatactttgtgaaaaggattatattataaaggtttgtactgtctgagtgcacagctactggaataaatttagggaatctcaggaacaagcatataatttgtccaagatttatttcttctcagaagtgtaagtgcagtttttaattctgtatattatttaatattttaccaataaaataaacttctgac

SEQ ID NO: 1005 - DNA, 693 bp, Homo sapiens
atggaaacagaggctattgatggctatataacgtgtgacaatgagctttcacccgaaagggagcactccaatatggcaattgacctcacctcaagcacacccaatggacagcatgcctcaccaagtcacatgacaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactag

SEQ ID NO: 1006 - DNA, 4555 bp, Homo sapiens
gggcgggaagggagtcggagacacaacaaagatggcggcggcgactgtgacggtgacgaagacggcggcggcggcgacggcatttaacaaggcggtgtggtttactccatgcagttgtcaggagacctctgtatggcttttcaattttagttgaaattctctctccatggccttttggagtcccttgctgtatctccgaagtaaatttcaattactctacatttcatcaatgttggagtggcaagaaaaaggaggaacagatttggggtgaaaagttttgttttctaggtctaacaaactgtaaatgttaaaaaagcaaagatgggtgaaaaaaaaccagagcctttggacttcgtgaaagattttcaggaatacctgactcagcagacccatcacgtgaacatgatttctggatcagttagtggggacaaagaagcagaggctcttcagggagctggaacagatggtgatcaaaatggacttgatcacccatctgttgaagtttccttggatgaaaactcaggaatgttagtagacgggtttgaaaggacctttgatgggaagcttaagtgtcggtactgcaactatgccagcaaaggaacagcccggcttattgaacacatcagaatccacacaggtgaaaaacctcatcgatgtcatctttgtccatttgcatctgcttatgagcgtcatctggaagcccatatgcgttctcatactggagaaaaaccatacaaatgtgaattatgttccttccgctgcagtgatcgaagtaacttgtcccatcatcgaaggcgcaagcataaaatggtaccaattaaaggtactaggtcttccttaagcagcaagaaaatgtggggggttttacagaagaaaacaagcaatctgggctatagcagaagagcactaatcaacttaagtccaccttccatggtggttcagaaaccagactaccttaacgattttacccacgaaatcccaaatatccagactgactcctatgaaagtatggcaaaaaccacaccaactggtggccttccaagggacccccaagaactcatggttgataaccctttgaatcagctctcgactctagcagggcagttgtccagtctgccacccgaaaaccaaaaccctgcatcccctgatgtagttccctgccctgatgaaaagcctttcatgattcagcagccctctacccaagcagtagtttctgccgtatcagcaagtattcctcagagctcctctcccacaagcccagaacctcggccatcccatagtcaaaggaactatagtccagtggcaggtccaagcagtgagccaagtgcccacacgagcactcccagcataggaaacagccagccaagcaccccagccccagccctgccggtccaggaccctcagcttctgcaccactgccagcactgtgatatgtactttgcagacaacatcctttacactattcatatgggatgtcatgggtatgaaaatccttttcagtgtaatatatgtggatgcaaatgtaaaaacaagtatgattttgcctgtcattttgcaagagggcaacataaccaacattgattgaaaatagtcatattttacttagttttgctgtttttgtggtttggttttttttgttttttgttttggtcatccctaataaagtgtctgctaattcaaggcttatacattatatttatagaatataaatttgtcagtggaataaaatttcccctttttttcataaaaatctggtcagggtcatttatatattagaacagttagacacattggtgtctcttttttcctttcctttcgacattggagaattggagtgcagtcataatcttacaagatgttcatttgaatttctcacatttatggtccataaaaacttcaaggcttatccatacttttgatgtttcaatatgcattgaactggatgttatttctgccatatttcaaaatggtagaataaattacagaatttattactactcatttcagtgtttagtacagaaattgccttaaaaattgctattaattgaaatatcatttagttcacattccttaagttgaatcggtagtttcatttcaactgataatagtaaagctatttcagtttagtaaaaattttcttttttccacaagaggaaatgtaaaacagttaagacttgaaattgaaaattcttttaatatttaaaataacttgtttattcaatgtctaaacacatgtcagttttccactggatttttattttcacaggtaaatacactagagtgctagatgcctttttcccctgtcagtttgactttcatttaaatccttcattctgatatcattactgttaggtgaggtggataactataatgagaatctcttattcttcctattcctttgatgaccaaagagataaagtgaagtcatccttattattaaaatgcagcctccaaacaaatttctcaagattccttttccttccttctatccattttctgcccataatttccaagaaaaggtgggtatggaaacacatgagagaatgtgatagtgaagtcatatttacaaaactgagaacatgtccaaaatggattcttgtctcctcttcagaattagccatttaaaatattttctgtgacttcaaattgtaattcttatttgcagttttaccagtcttcatgtacagtgacgaaactgtgtagaaactaaatcatcgctttagtaagaaaggataaaaaggtgtggaagtgaatataaaatgcatctaaacatgacatttaatttgtttataaaaataagacttactaaatatagagtaattcattttgaataggaggctattgtttttatattgtgtaataactcacgtactctgaagagagcttggtcaaacaataaaatacattgttactaacttggtttcttttctgtgtactttgcaaaaattctatttttaattttgttcatatgttgaatgtgcccctaattggcatcttaaagagaatagtaagcatctattaaccaaaaaagaactctaatagtaaaggaaagggaaatattggtggtatgtacccacaaaacccccaagtgccaagttaatggaatctctgctttccctttcagatgctagaaagccactgtaatgagttcttgcagtttagcatccagtctaagctactgcattgtttaaagagcagcatcaaggacactttctccaaactggaactctcttctttgtcaaatcttgtactttaaaattctacaattctgttacattgttgtttaaatcacagactgctcagatccattttactgcagtagtttccaagtgtgtaacttggctttagtatttatcagttgccagaaagaaacaggttgtcatttggaagtttttgtggttattttttcccatttttattcttcagataaaagcagtaccccaaaatagaaaatgaaaattttcatgaaacaaagagaactcccttgttaaaaccagcttattaactctgtattctgtcaaatgcatttttttctaacaactgaccatggatgttgtgaaggtgcattttaatttaaacatggaaaagatttttttcataattacatactagaatgtaaaattataattttgccatgacttaaagagcacagttgatatcccaaaggttttgatgctaagaagctacagttattctaaatgcactaaaatgtttgaggcaaatctaccttagaggcttttttggtatggtattttttaaaatatttagattttatttaaatttcctgtgagttattctgtatttgaaaagatgttcgtgtcttcccctctgtattgaatgtttcactcattttatttttaatcaaatattttatagaaatgagttgttgggaagagtttaacatgcactatttatagtactttgccgttaacaggcaatgttctgaaactaaatttatttttgttcagtgaacataagtttagatttttaaagttggtagataatttatctccactaatatttttttaagaaactgtgaagagattaactgggaataattttatttcagattttactaatgtagtatgtagctacaacttcttgaacttcaagttaaggctagacatttactttgaaaaaattccactgggtgtttccagggctatttcattttagaaataagtgtttgccattcttctgcaaaaactggacaaggggaatactacaaaaaatactcagagataaaatcctcatttcaagttctacaaaatatttatcaaatgaatgttaatttttttttaattccctgctaaagacgttttcattagtcttagagggtatatgctttctagaacttgtttttgttaacatgtgctttgatgtaaagaacatattttgtatgcaaaacataacttgcattatggttgtacaatacactatattgtttagggattccggaaagcagtttaatgcagaaataactatatctagtatgcagttcatattgtgaatgaagctttgcttttgtaataaataaataagactttctaatgac

SEQ ID NO: 1007 - DNA, 1261 bp, Homo sapiens
ggttgttttgctggctccagtttttccgcggggcggaaaaggcgtgtctgcgtgtgtcccaaccatttctagtcccctttcctcgcaggacctcatgagtaagctgtggcggcgtgggagcacctctggggctatggaggcccctgagccgggagaagccctggagttgagcctggcgggtgcccatggccatggagtgcacaagaaaaaacacaagaagcacaagaagaaacacaagaagaaacaccatcaggaagaagacgccgggcccacgcagccgtcccctgccaagcctcagctcaaactcaaaatcaagcttgggggacaagtcctggggaccaagagtgttcctaccttcactgtgatcccagaggggcctcgctcaccctctccccttatggttgtggataatgaagaggaacctatggaaggagtcccccttgagcagtaccgtgcctggctggatgaagacagtaatctctctccctctccacttcgggacctatcaggagggttagggggtcaggaggaagaggaggaacagaggtggctggatgccctggagaagggggagctggatgacaatggagacctcaagaaggagatcaatgagcggctgcttactgctcgacagcgagctctgctccagaaggcgcggagtcaaccttcccctatgctgccgctgcctgtagctgagggctgcccacctcccgccctcacagaggagatgctgctgaagcgcgaggagcgggcgcggaagcggcggctccaggcggcgcggcgggcagaagagcacaagaaccagactatcgagcgcctcaccaagactgcggcgaccagtgggcggggaggccgggggggcgcacggggcgagcggcggggagggcgggctgcggctccggcccccatggtgcgctactgcagcggagcacagggttccaccctttccttcccacctggcgtccccgcccccacggcagtgtctcagcggccatccccctcaggcccgccgccgcgctgctctgtccccggctgtccccatccgcgccgctacgcttgctcccgcacaggccaggcactctgtagtcttcagtgctaccgcatcaacctgcagatgcggctgggggggcccgagggtcctggatccccccttttggctacgtaaggcccttaacccggactctgcgccccgtcccatgcccgctcttgagtatcttccccaccctattaaattacatccggtgcttcggcttgtacagaa

SEQ ID NO: 1008 - DNA, 2040 bp, Homo sapiens
tttctagtcccctttcctcgcaggacctcatgagtaagctgtggcggcgtgggagcacctctggggctatggaggcccctgagccgggagaagccctggagttgagcctggcgggtgcccatggccatggagtgcacaagaaaaaacacaagaagcacaagaagaaacacaagaagaaacaccatcaggaagaagacgccgggcccacgcagccgtcccctgccaagcctcagctcaaactcaaaatcaagcttgggggacaagtcctggggaccaagagtgttcctaccttcactgtgatcccagaggggcctcgctcaccctctccccttatggttgtggataatgaagaggaacctatggaaggagtcccccttgagcagtaccgtgcctggctggatgaagacagtaatctctctccctctccacttcgggacctatcaggagggttagggggtcaggaggaagaggaggaacagaggtggctggatgccctggagaagggggagctggatgacaatggagacctcaagaaggagatcaatgagcggctgcttactgctcgacagcgagctctgctccagaaggcgcggagtcaaccttcccctatgctgccgctgcctgtagctgagggctgcccacctcccgccctcacagaggagatgctgctgaagcgcgaggagcgggcgcggaagcggcggctccaggcggcgcggcgggcagaagagcacaagaaccagactatcgagcgcctcaccaagactgcggcgaccagtgggcggggaggccgggggggcgcacggggcgagcggcggggagggcgggctgcggctccggcccccatggtgcgctactgcagcggagcacagggttccaccctttccttcccacctggcgtccccgcccccacggcagtgtctcagcggccatccccctcaggcccgccgccgcgctgctctgtccccggctgtccccatccgcgccgctacgcttgctcccgcacaggccaggcactctgtagtcttcagtgctaccgcatcaacctgcagatgcggctgggggggcccgagggtcctggatccccccttttggctaccttcgagagctgtgcccaggagtgaacaaccagccctacctctgtgagagtggtcactgctgcggggagactggctgctgcacctactactatgagctctggtggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgcttcctcagcaccttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccggggcaggggtgacccctgcctccacacccccctcctgccgctatcgccgtttaactggcgactccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagct

SEQ ID NO: 1009 - DNA, 677 bp, Homo sapiens
aagacggaagtaacagcggaaaggaagttccaaggcccgcgctgggaaaaaggtggggggaccaggggaagactcggagtgcgatggcggcgcaaattccaattgtggccaccacttccactcccggaatagtccggaacagcaagaagaggccggccagcccttcccacaatggcagcagcggcgggggctatggcgccagtaagaagaaaaaagcgtccgcttccagctttgcgcagggtatcagcatggaagccatgagtgagaataaaatggtgccctctgagtttagcacaggacctgtggaaaaagctgccaaacctttgccatttaaggatcccaactttgtgcactctggccacggtggcgcagtagctggcaagaagaacagaacctggaagaacctgaaacaaatcctcgcttctgaaagggcattgccgtggcaactgaacgatcctaactacttcagtattgatgctcctccatcctttaagccagctaagaagtattctgatgtttcaggtctgcttgaaccaccaaactgttttccacagaggctgcatcaattgacattcccactagcaatggatgagggttccaatttttccagatgctcaccaacacttgttaattttggttttgttttcattatggccattctggtgggtgtaaagtag

SEQ ID NO: 1010 - DNA, 974 bp, Homo sapiens
acagcttggagtccaggccgggttttcaagcatcaagacggaagtaacagcggaaaggaagttccaaggcccgcgctgggaaaaaggtggggggaccaggggaagactcggagtgcgatggcggcgcaaattccaattgtggccaccacttccactcccggaatagtccggaacagcaagaagaggccggccagcccttcccacaatggcagcagcggcgggggctatggcgccagtaagaagaaaaaagcgtccgcttccagctttgcgcagggtatcagcatggaagccatgagtgagaataaaatggtgccctctgagtttagcacaggacctgtggaaaaagctgccaaacctttgccatttaaggatcccaactttgtgcactctggccacggtggcgcagtagctggcaagaagaacagaacctggaagaacctgaaacaaatcctcgcttctgaaagggcattgccgtggcaactgaacgatcctaactacttcagtattgatgctcctccatcctttaagccagctaagaagtattctgatgtttcaggtctgcttgccaactacacagacccccagagcaaactgcggttcagcaccattgaagagttttcctacattcggaggctgccctctgacgtcgtcaccggctacctggccctgaggaaggccacgagcatcgttccctgagccccagaaagggagatgaagtggaaagctgtttcaaaaacagactctggactcatgattttgtttcacggaaacaaactcgttctgctgtcaatctgaaaatgccagtgctgtgccttggaaagaatgtttggctttaatttaagggttttttttttttttagtgtgtgttttccctccaagtgtgatatttcctgctgaattaaattatacttcagttgttgcctcaagtaaaggtgtttgacaagaagatacaataaaaccatacttttcattta

SEQ ID NO: 1011 - DNA, 1086 bp, Homo sapiens
acagcttggagtccaggccgggttttcaagcatcaagacggaagtaacagcggaaaggaagttccaaggcccgcgctgggaaaaaggtggggggaccaggggaagactcggagtgcgatggcggcgcaaattccaattgtggccaccacttccactcccggaatagtccggaacagcaagaagaggccggccagcccttcccacaatggcagcagcggcgggggctatggcgccagtaagaagaaaaaagcgtccgcttccagctttgcgcagacgtgcctttcgccttccaccatgattgtgaggcctccccagccacgtggaactacgtgcctcttgccttccgccatgattgtgaggcctccccagccgcgtggaaatggtatcagcatggaagccatgagtgagaataaaatggtgccctctgagtttagcacaggacctgtggaaaaagctgccaaacctttgccatttaaggatcccaactttgtgcactctggccacggtggcgcagtagctggcaagaagaacagaacctggaagaacctgaaacaaatcctcgcttctgaaagggcattgccgtggcaactgaacgatcctaactacttcagtattgatgctcctccatcctttaagccagctaagaagtattctgatgtttcaggtctgcttgccaactacacagacccccagagcaaactgcggttcagcaccattgaagagttttcctacattcggaggctgccctctgacgtcgtcaccggctacctggccctgaggaaggccacgagcatcgttccctgagccccagaaagggagatgaagtggaaagctgtttcaaaaacagactctggactcatgattttgtttcacggaaacaaactcgttctgctgtcaatctgaaaatgccagtgctgtgccttggaaagaatgtttggctttaatttaagggttttttttttttttagtgtgtgttttccctccaagtgtgatatttcctgctgaattaaattatacttcagttgttgcctcaagtaaaggtgtttgacaagaagatacaataaaaccatacttttcatttatccc

SEQ ID NO: 1012 - DNA, 3042 bp, Homo sapiens
ctcttcttgtacagccccggcagccctgccttcttggctggagagtatattcagggatttccccttaataatcaccgaccctgggagcactttttagtttccaaaataaaaatatgatcctcacccctcttgcttgacagggaaaggctctcgccggagcccaggggggagcagtagcagcggcagccgagcttcctagtccattgccagcgcctctcactctgatctgtcagcccagccgagggaacaggggggaaggagaaaaaaaaaagcagctgaaagacaatctgcttcatcctgattctgcggcattccaaactgtggtatccttgggggttctcttaacattgctatggtgcagaagatttaaaatcagctgatgttcacaaggaatagagtcacgtgatgtatgaagggaaacatatacacttctctgaggttgacaataagcccttgtgctcatatagccccaaactgtgcaagcagaggcgactcaacggctacgccttctgtatcagacacgttctggaggacaagactgcccccttcaagcaatgtgaatatgtggccaagtataacagccaacgctgcaccaaccccatccccaaatcagaggatcgtaggtactgcaacagccacttgcaggtacttggctttatcccgaaaaaagagaggaagaaaaagaatgatcctatagatgaggtgaaggtcaggcaccagatggataccatggcctttagcctgacagtgcccacgttggccttgaagatgcccaacggactggatggaatgtccctctctccacctggggcaagggtccctctccactacctggaaaccgaattggaagacccatttgctttcaatgaggaagatgatgacctaaagaaaggggcaactgtgagaaagaagttgcagagcaagttggcccagaatcggcagcgccagagagagacagagattttaaaagttcgacaagagcactttagtccccctcctgcaccttcacagcagcagcctccgcagcagcactcccacctgtcacctttatctacttctttaaaacctccagcgccaccgcagggttcagtctgcaagtcacctcaacctcagaacaccagcctaccaatgcagggagtggcacccaccacacacactatagcacaagcacggcagttgtctcacaagaggcctctgcccctcctgccatccagtagggctcccactgtggacccacccaggactgaccggatcctcatgaaagccacagccttctctccacacttctcatgtataagccgactgcagagactggtgaaactgtgcacccagaaacatcagttggacactgatctgtttccccatttaggtttggactggtctgaagagagcggagaggaaccagaggactcagagcaggcctcgccctaccaggttgcatggtccatccgggaaaccctcagatatcaaagacatgcgtcagatgatgatgatgcggagagtaggagctccagggtgactcaactttgcacttactttcagcagaaatataagcacctctgccgcctggagcgggcagaatctcgtcaaaagaaatgccggcatacgtttaggaaagctttgctgcaggcggccagtaaagaaccagaatgcactggtcagttaatacaagaactgcggagagctgcatgcagtcgaaccagcataagccggaccaagctgagggaggtggaaccagcagcatgcagtggaaccgtgaagggtgaacagtgcgctaacaaagcccttccattcaccagacattgtttccaacatatcctcttgaaccactctcagcagctcttctcaagttgcacagccaagtttgcagatggacagcagtgctctgtgccagtttttgacattacacatcagacacctctgtgtgaagaacatgccaaaaaaatggataatttcttgagaggagataactcccgtaaagttcagcaccagcagcagaggaaacccaggaaaaaaaccaagcctcctgcactaaccaaaaaacacaagaagaagagaaggcgtggacctcgtcgaccccaaaaacccattccacctgcagtcccccaagggaacctcagcatgcccgccagcgtctcactgccagtggaggcctctcacatccggagcccatccacgccagagctgagtgctgatgagttgccggatgacattgccaatgagatcactgacattccacatgacttggaattgaaccaggaggacttttcagatgtcctgccacggctacctgatgacttacaagattttgatttttttgaagggaagaatggagacctcctcccaactaccgaagaggctgaggagcttgaacgggccttgcaggctgtaacttctctcgagtgcctgagtaccattggggtccttgcccagtcagatggtgtgccagtccaggagttgtcagatagaggaataggggtgttctccacaggtactggagcttcaggaatacaatccttgagccgagaggtgaacacagacctaggggagctattgaatgggcgtatagtacatgataatttttctagtctagagctggatgagaacctgctccgttctgctaccttgtcaaacccacctacacccctggcagggcagatccaggggcagttctctgccccagccaacgttggccttacttctgccactctgatcagccagagtgcacttggggagagagccttcccaggacagtttcatggacttcatgacggcagccatgcctcccagaggccacatcctgcccagctgctgagcaaggcagatgacctaatcacctcacgacagcaatacagcagtgatcactcacactcctcaccccatggaagccattatgatagtgagcatgtgccgtctccctacagtgaccatatcacctctccccacacaacatcgtactctggtgataatatggcagctccagtgtgcttccggggttaccacagaccagcttcagtggcatggggccttctgctgaactaa

SEQ ID NO: 1013 - DNA, 14136 bp, Homo sapiens
ctcttcttgtacagccccggcagccctgccttcttggctggagagtatattcagggatttccccttaataatcaccgaccctgggagcactttttagtttccaaaataaaaatatgatcctcacccctcttgcttgacagggaaaggctctcgccggagcccaggggggagcagtagcagcggcagccgagcttcctagtccattgccagcgcctctcactctgatctgtcagcccagccgagggaacaggggggaaggagaaaaaaaaaagcagctgaaagacaatctgcttcatcctgattctgcggcattccaaactgtggtatccttgggggttctcttaacattgctatggtgcagaagatttaaaatcagctgatgttcacaaggaatagagtcacgtgatgtatgaagggaaacatatacacttctctgaggttgacaataagcccttgtgctcatatagccccaaactgtgcaagcagaggcgactcaacggctacgccttctgtatcagacacgttctggaggacaagactgcccccttcaagcaatgtgaatatgtggccaagtataacagccaacgctgcaccaaccccatccccaaatcagaggatcgtaggtactgcaacagccacttgcaggtacttggctttatcccgaaaaaagagaggaagaaaaagaatgatcctatagatgaggtgaaggtcaggcaccagatggataccatggcctttagcctgacagtgcccacgttggccttgaagatgcccaacggactggatggaatgtccctctctccacctggggcaagggtccctctccactacctggaaaccgaattggaagacccatttgctttcaatgaggaagatgatgacctaaagaaaggggcaactgtgagaaagaagttgcagagcaagttggcccagaatcggcagcgccagagagagacagagattttaaaagttcgacaagagcactttagtccccctcctgcaccttcacagcagcagcctccgcagcagcactcccacctgtcacctttatctacttctttaaaacctccagcgccaccgcagggttcagtctgcaagtcacctcaacctcagaacaccagcctaccaatgcagggagtggcacccaccacacacactatagcacaagcacggcagttgtctcacaagaggcctctgcccctcctgccatccagtagggctcccactgtggacccacccaggactgaccggatcctcatgaaagccacagccttctctccacacttctcatgtataagccgactgcagagactggtgaaactgtgcacccagaaacatcagttggacactgatctgtttccccatttaggtttggactggtctgaagagagcggagaggaaccagaggactcagagcaggcctcgccctaccaggttgcatggtccatccgggaaaccctcagatatcaaagacatgcgtcagatgatgatgatgcggagagtaggagctccagggtgactcaactttgcacttactttcagcagaaatataagcacctctgccgcctggagcgggcagaatctcgtcaaaagaaatgccggcatacgtttaggaaagctttgctgcaggcggccagtaaagaaccagaatgcactggtcagttaatacaagaactgcggagagctgcatgcagtcgaaccagcataagccggaccaagctgagggaggtggaaccagcagcatgcagtggaaccgtgaagggtgaacagtgcgctaacaaagcccttccattcaccagacattgtttccaacatatcctcttgaaccactctcagcagctcttctcaagttgcacagccaagtttgcagatggacagcagtgctctgtgccagtttttgacattacacatcagacacctctgtgtgaagaacatgccaaaaaaatggataatttcttgagaggagataactcccgtaaagttcagcaccagcagcagaggaaacccaggaaaaaaaccaagcctcctgcactaaccaaaaaacacaagaagaagagaaggcgtggacctcgtcgaccccaaaaacccattccacctgcagtcccccaagggaacctcagcatgcccgccagcgtctcactgccagtggaggcctctcacatccggagcccatccacgccagagctgagtgctgatgagttgccggatgacattgccaatgagatcactgacattccacatgacttggaattgaaccaggaggacttttcagatgtcctgccacggctacctgatgacttacaagattttgatttttttgaagggaagaatggagacctcctcccaactaccgaagaggctgaggagcttgaacgggccttgcaggctgtaacttctctcgagtgcctgagtaccattggggtccttgcccagtcagatggtgtgccagtccaggagttgtcagatagaggaataggggtgttctccacaggtactggagcttcaggaatacaatccttgagccgagaggtgaacacagacctaggggagctattgaatgggcgtatagtacatgataatttttctagtctagagctggatgagaacctgctccgttctgctaccttgtcaaacccacctacacccctggcagggcagatccaggggcagttctctgccccagccaacgttggccttacttctgccactctgatcagccagagtgcacttggggagagagccttcccaggacagtttcatggacttcatgacggcagccatgcctcccagaggccacatcctgcccagctgctgagcaaggcagatgacctaatcacctcacgacagcaatacagcagtgatcactcacactcctcaccccatggaagccattatgatagtgagcatgtgccgtctccctacagtgaccatatcacctctccccacacaacatcgtactctggtgataatatggcagctaccttttcagcagagatgcccatcatggcgcagcacttgctcccaacccaacttgaggtgccacttggaggcgtggtaaaccccagaactcactggggcaatctccctgtcaaccttggagacccctctccatttagcaaccttctcggcgcagatggacatcttctttccacttccctatccacgccacccaccacttcgaactcagagaccacacagcctgccttcgccaccgtgacccccagcagctccagtgtgcttccggggttaccacagaccagcttcagtggcatggggccttctgctgaactaatggcctccacctctcccaagcagcaactccctcagttcagcgcagcctttggccaccagctgagttctcacagtggcattcctaaggacctgcagcccagccacagctctatagcccctcctacaggcttcacagtaacaggtgccacagctacaagtaccaataatgcatcttctccctttccctcccctaactgagggtgtctgtgtgtttgcaggcaggtggggaacccagtgttttctatctttgtttcctctttagcacccctctccccttttcctaaagaagatataacagatggggatcagaggggcaccccccttcccagttcaatgagtggccctgcagtggacctcgctacagtgttcacatgtgctccttagcactggtgctcattccctcctggcaggcccactccgccccagtggtttccttagtggttcagcacagtgactggataggattgatttttagcagcaagtcctagaagtggaagatacctcagaataccagtgccctttactatttcctagtattcagatcagtgctttccattctgttgccaggtttttacataggtggttctagatagaatgatcttattaattgagttcctgtataagagacagcaaatggtgtgtggcaggtcaagattctgacctagcaccaactgctaaacaccacagtgaggccaggattccattcgtaattgtgatcatgtttaactaaaagaaaaaaatgtgtcttttgactgcctgtgagtatgcgtgtgcccacgcgtgtgtttttgtgcagtgcaggaagcagctgtcccattagtttgatttttttttgttctccccttccccctacttaatgagtataaaactcttacttttctcctgtcctacatctcacagtcctaataaggttggtccttcttttcctcaagtttcctgaatagggagggtggtggactggtcgtgtgagtagcacaacctttttctgctaaaagttagcccaagaagaaacagaacatagaaagcttggattcccgtcagtgaggtagggatgtcctaaaaagcttgcctgggatgactgcaggctgccggggttctggggcctgatggtcactttgtcttttcagacatttgtttgtttctaaatccctctctcatggaatacatttgcaagatgtaattaaagaaaatattttgatgtgaaaaagcaggataggtcagatagatttgaaaagatgggatctgtcaactccttgatccatcttttgcttttgaatttttcatgtttacagtagtgattctttggtaagatttgtaaaatgttaagacacttgtagaatcagtgtaccagttgtgaagtgatgtgtaatatctgaaggatacacattttaaagtttctttcaaagcagaatatggaaattagatataaattttattcgccctttggtccttttaaaataattcaagtacttgggtttaagtaaatttgaaaatagctttgggaaatgtttttaaaatgccaggattttaggggttaaagatcatatggggtagtttaggaagtttgtgactatgagatgaatttgtgaggtttcttgcctaccttttttcccccccagagaagggtggaactagattttaaaggcatctctactctgcttttgctgagtagtttcactgtcccttgagataccattggctatttatacctgagtctagtctaattcacatatatatatattttaaaagttgagagaacatacctattgatgtggttcaataattcatttgtcagggaatatttgatcttaattcctttctaataggtagtgattggatgtattttcctacttcctgtatgtaatctctttatgccatgctagttctaaccagtcccttcttttgaaagcttttctttctctgctttttaaaggaatgatggtgatcagcaggcattatgcagataccacgtgcctgaggttatggaggggaaatgtcacatgactgtatgaaatcattatatgccctattttgtatttattgatgtttctttttgtgggccaaaaatatgtttgtaatatatttagtttttttaaaatcatggtaattgattggaagatttatttttaatagctttgccttttttgcagagtgcaaaatttctaaattataacttatgtcataaagcaaaattatatttggtatcaccataaatttctattctgaatggtgagaacagataatttgaatatttctcacctgtgagtctatattagtaagcttttttattttaatgtactgtaatgaagtggtcacgagtagttacctcggctcaaaaatgtcatttagtttgttaaactattttcacaaccatcataagcataactagataactgtccattcccagcagttcagtttagtctccattgtgtatttaaaggttgtcgcagagcagcacattgacttcctcatcagccctttgacaaggaagggaaagtcgtgggtagtcgatttgaactttttctgtctacttgtcccctcatgttagctgcttgaaattcttcagttatgatacaaagctgagtttgcagtaagttgcacattttattgtttgcaattttctgttttatgtgcatttaaaagcccttctctgctttctagtaaggaggcatgaaattatcaggaatgttgctagttacagcttcacaccaaaaactttgagtaaatacattttcgtttggatgcccatgatgaaagctgaggaaagtggttgaggaattatcaacaacaaacttttcctcttattttatctagttcaaaacagatatcaaagtttgcaatttgctttgctcttgctgtttcttatgagtccctttttggaagagaggagaacatctataagcccagagagatctgtgtttttcttttacttaatagagccattctcgtctattagtaggaactttgctattaatatgtatagaaaggaatgaagtggcttttactccagaaatatgaaaattagtatcttttaaaatagcacttatgctatcacaaggcaatactggaatgaaaaacaaatcttatataaggtcctaaataggtagaaactagcttttattctagtgttgaacccaggagaaatagtggcaaagaagtttcactctgtttctgcagttctttgggactatttataaaggccagttagattgtgttactgtgatttaatttacaaagttgctgcagttaatggatacattctgtgctctgagaatctgaattccattctaatgtgtgatattcactggctatgatcagtagtatctgaagaaaagatgggctttttctcctttactctctctacataattattaatattattttaattaaagtacttaagacattgttttttcttctgtaaaaatggcttagcaatttgcacatctgggtaggttatgtagctagtaaacaactcaatagtaagtagcaattatacttaacccaccaagtgacagactatgcaatggaaaaattttctaattatcgtcacatagcttagacagcaaaggattattttctctggtgacctaccatgtgtgatataactgctttataaatgacttcctgagcaatttcatgttggcaggcagtgtggtgtgtctagtgcccctctatgagaagactataatttaatcagaaacaaatagtaggcatggggagcaagttggaaagtgaggttattattttttttccttaaaattggtgttactgtctttagtggcttgaggctaaagaaagctgatactttatctttgccaaataattatttataagatttatttttaaataagcccaatctctcacctgcagttaagaatcatcattttctgtgactgacactaaagctcttccttatcagagcttgttctcaatctgtgatcacagtccacagtggcaaagacaactctttgattaggaaggaaaccatgtttgggatgcacagaggtgccctgtccatacggttttcttcttacatgaaagaattgacctttctgttgacctataccattctgtttttataaagtgggattagaatttgagcatatctagtaaatgccgtgtggtcagtccgctgatgcttgcccgccgtctttgccgtgccttggcatcctaggggtgctggtgatggtcagtgggcatcatcggtcagcagtgcacgtgtaaggcaatctcctctcctccaggttagttcagaaggtcgctatgggttggtattgcaaaaagatgagtatatgaacactaaacttattaagaggtttgaaattcattaaaaattagttttcagtttcttcatctttcttttcagacttctttaaaaatactgttcttaatctggtatatatagaaatctaatattatggtcttctaaatggtcaacagaactctccagtttaatgaggcaatttagaggattccttgaaagaaaatttcatcatactgaacagtcctcatttgtatctcttttgttaccagtatttacattgttccaaggatttttttcctgacaaaaaatatatttctcgggagtggagagttttttatatatatatatgaaagaacatagatgtttccccccgcccaatacattaactgaatcttcactggcattctgtagaaaagttaaaacagtttaataatgtcttaacatctttatacattttcctatattctggaggaaaccagaatcatgtttagtagattaaagtaacattttaaatactacctttccaataatttgtaataaaataccagtgaaggacatgtttggatatctgttaagcatttttccctgactaatgaattaggaaagaaaacataaaacataaatgaatagttatgtctcttctaataaacagtgtcattaatgctgcagttgtgggtcaaacttagggagccttatttctaaatagcaaaaattctgttttcacttcagcccttatttttttttgttagtttttctctgcactgtgatacagagctaataagaggaaatgtgacgtttcagagagagagcaagcaaattgggtatgacttttttaccctatgttccccaatactggggatgtttggctactttgaacagcagtttttagtgatctaaagtttagatcaatactcgtataagagaaaaatctaactctcagtgagctccatagggcagcacagctttccatcttctctttcgccttcttgcgtctgcccaccacagtcccgaagaatgcacacgcacatatgatctgtacccatcccgcccgaagagtcatagaatcctcttctttcacttgtttcttttttcttcgtttgtttgtttttgtttgtttgttttttaagctggggaccactgaagtaagctctgtatgcacccaaagttccccttggaaaaattttcaacacgcagtgcagaaggctccagtgcagctaaatgccacaccattggttctacctgggggaatagactgatttgccctaaaatgactccaacctgcatcattaaggtacagttggctccagtggattagtgctgaaatgatgggaagtctgacacttgttgacattgtcttcatctgtttggaagggttgaatctgttcctctcaacagtgatagttcttttcactgtatagtattgagtatgtctcagggattccttgtggaaattagggcagtttttaaaataagaaaatagttttaaaagaaactaaaggtgactcatcattgaagagagcggaagaaagaggaaacatttggttttgtagcccacagtgtcttgcataggactttttcctttctcctccaggctctcatctcagcttcagaatacagaatcctttcccatcacgcacagctttaaaacttttatttaaaaatttccttccccaatgagctttcagaatacttattgtagattttaagagaaaaggtatattaatttatgctattaacatcacctcataaattataagttttatactaaagctgtatcgagtgtaatgaattatgttgcctatgtgtttaatagctaaatatatatgagcttttttttttttttttttttttgacaaaacaaactagtgaagcacctttttacactggatctctgccgtgtcaaggtgtatagctatcctttgctaccttgcagatatataaaataaaaggatatcctggggcctcaaaatgtagaacacctttagaccatttataactgttcctagaactgttgagaatcatgttctttagtaaatgatctgtggtttacacttaagatggctagaagcttagttacagggtacatagaaatacatagatcaagtaaaactccaactactgtagctggaatttgtaaactaagtttgtaagacctcttttatttcctatggagttattctttaatttacagtttattctgtaagttgggaagtaaaatagagaaaataataaatctagatgttctcagtgtcttattcaggaactttttatccctcctcactaaggaattcccactgtgactttaaaatagaactaaattacttgtgtgcatgtatatgtctgtattttttacacacatgcaaaaatatacattgggggcacgtgtgtgagagatatgaatgtgtgcttatataaaaatagataaaggtaaccgaatgtattgtagaaacatgatttatttagttgagggtattggagttactttctcattgtctctgttgtataaatacaccaaattaatcattatgttatcttatgttaaaaggctagctctgatatcatgtgcattttatgttaacctttggattaacttatattatgctatgttcataaaatgacatgagaaacaggaggttctaagatcagcctctcactttcgagcataaaaataagagagggagacagacagccccagacatgagctgtgtttatctattgtggtgatgggaccacagatctattgaatcttttttatgttaattatagatttctttatattcgagtaagaaaatattgttgatcatcttttcttggtgaagttaagaaaaagtataggcctttcataaacaatttttggaaggggctgctttgtttaaggagttggtgggatcatttcaccgtgcatatttcaaagctggggtgatttcatttatttccaaaatttttcaaaaaacttttactcagttctgctgttatttattaacttaagagtgctcccatccccatatttcagctataggaaaattgtgctacccctgattcatatggaattaaaaaaaaatacatccctttattttgagttttaagttgttattttgctatacatttattactggagtatctggtggtctgaaatagtcaaaagtagagttggtattaaatgttccaatgacatttatttttaatacttaaaaaatcatgtactttgaaatatgtcaaagcaacttctgataatatacctgaatttgtagttgtctcttgagcatcatttacttcatcttagatatagtgaagatctaggaaagctctatatgctgttcttttctacagttgtatttttgcagcatctcctggtttcattcactcttgttttgggatttttttttagatctgcatatttcttgtacatatgcatgcaaatgaaagaagggagtttgtactggtgccatttctcccttcagttgctggttaatgggatttgctagaaaaaattctcccggttgaagggtgaaaacagacccttatgtgtatatctgtacagagatgtgtatatgggatgtggtggcactttgctgaatgtgaacttgccttgtcaatggaaagattgaaaagtattatgtttatttatacatttgtataaatctatatatacacgtatgtatatgtgtgtgtatagataaagctatatacatatatttcccttaaaaatgtgtgtgtataataggtaaacagcctttgttaagcaagattaatgtctatggaaagttctggattattctgtaagccagaggaggtgacagtctagagtacatcatcagaacatactaaaatggaagtcctttggattatagttttgtttatggatattacacaatgaatgcttgtctgaacagttcttacttgccagttccactattcttcatcttcaccaccttctactggtcagtctttcatcacttaaaaaaaaaaaaaaaatcacacatcattgtggtttttttcccccttaattctgtctcttctagccagaagcatctggcttaagcatatttcatcaacttctctgttatttcttttaaagatctttatctctgaaattttcccagaagatacaagttttggtaatattatcaataggaattttgagacttgggcattcatctttgtctcaaaaacaaacagaaagccaaccttcaaataaaacaaatttgaaagttttagctcaataatttggggacattttacttaaattacaaaagaacataattatgattttatgatcgatattagtgttaggtttatttccacacttactgtcattaatttgtcatttacatatttttatttgctttgtagtttaatcataacttcaccatttacattttaatggaaagcatacaaggtcacatgttagcctcttgaattctgtaactaactcatttttctcatgatgaaactgctttgatgaattcctgtgtgatgaattctgctatatttccttttgacttttctcagtttgtgacattctgtattaactttgctgcagctctctagaaaacttgcatccctatatattgtgcctttaaagctcttatgcacacacagacaaaagtgtatatatacatgtcagagcatgtgtacatatgctttcgtatgtactcacacagtatgtctctagtatatattgtgggagtagatatatagatattcaaaggcaatgaaatattgctctccagatatatatgtatataaatagtgttgatataactgtatatacacatgtatatgtatgagttttaaatggcaatcttttacatttagcaaaatgctgcccctactggaatattgtcactgcagtggcagttgtatgtaatgatttaaaatacattatcaaaagttatttaaagaacatttaaagtctcatctaaagacatccacacactatttatttatcttccttttccttttattgttgtgtttttcttaactgaaagggagactgtcattttaaaaatgccatctgtcccatgagagtaagaaagagctggagattcacttgaggagctttgtgcatttttcctctctctgaagtggagatgttccacagaccagactgtttatttcacttataaagcaatcctaatatttccgttagtgtatgtcagccaccatctcctagatcaacttaattcaccaatttgcctcctcctttcattaataaataatgattattgagatcattttgcctgggggaagttaactactcccatgctgcagggaaatatatcacctaattgttattttgccttgttcaaaattcaaatttgaaagaaggcagctctctcatgaagctgtcttaagcacattttagttaagggccctcccaaactcttttttctttctttctttctttcttttttttttttttttgcgagttccaagttgcatgtgcttgaaatagatttaattcttattccccacagtttaggtatttttcattagtacatcaatttgacacactgaatgcaagactattaaggaagaacgattaaatattattttattttgtgaagagttggcagcagattacatctcaagaacttgcagagagaggaaggtagatggacaatcctaaattgtaagatgttacaaaaaacagtgaagtaagagtactcctgaagactaaaatagagaggctggggtttgagccattttactgagtagcttagctggaacctgatatcagaagtagcctttaacaaaaagcctcttggcaattgtatggtactaacaactagagtactgaagtgtaagttgaaaccaagttgcagtgggaaatcaaaggtgaggtagcttatttgaaaccagcaaatgagacaggttggacagttttaaaatctcttctaacaaagaaactgcacggtagcaaggactagcggttctcaaagcccttctttttcagtgttctcattcaccttggcacccaagtatgtttaacaggccatgcattaaaaataaatacaaaaatataaaagccgcttaaagggaacttacaaactgacaatctctcctctgtatttgtgttcatagtggctgggagtttaattatatgcacaaaagttaggagccacttgtttctgcacagactgtaggagcaagatgaggagatgggcaggttttggtaagagcccccagttctggtggacaggcatacttgtggcattgggtgcggcattgctgggaggaccacgtcttgggaggcgattgacttttggtttgtaatttccctttaaacaagaagagatggctcacattttccatatatatctcaatgaatgtactgtattactgttttaaaaatttgatgaaataataatgaattggtctccttttgttatctggtccttgtttaatttgtttaagggtttttgtatacaaaagtttacatttttatgtatatttttcttgtgtaaaaactgatgtaatatgtgtatgaaacactgtatgtattatctgtatatagtgtgacaaaatcatttttctttctttcttttggatgtattaataaatcttgctgtgaagta

SEQ ID NO: 1014 - DNA, 753 bp, Homo sapiens
ctggcccccctttgctctgcctccaagatggtaggaaagttgtcgtttcggagggcagaggagcagctctctggtgttatgtcctcgcagtgcctgtagtggtgctgtaggaggctgctgcctcttcttgtacagccccggcagccctgccttcttggctggagagtatattcagggatttccccttaataatcaccgaccctgggagcactttttagtttccaaaataaaaatatgatcctcacccctcttgcttgacagggaaaggctctcgccggagcccaggggggagcagtagcagcggcagccgagcttcctagtccattgccagcgcctctcactctgatctgtcagcccagccgagggaacaggggggaaggagaaaaaaaaaagcagctgaaagatcttcactctcacccaggctggagtccagaggtgtgatctcggctcactgcaacctctgtcttccgggttcaagtgattctcctgcctcagcctcccaagtggctgggattacagacaatctgcttcatcctgattctgcggcattccaaactgtggtatccttgggggttctcttaacattgctatggtgcagaagatttaaaatcagctgatgttcacaaggaatagagtcacgtgatgtatgaagggaaacatatacacttctctgaggttgacaataagcccttgtgctcatatagccccaaactgtgcaagcagaggcgactcaacggctacgccttctgtatc

SEQ ID NO: 1015 - DNA, 1687 bp, Homo sapiens
cgagggaccgttggcccttggccgcggaccgcgtgggccgagaactttgccagacgagacttgttttctctgggcagttggagggtctcgcggctcctacccttttttggaacggatcattttaaaagttctcgttagaaaccaattcggcgccggcaccctttgggtgaaacctaatcagcccgcgacgctgcctttctcactggtcacgggcaacagctaggctgctgttatttcgcaaggcagaagagaaaaggcatcctcgcgagcagatgaggaacctcggggataaatccttttgtggcttcaagtgtctaagtacattagagtcaggaacggcgctttccagcgtccgccatttttgtggcgtcaccgcgtcgctgctacgccatccccagcgcagtggctgccgcgctcctgtcccagtgtcccccgggaggtcggcccgtgcggtgacgcccctgagcgcggggtacgccgggagttgtagtcctgacggcacagccttgcagcgtctccggaagtggaggcgggagcggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgagcacgagtgcttccaggaggagctgaggaaagcgcaaaggaaattactgaaggtgtcccgggacaagagtttcctcctagaccgacttctgcagtacgagaacgtggatgaagactcttcggactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgctggcctcctcccgctaccccccattcccttctgactacctggccctgcagctgcccgagcccagtcccctgaggcccaagcgggagaaacggccccgcctgccccggaaactcaagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgggtt

SEQ ID NO: 1016 - DNA, 515 bp, Homo sapiens
acagccttgcagcgtctccggaagtggaggcgggagcggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgagcacgagtgcttccaggaggagctgaggaaagcgcaaaggaaattactgaaggtgtcccgggacaagagtttcctcctagaccgacttctgcagtacgagaacgtggatgaagactcttcggactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcggaacggggccaggcctga

SEQ ID NO: 1017 - DNA, 3064 bp, Homo sapiens
gggagggcagactctgggcgccactcccgggccggtcatgaacgggccggcggacggcgaagtggactacaaaaaaaaataccggaatctgaagcggaagctcaagttcctcatctacgagcacgagtgcttccaggaggagctgaggaaagcgcaaaggaaattactgaaggtgtcccgggacaagagtttcctcctagaccgacttctgcagtacgagaacgtggatgaagactcttcggactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcggaacggggccaggcctgactgaggagagcaaagcccaggacagcatcctgctgctgcccggcccttctgtgctcgggagccccgggagccgcactcatcaccatctcttttgtttttccatcctccttctgtttgcatttcttcccccaccctcaccccggtccattccgcctcccatctccatccccgctcccgcccgcagctggcctcctcccgctaccccccattcccttctgactacctggccctgcagctgcccgagcccagtcccctgaggcccaagcgggagaaacggccccgcctgccccggaaactcaaggtaccctgacgtgggggtgctagggaggggcaggacggcaggaggacagtcacctgagggaggctgaaggcgggggcctgtcagagaaccatgaacagttaatttggggacccagtcagcacttagcactgaggggtggatcacagaagtctcggcttacaggcttgtatggagacaaatcagggcagaaccagccttggaggacccggtgtgcagatgccagggatcccgccctttcatggctgcagtgtagcggggccaggctcattttcccaggggggcgtgttgtgtgatgccaggtagccccagaccgggtcaggattatgggatctagagtcaagtcaagactgcctgttagaaaccacgtggccttgagcaggtctctgctaccctctaggcctcctaggcttggcacctatagggcgagtggtcctactcgatgtgaccagcaagcgcccctggagcgcctcctgttacacggcagtgcacaaagcagaccagtgcctgccctcacagagctcacagtctagcaagataggcagaaaacacaccagaaaagtaggtacttgtggagaagaacagagcgaggtccagagcatggggacgccagggggacgaggctgacacttagggcccagcagtctgggatgttcttgatcagagacttacaggaaatggcagcaagctgtgtggctcctgggcagtgtttctgtcgggcagagtctgtgtttgggagaaaagtaagcagggaattgggtcccggagcaggtcagagggggagctcatgaggtgccagtgtgcaggattcgctgtgaatgaagccttggagacagcagttccctggcggggcgcaggttgcaggtgtggagggggagtgatctaattgcatcttaacaaaattgcagacactggtggtcagagaacagactgagcggtggagtgagttgggacgggagtgaggaggccaccacggtaaaccaggccaagggcagagggtccagagggagctgcggacccatttcagagaatgagcatgggagttcctggaggacctggtgtgggctgtgcgggagagaggccaggatgcctccagggctttagtctgagcacgagtggagtctccctccctggagatgggagggctgtgggaccacaggcttggaggaaaactgagtctggccgcggatgtgtcagatgccatctggaaaggcagctagatagcggcccgtgaggggctgcgcatttggaagccgccaggctggcggtagatgcaagccttgggagagatggggatgggctgaggggcagagcggagtggggaccaactgggcggctcccagggttctggagccagaagcagaatgagaggccgcatttgcggtggtctggagtacaggatctggagctctaatcccaactctgccgttttctccgtgtgaccttggccctgtgaggcttcacctcttgagcctgagaagcagaggggagcgggagtccctgaagggccaggggagtgaggagatggaaggaagggagtccaagcagaggaaggatagctgtgaagacagaagcagtggcggcattgtgcggagaatgtgagtgaagggatgaaaatcgctcggcccgtgcctggcccctagtctgtgttttagagcgcgcgctctggctgccgtgcggaggagctggatctgggagaggctgcgggcagggagtccagttaggaggctgggaccgcagcccagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgg

SEQ ID NO: 1018 - DNA, 2103 bp, Homo sapiens
agcaagccccgcctccgcctcccgcggcccaggctccggcccggcacacctgcatcttcagcagctcctcctccaccagccgcttcagtgcctgcttctcctcgggctccaggtggctgcggcccgagtgagctaagtacctccgccgcacgatggaatgcgtaagcgtgctgcagggacatggtgtcaggacggagtcccgacccacccgcgccctttccaaccccatctccaaccccctgggcacctgaggtccgggcggcctcggaagaagctacgggtgaactcctgcatctccttctcccgcgccattttgctcaacccgggattgacggctcccgcctttttttcttctcggcctccgtcagcgcgtttgacagcggctcgcgcacgcgcagtgctgcggcaacgtggggcgagggaccgttggcccttggccgcggaccgcgtgggccgagaactttgccagacgagacttgttttctctgggcagttggagggtctcgcggctcctacccttttttggaacggatcattttaaaagttctcgttagaaaccaattcggcgccggcaccctttgggtgaaacctaatcagcccgcgacgctgcctttctcactggtcacgggcaacagctaggctgctgttatttcgcaaggcagaagagaaaaggcatcctcgcgagcagatgaggaacctcggggataaatccttttgtggcttcaagtgtctaagtacattagagtcaggaacggcgctttccagcgtccgccatttttgtggcgtcaccgcgtcgctgctacgccatccccagcgcagtggctgccgcgctcctgtcccagtgtcccccgggaggtcggcccgtgcggtgacgcccctgagcgcggggtacgccgggagttgtagtcctgacggcacagccttgcagcgtctccggaagtggaggcgggagcggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgagcacgagtgcttccaggaggagctgaggaaagcgcaaaggaaattactgaaggtgtcccgggacaagagtttcctcctagaccgacttctgcagtacgagaacgtggatgaagactcttcggactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgctggcctcctcccgctaccccccattcccttctgactacctggccctgcagctgcccgagcccagtcccctgaggcccaagcgggagaaacggccccgcctgccccggaaactcaagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgggtt

SEQ ID NO: 1019 - DNA, 2804 bp, Homo sapiens
aaactgagcaatacccagagaggatggaaatggcgaagaggcctggcgcctgcccgctcccgcgcatgctccctgacttcaccaaggtcacgctgcagcccgcaggaatgaaaatccacttctccgcattttcgaggtgacctggaagcggttcaactgctctggcttctcagaagaggaggggaccgggcggtaacgaggagccaaggggaggagactgctcgcaaaacccggaaaagctttcccgatccactctgccagcctccgtgcgcctccagacatgcgcagtagcctcccccgcggtggcggcggcggcggcggtggctgccgtggcggctgagagtccagagccggacgttccggccgcttcgggctggcggctggagagcgctcgggtcatgtctgcccagggggactgcgagttcctggtgcagcgagcccgggagttggtgccgcaagacctgtgggcagccaaggcgtggctgatcacggcccgcagcctctacccggcagactttaacatccagtatgagatgtacaccatcgagcggaatgcagagcggaccgccaccgccgggaggctgctgtacgacatgtttgtgaatttcccagaccagccggtggtgtggagagaaatcagcattattacatcagcattaaggaacgattcacaggacaaacaaacccaatttttaagaagtttatttgaaactcttcctggtcgggtccagtgtgaaatgttactaaaggtcacggaacaatgcttcaacacgttagaacgatcagaaatgttgcttctacttttgaggcgcttccctgaaacggtggtgcagcatggggttggccttggggaggcactattagaggctgaaactattgaagaacaagaatctccagtgaactgctttagaaaattatttgtttgtgatgtccttcctctaataattaacaaccatgatgttcgattacctgccaatttattgtataagtacttgaacaaagcagctgaattttatatcaattatgtcactaggtctactcaaatagaaaatcagcatcaaggcgcccaggatacatctgatttaatgtcacctagcaaacgtagctctcagaagtacataatagaagggctgacggaaaaatcatcccagatcgtggacccttgggagaggttgtttaagattttgaatgttgttggaatgagatgtgaatggcagatggataaaggaagacgaagctatggagatattttgcatagaatgaaggatctctgcagatacatgaacaactttgatagtgaagcacatgcaaaatataaaaaccaagtggtgtattccaccatgctggtcttctttaagaatgcattccagtatgtcaacagcatacagccatctctcttccaaggtcctaatgccccgagccaagttccactggttcttcttgaagatgtatcgaatgtgtatggtgatgtagaaattgatcgtaataaacacatccataaaaagaggaaactagctgaaggaagagaaaaaaccatgagttcagacgatgaagactgttcggcgaaaggaagaaatcgtcacattgtagtcaataaagccgaacttgctaactccactgaagtgttagaaagctttaaattggccagggagagctgggagttgctctattccctagaattccttgacaaagaatttacaaggatttgcttggcctggaagacggatacttggctttggttaagaatcttcctcactgatatgatcatctatcagggtcaatataaaaaggcgatagccagcctgcatcacttagcagctctccagggatccatttctcagccacagatcacagggcaggggaccctggagcatcagagggcgctcatccagctggcgacgtgccactttgcgctaggggagtacagaatgacatgtgaaaaagtccttgatttgatgtgctacatggtactccccattcaagatggaggcaaatcccaggaggaaccctcgaaagtaaagcccaaatttagaaaaggttcggatctgaagctcctgccttgtaccagcaaggctatcatgccatactgcctccatttaatgttagcctgttttaagcttagagctttcacagacaacagagacgacatggcattggggcatgtgattgtgttgcttcagcaagagtggccacggggcgagaatcttttcctgaaagctgtcaataaaatttgccaacaaggaaatttccaatatgagaattttttcaattacgttacaaatattgatatgctggaggaatttgcctacttgagaactcaggaaggtgggaaaattcatctggaattactacccaatcaaggaatgctgatcaagcaccacactgtaactcgaggcatcaccaaaggcgtgaaggaggactttcgcctggccatggagcgccaggtctcccgctgtggagagaatctgatggtggttctgcacaggttctgcattaatgagaagatcttgctccttcagactctgacctgagtggagacctttccaccagacacagctcgggcctgtgtaattgtaggagaagacactcagcagtgattgccatggcacagagccgtggtcattgttgctgttacaaagaagaaaaccatctgagttctaactccttggttgcttaaaagtagttcccaagagtctgagaagctatttctatttttaagagtcattttttgtaatttttgtaaaacaaaagtaccaatctgttttgtaaataaaaatcatcctaaaatttgaagtttttaaaaa

SEQ ID NO: 1020 - DNA, 1710 bp, Homo sapiens
agggaccaccgggaacagacggatcggcagggcggggcggaacggtgaggccatctactgaaacacagaagcaattttaaaagaaaatggaggaagtataactgatctttgcagaaagtggggaagtgagttgaccagagaaggatgagagaattgccaagttgtactgaacgccaagctgagaatggtgattctgaagatagaatgcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaaatgaaatcagacatcactgaaggagttgatattccaaagaaacctagattggagaaaccagaaacacagtcatctcccattactgtccaaagtagcaaggatttacctatggctgacctttccagttttgaggagaccagtgctgatgattttgccatggagatgggattggcctgcgttgtttgtaggcaaatgatggtggcatctggcaatcaattagtagaatgtcaggagtgccataatctctaccaccgagattgtcataaaccccaggtgacagacaaggaagcgaatgaccctcgcctggtgtggtattgtgcccgatgtaccagacaaatgaaaagaatggctcaaaaaactcagaaaccaccgcagaaaccagcccctgcagttgtttctgtaactccagctgtcaaagatccattggttaagaaaccagaaactaaactgaaacaagagacaacttttctagcgtttaagagaacagaagtcaagacatccacagttatttcaggaaattcttctagtgccagcgtttcctcgtcagtaactagtggcttaactggatgggcagcttttgcagccaaaacttcctctgctggtccttcaacagcaaaattgagttcaacaacacaaaacaatactgggaaacctgctacttcgtcagctaaccagaaacctgtgggtttgactggtctggcaacatcatccaaaggtggaataggttccaaaataggttccaataacagcactacgcccactgtacctttaaaaccacctccacctctaaccttgggtaaaactggccttagtcgctcagttagttgtgacaatgtcagcaaagtaggtcttcctagtccaagtagtttagttccaggaagcagcagccaactaagtgggaatggaaatagtggaacatcaggacctagtggaagtactaccagcaaaactacttcagaatccagcagctctccctcagcatcccttaaaggcccaacttcacaagaatcacagctcaatgctatgaagcgattacagatggtcaagaagaaagctgcccaaaagaaactcaagaagtaatgtggccaagtaggtttttgtatcatattagcctaaagatgaaaggcttattattatgatataatctgtaatacactgtaatttaataaaagtcttcataatcaaa

SEQ ID NO: 1021 - DNA, 1927 bp, Homo sapiens
attggaaggggttgcaagagcttgcgaagtcatgaagaacaaagttttttagagccattatgaaatggcaacgataatactgcactctatgtgaacagtttctgtttccttcatctggggcacgtgcatatgatcaactttggacttcttttgagattgccaggaactctgccagacaggggttacaacagtaggcaagaccaatccactgcctgccttcatggaacttacattctaatgagaaagaaagattatttacataattaacagtgtgattaatattacaaataagtacagaatgtttttgggctatgtaacagtgaaacttctagttttgttgagggaatgtgcaggaaaaactgaaacttgagaggtgacttaagatggaggtgggggtggcacactttctactgaagtgctaaggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaaatgaaatcagacatcactgaaggagttgatattccaaagaaacctagattggagaaaccagaaacacagtcatctcccattactgtccaaagtagcaaggatttacctatggctgacctttccagttttgaggagaccagtgctgatgattttgccatggagatgggattggcctgcgttgtttgtaggcaaatgatggtggcatctggcaatcaattagtagaatgtcaggagtgccataatctctaccaccgagattgtcataaaccccaggtgacagacaaggaagcgaatgaccctcgcctggtgtggtattgtgcccgatgtaccagacaaatgaaaagaatggctcaaaaaactcagaaaccaccgcagaaaccagcccctgcagttgtttctgtaactccagctgtcaaagatccattggttaagaaaccagaaactaaactgaaacaagagacaacttttctagcgtttaagagaacagaagtcaagacatccacagttatttcaggaaattcttctagtgccagcgtttcctcgtcagtaactagtggcttaactggatgggcagcttttgcagccaaaacttcctctgctggtccttcaacagcaaaattgagttcaacaacacaaaacaatactgggaaacctgctacttcgtcagctaaccagaaacctgtgggtttgactggtctggcaacatcatccaaaggtggaataggttccaaaataggttccaataacagcactacgcccactgtacctttaaaaccacctccacctctaaccttgggtaaaactggccttagtcgctcagttagttgtgacaatgtcagcaaagtaggtcttcctagtccaagtagtttagttccaggaagcagcagccaactaagtgggaatggaaatagtggaacatcaggacctagtggaagtactaccagcaaaactacttcagaatccagcagctctccctcagcatcccttaaaggcccaacttcacaagaatcacagctcaatgctatgaagcgattacagatggtcaagaagaaagctgcccaaaagaaactcaagaagtaatgtggccaagtaggtttttgtatcatattagcctaaagatgaaaggcttattattatgatataatctgtaatacactgtaatttaataaaagtcttcataatcaaa

SEQ ID NO: 1022 - DNA, 995 bp, Homo sapiens
cggtgagttatgctgagcgactctgctcctggcctcctggaggctcgagacccccgcgccaggagcgaggtgggagagtagctacgtggggtattagtttcctcgctcctcaaggggaatcataatttacgggcggttgcgtgccctagactgactgctctcccctttcagtgaggactgtgcttcctccgagggagttgcgggccgggacatgcggaccgagcatatttctaggtctagggacaagggacttggaatcctgcctcggactttgtcggagggttttagtgacttctctacgtagctccctcattgtctctcatcttttggctcccctgtcaaggaccatcccccattctaggacttcgatgtgtgatgctttgatcaaaggattgacattccttttctaagtgtttgctgtcagctttcagccacttgattggtttggaatcggagccttttctcctgcgattccaggtgtccctaaggtatcagtgttatccagaaccaagaactcagtggaggaatgaaaaaggcagcatctttaaaataatgtttattggaaggggttgcaagagcttgcgaagtcatgaagaacaaagttttttagagccattatgaaatggcaacgataatactgcactctatgtgaacagtttctgtttccttcatctggggcacgtgcatatgatcaactttggacttcttttgagattgccaggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaa

SEQ ID NO: 1023 - DNA, 726 bp, Homo sapiens
atcggcagggcggggcggaacggtgaggccatctactgaaacacagaagcaattttaaaagaaaatggaggaagtataactgatctttgcagaaagtggggaagtgagttgaccagagaaggatgagagaattgccaagttgtactgaacgccaagctgagaatggtgattctgaagatagaatatcaacacagttacaccaagttgctgacctctttatgactgctgtagaaagtaaacttctttcactatatggatatttgccggtaaggaaggaaaagtaacagagattagagaaggcaacagaaaagggggagtaaaggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaaatgaaatcagacatcactgaaggagttgatattccaaagaaacctagattggagaaaccagaaacacagtcatctcccattactgt

SEQ ID NO: 1024 - DNA, 562 bp, Homo sapiens
gaagggaccaccgggaacagacggatcggcagggcggggcggaacggtgtccctaaggtatcagtgttatccagaaccaagaactcagtggaggaatgaaaaaggcagcatctttaaaataatgtttattggaaggggttgcaagagcttgcgaagtcatgaagaacaaagttttttagagccattatgaaatggcaacgataatactgcactctatgtgaacagtttctgtttccttcatctggggcacgtgcatatgatcaactttggacttcttttgagattgccaggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcac

SEQ ID NO: 1025 - DNA, 1975 bp, Homo sapiens
cgcatcctcagccctgcagacccccgaagaaaagaccagttcttagggggtcgcggaggctgagaagccggcggcccgagcgccctctttacctggtcgcagaggcgcggccaggcagggagggtgcgtgagcgtgtcggcgacctgggccgcctgcgccttcccgcccagtccgagctggaattccaaggctgcctctgggagctgctgcccgcagaccactcgcctccacagacgccaggagaaaaacgacagccaccttatgtggaaaatactcgcgccggccgtcattcataatccggcggaccggaaaaagggaagtaacgtcacttcctactgtcgcactgccaaacgtttcccccgcccctactgtgggaacctttgttttcctgctttcggagccggccagtgcgggaaccgtttccgaagggaccaccgggaacagacggatcggcagggcggggcggaacggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaaatgaaatcagacatcactgaaggagttgatattccaaagaaacctagattggagaaaccagaaacacagtcatctcccattactgtccaaagtagcaaggatttacctatggctgacctttccagttttgaggagaccagtgctgatgattttgccatggagatgggattggcctgcgttgtttgtaggcaaatgatggtggcatctggcaatcaattagtagaatgtcaggagtgccataatctctaccaccgagattgtcataaaccccaggtgacagacaaggaagcgaatgaccctcgcctggtgtggtattgtgcccgatgtaccagacaaatgaaaagaatggctcaaaaaactcagaaaccaccgcagaaaccagcccctgcagttgtttctgtaactccagctgtcaaagatccattggttaagaaaccagaaactaaactgaaacaagagacaacttttctagcgtttaagagaacagaagtcaagacatccacagttatttcaggaaattcttctagtgccagcgtttcctcgtcagtaactagtggcttaactggatgggcagcttttgcagccaaaacttcctctgctggtccttcaacagcaaaattgagttcaacaacacaaaacaatactgggaaacctgctacttcgtcagctaaccagaaacctgtgggtttgactggtctggcaacatcatccaaaggtggaataggttccaaaataggttccaataacagcactacgcccactgtacctttaaaaccacctccacctctaaccttgggtaaaactggccttagtcgctcagttagttgtgacaatgtcagcaaagtaggtcttcctagtccaagtagtttagttccaggaagcagcagccaactaagtgggaatggaaatagtggaacatcaggacctagtggaagtactaccagcaaaactacttcagaatccagcagctctccctcagcatcccttaaaggcccaacttcacaagaatcacagctcaatgctatgaagcgattacagatggtcaagaagaaagctgcccaaaagaaactcaagaagtaatgtggccaagtaggtttttgtatcatattagcctaaagatgaaaggcttattattatgatataatctgtaatacactgtaatttaataaaagtcttcataatcaaa

SEQ ID NO: 1026 - DNA, 653 bp, Homo sapiens
agacggatcggcagggcggggcggaacgatcaacacagttacaccaagttgctgacctctttatgactgctgtagaaagtaaacttctttcactatatggatatttgccggtaaggaaggaaaagtaacagagattagagaaggcaacagaaaagggggagtaaaggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaaatgaaatcagacatcactgaaggagttgatattccaaagaaacctagattggagaaaccagaaacacagtcatctcccattactgtccaaagtagcaaggatttacctatggctgacctttccagttttgaggagaccagtgctgatgattttgccatggagatgggat

SEQ ID NO: 1027 - DNA, 569 bp, Homo sapiens
ggcagggcggggcggaacggtgagttatgctgagcgactctgctcctggcctcctggaggctcgagacccccgcgccaggagcgaggtgggagagtagctacgtggggtattagtttcctcgctcctcaaggggaatcataatttacgggcggttgcgtgccctagactgactgctctcccctttcagtgaggactgtgcttcctccgagggagttgcgggccgggacatgcggaccgagcatatttctaggtctagggacaagggacttggaatcctgcctcggactttgtcggagggttttagtgacttctctacgtagctccctcattgtctctcatcttttggctcccctgtcaaggaccatcccccattctaggacttcgatgtgtgatgctttgatcaaaggattgacattccttttctaagtgtttgctgtcagctttcagccacttgattggtttggaatcggagccttttctcctgcgattccaggtgtccctaaggcgtttgcaatggctgctactgtgaacttggaacttgatcccatttttttgaaagcactaggtt

SEQ ID NO: 1028 - DNA, 4506 bp, Homo sapiens
ccttccactatggccgcttctgtgtggtgtggggagacgctggtcctccccgtcctcccatagcgcttattgcctcaccctcaccccctaggggccggatccaaaggcgctgcactccccaagccttggggcatcagccaggaaggtttcctacctcctaattcaggggcaggactcctcttttccccccacggggaaaagaggcagaaacttaggggtttccctcctttcttagggtcagacgctcttagggtccacttcttcaggggcggaagcctctcctacccttcccatagggacacaggcctttaccccactgtacttcggagccaacgcctttccctcagcactgccaccccagagtcaggacccagaggactgtgccttcgcccccaacgcaggcgcggccttttggagaggagggaggagtggagaggacaggggcccttgctctcccctccccaacttgttcctcttgccccccagtccctggcaatccagagatcccgatatctaggactgtccatccatccactccctgaccttttcccggctcctggctgcagccatggagttgcagaagggaaaaggggcggcagcagcagcagctgcttcgggagcagcgggaggtggaggaggaggagcgggagcaggagccccaggaggggggaggctgctactttcaaccagtttggatgccaaggatgagttagaggagagattggaaaggtgtatgagcattgtgacatcgatgactgctggtgtctcggagagagaagccaatgatgccctcaatgcgtatgtgtgcaaaggcctcccccagcatgaagaaatctgcctgggcctgtttactctcatcctcactgaacctgcccaagcccagaagtgttaccgggacttagctctggtgagtcgtgatggcatgaatattgtcctgaataaaatcaaccagatacttatggagaagtacctgaagctgcaggatacctgccgtactcagttggtgtggttggtacgggaactggtgaagagtggggttctgggagccgatggtgtttgtatgacgtttatgaagcagattgcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtc

SEQ ID NO: 1029 - DNA, 3597 bp, Homo sapiens
tggtgtggggagacgctggtcctccccgtcctcccatagcgcttattgcctcaccctcaccccctaggggccggatccaaaggcgctgcactccccaagccttggggcatcagccaggaagtccctggcaatccagagatcccgatatctaggactgtccatccatccactccctgaccttttcccggctcctggctgcagccatggagttgcagaagggaaaaggggcggcagcagcagcagctgcttcgggagcagcgggaggtggaggaggaggagcgggagcaggagccccaggaggggggaggctgctactttcaaccagtttggatgccaaggatgagttagaggagagattggaaaggtgtatgagcattgtgacatcgatgactgctggtgtctcggagagagaagccaatgatgccctcaatgcgtatgtgtgcaaaggcctcccccagcatgaagaaatctgcctgggcctgtttactctcatcctcactgaacctgcccaagcccagaagtgttaccgggacttagctctggtgagtcgtgatggcatgaatattgtcctgaataaaatcaaccagatacttatggagaagtacctgaagctgcaggatacctgccgtactcagttggtgtggttggtacgggaactggtgaagagtggggttctgggagccgatggtgtttgtatgacgtttatgaagcagattgcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgt

SEQ ID NO: 1030 - DNA, 4704 bp, Homo sapiens
ccttccactatggccgcttctgtgtggtgtggggagacgctggtcctccccgtcctcccatagcgcttattgcctcaccctcaccccctaggggccggatccaaaggcgctgcactccccaagccttggggcatcagccaggaaggtttcctacctcctaattcaggggcaggactcctcttttccccccacggggaaaagaggcagaaacttaggggtttccctcctttcttagggtcagacgctcttagggtccacttcttcaggggcggaagcctctcctacccttcccatagggacacaggcctttaccccactgtacttcggagccaacgcctttccctcagcactgccaccccagagtcaggacccagaggactgtgccttcgcccccaacgcaggcgcggccttttggagaggagggaggagtggagaggacaggggcccttgctctcccctccccaacttgttcctcttgccccccagtccctggcaatccagagatcccgatatctaggactgtccatccatccactccctgaccttttcccggctcctggctgcagccatggagttgcagaagggaaaaggggcggcagcagcagcagctgcttcgggagcagcgggaggtggaggaggaggagcgggagcaggagccccaggaggggggaggctgctactttcaaccagtttggatgccaaggatgagttagaggagagattggaaaggtgtatgagcattgtgacatcgatgactgctggtgtctcggagagagaagccaatgatgccctcaatgcgtatgtgtgcaaaggcctcccccagcatgaagaaatctgcctgggcctgtttactctcatcctcactgaacctgcccaagcccagaagtgttaccgggacttagctctggtgagtcgtgatggcatgaatattgtcctgaataaaatcaaccagatacttatggagaagtacctgaagctgcaggatacctgccgtactcagttggtgtggttggtacgggaactggtgaagagtggggttctgggagccgatggtgtttgtatgacgtttatgaagcagattgcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaactgtatgccttccaccctcggcgtccagtgtagacggtgctgccctggcccagactatgcctggagccaggctgggggcaggggcaggacacccggggccacaacccacactcgggataaaacaacctgtgcgtgctgtttaataagctcccagacatctgattgtttttccttccctgctctcccttttcttcctctagtttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtc

SEQ ID NO: 1031 - DNA, 3442 bp, Homo sapiens
atttggcacttatctttataggcacttggaagagaaaattaggaagttgtccgtagcttagccagttgatagtccaagatagatactagcatgagtgagcaagcaaaaaatcaaagcatctactcccagtgtcaaatcatcaattatttctgaggcactgtagccaagcccaagaagcgtgaattgggagggtgaatagttctagacagagcataggagccagtgtgtttcctccctgcagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaactgtatgccttccaccctcggcgtccagtgtagacggtgctgccctggcccagactatgcctggagccaggctgggggcaggggcaggacacccggggccacaacccacactcgggataaaacaacctgtgcgtgctgtttaataagctcccagacatctgattgtttttccttccctgctctcccttttcttcctctagtttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctg

SEQ ID NO: 1032 - DNA, 1530 bp, Homo sapiens
ccaaatagcatctgcagacacttacatctgacagatacgtctcatggtgtaagaaataagtgcctgcagttacttggcaatcttggctctttggagaaaagtgtcacaaaagatgcagaaggcctagctgccagagatgtccagaagattataggggattacttcagtgaccaagacccacgtgtcagaacagcagctataaaagccatgttgcagctccatgaaagaggactgaaattacaccaaacaatttataatcaggcctgtaaattactctctgatgactatgaacaagtgcgcagtgctgcagtccagcttatctgggtcgtcagtcagctctatcctgaaagcattgtcccaattccttcttctaatgaagaaatacgcttagttgatgatgcgtttggcaaaatttgtcacatggtcagtgatggctcttgggtggttcgtgttcaggcagcaaaactgttgggctctatggagcaagtcagttctcatttcttggagcagacccttgacaagaagctgatgtcagatctgaggaggaaacgtactgcacatgagcgtgccaaggaactttacagttcgggggagttttccagtggcagaaagtggggagatgatgctcccaaggaagaagtagataccggggctgtgaacttgattgagtcaggagcttgtggagcttttgttcatgggttggaagatgagatgtatgaggttcgtattgctgctgtggaggccctctgcatgttggcccagtcttcaccctcttttgctgagaagtgccttgatttcctagttgacatgttcaacgatgaaattgaggaagtacgtctgcagtctatacataccatgagaaaaatctctaacaacatcaccctccgagaagatcagcttgacactgtcctggctgtgctagaggattcatccagagatattcgagaggctcttcatgaactcttatgctgtactaatgtttcaaccaaagaagggattcatcttgcattggtggagctgctgaaaaatttaaccaagtaccctactgatagggactccatatggaagtgcttgaagtttctgggaagtcggcatccaaccctggtgcttcccttggtgccagagcttctgagcacccacccattttttgacacagctgaaccagacatggatgatccagcttatattgcagttttggtacttattttcaatgctgctaaaacctgtccaacaatgccagcattgttctcagatcacaccttcaggcactatgcctacctccgagacagtctttctcatcttgttcctgccttgaggttaccaggtagaaaactggtgtcatcagctgtttctcccagcatcatacctcaagaggatccttcccagcagttcctgcagcagagccttgaaagagtgtatagtcttcagcacttggaccctcagggagcccaggagctgctggaattcaccatcagagtcgaggtttcaccatggtggccaggctggtctcaaactcctgagctcaagtga

SEQ ID NO: 1033 - DNA, 3156 bp, Homo sapiens
tagtgtacggaagctgagagggcccgcgggtaggcatggcggcgcaccttaagaagcgggtttatgaggaattcacgaaagtggttcagccacaggaggaaattgctactaagaaactccgactaacaaaaccaagtaaatctgcagcactccacatagatctgtgtaaagctacctccccagcagatgctttgcaatacttgctccagtttgccaggaagcctgtcgaggcggaaagcgtagagggagtagtcaggattctcttggaacattattacaaggagaatgatccatctgtgagactgaaaattgcatcattgttgggtttattatcaaagacagcaggattttcaccagactgcattatggatgatgccatcaacatcctgcagaatgaaaagtctcatcaagtcctagctcaactgctggatactttgcttgcaattggcactaagctaccagagaatcaagctatccaaatgcgattagttgatgtggcctgcaagcatctgacagatacgtctcatggtgtaagaaataagtgcctgcagttacttggcaatcttggctctttggagaaaagtgtcacaaaagatgcagaaggcctagctgccagagatgtccagaagattataggggattacttcagtgaccaagacccacgtgtcagaacagcagctataaaagccatgttgcagctccatgaaagaggactgaaattacaccaaacaatttataatcaggcctgtaaattactctctgatgactatgaacaagtgcgcagtgctgcagtccagcttatctgggtcgtcagtcagctctatcctgaaagcattgtcccaattccttcttctaatgaagaaatacgcttagttgatgatgcgtttggcaaaatttgtcacatggtcagtgatggctcttgggtggttcgtgttcaggcagcaaaactgttgggctctatggagcaagtcagttctcatttcttggagcagacccttgacaagaagctgatgtcagatctgaggaggaaacgtactgcacatgagcgtgccaaggaactttacagttcgggggagttttccagtggcagaaagtggggagatgatgctcccaaggaagaagtagataccggggctgtgaacttgattgagtcaggagcttgtggagcttttgttcatgggttggaagatgagatgtatgaggttcgtattgctgctgtggaggccctctgcatgttggcccagtcttcaccctcttttgctgagaagtgccttgatttcctagttgacatgttcaacgatgaaattgaggaagtacgtctgcagtctatacataccatgagaaaaatctctaacaacatcaccctccgagaagatcagcttgacactgtcctggctgtgctagaggattcatccagagatattcgagaggctcttcatgaactcttatgctgtactaatgtttcaaccaaagaagggattcatcttgcattggtggagctgctgaaaaatttaaccaagtaccctactgatagggactccatatggaagtgcttgaagtttctgggaagtcggcatccaaccctggtgcttcccttggtgccagagcttctgagcacccacccattttttgacacagctgaaccagacatggatgatccagcttatattgcagttttggtacttattttcaatgctgctaaaacctgtccaacaatgccagcattgttctcagatcacaccttcaggcactatgcctacctccgagacagtctttctcatcttgttcctgccttgaggttaccaggtagaaaactggtgtcatcagctgtttctcccagcatcatacctcaagaggatccttcccagcagttcctgcagcagagccttgaaagagtgtatagtcttcagcacttggaccctcagggagcccaggagctgctggaattcaccatcagggatctgcaaagacttggagaacttcaatctgaattggcaggagtagctgatttctctgccacctatcttcgctgtcaactacttctcatcaaggccttgcaggaaaagttgtggaatgtagctgcccctttgtatttgaagcagagtgatttggcctcagcagcagcgaaacagattatggaagagacctacaaaatggaattcatgtacagtggtgtggagaataagcaggtggtgattatacatcacatgaggctgcaggccaaagctttgcaacttatagtaacagcacgaactacacgaggacttgaccccttatttgggatgtgtgaaaaatttttacaggaagtagacttttttcagaggtatttcatcgctgatttgccccacttgcaggacagctttgtggacaaactccttgaccttatgccccgactcatgacatccaaacctgcagaagtggtcaaaattctacagaccatgctgcgacagagtgcctttctgcatctcccgcttccagagcagatccacaaagcctcagccaccatcatcgagccagcgggcgagtcagacaaccctttgcggtttacctctgggttggtggttgccctggatgttgatgcaaccctggagcatgtgcaggatcctcagaacactgttaaggtccaggtcttatatccagatggccaggctcagatgattcaccccaagcctgcagacttccggaatcctggcccagggcggcaccggctcatcactcaggtttatctctcccacaccgcttggacagaggcatgccaggtggaagtgaggctgctgctggcctacaactccagtgctcgcattccaaaatgcccctggatggagggtggtgagatgtcaccacaggtggaaaccagcatcgagggcaccattcccttcagcaagcctgtaaaagtttatataatgcccaaacctgcacggcgctaaggcaaaaacagtcttcccaaccgtggcctagagggcccttcttaggtgtcagaatgagccaagcctgaagcacttcacctggaattgatgtgtaggcttaaggagtatgtgacccttacagtctcatctggtatcaaacacaggataaattgtttcttcattaaaaaataaaaaaccttcaagtctacttacccttctcctgtccacaataaagttgagaaaacaccaa

SEQ ID NO: 1034 - DNA, 1382 bp, Homo sapiens
aggcatctccttcttgatgtcaaagtccccaggaggcatcgttaactatcgtaacgttacctgccgagcatgagatgggaggaagtgtcatagtccagtggacggttttttccaggctactgtgaaacctgatgtgttatgccggccctgaaacagacagcttcccaagtgactcagaccttaagggatctgcaaagacttggagaacttcaatctgaattggcaggagtagctgatttctctgccacctatcttcgctgtcaactacttctcatcaaggccttgcaggaaaagttgtggaatgtagctgcccctttgtatttgaagcagagtgatttggcctcagcagcagcgaaacagattatggaagagacctacaaaatggaattcatgtacagtggtgtggagaataagcaggtggtgattatacatcacatgaggctgcaggccaaagctttgcaacttatagtaacagcacgaactacacgaggacttgaccccttatttgggatgtgtgaaaaatttttacaggaagtagacttttttcagaggtatttcatcgctgatttgccccacttgcaggacagctttgtggacaaactccttgaccttatgccccgactcatgacatccaaacctgcagaagtggtcaaaattctacagaccatgctgcgacagagtgcctttctgcatctcccgcttccagagcagatccacaaagcctcagccaccatcatcgagccagcgggcgagtcagacaaccctttgcggtttacctctgggttggtggttgccctggatgttgatgcaaccctggagcatgtgcaggatcctcagaacactgttaaggtccaggtcttatatccagatggccaggctcagatgattcaccccaagcctgcagacttccggaatcctggcccagggcggcaccggctcatcactcaggtttatctctcccacaccgcttggacagaggcatgccaggtggaagtgaggctgctgctggcctacaactccagtgctcgcattccaaaatgcccctggatggagggtggtgagatgtcaccacaggtggaaaccagcatcgagggcaccattcccttcagcaagcctgtaaaagtttatataatgcccaaacctgcacggcgctaaggcaaaaacagtcttcccaaccgtggcctagagggcccttcttaggtgtcagaatgagccaagcctgaagcacttcacctggaattgatgtgtaggcttaaggagtatgtgacccttacagtctcatctggtatcaaacacaggataaattgtttcttcattaaaaaataaaaaaccttcaagtctacttacccttctcctgtccacaataaagttgagaaaacacc

SEQ ID NO: 1035 - DNA, 3380 bp, Homo sapiens
aagaaggcggcgggggaagatggcggtcctggggtagagtttgcaagctttctgactaggctagtcgagtaactattcgggtcatggcgtcaaactcaactaagtctttcctggcagatgccggctatggcgaacaggaactggatgccaactctgcccttatggaattggacaaaggcctaagatctggcaaacttggtgaacagtgtgaagcagttgttcgctttcccagactttttcagaagtatccattccctattcttatcaattctgcattcctaaagttagctgatgttttcagagttggaaataatttcctgaggctatgtgttcttaaagttacccaacaaagtgagaaacatttggagaagattctaaatgtggatgaatttgtgaagagaattttttctgtgattcatagtaatgatcctgtggcaagagccatcaccctccggatgttgggaagtctggcatcaataattcctgagaggaagaatgctcatcatagtattcgtcagagtttagattcacatgataatgtagaagttgaagctgctgtttttgctgctgcaaacttctctgcacagtcaaaggattttgctgtaggaatctgtaacaaaatcagtgaaatgattcaaggtttagcgacaccagtagacttgaagctaaaattgatacccattctacagcacatgcaccatgatgcaatcttggcttccagtgctcgtcagcttttacaacagctggtcacatcctatccgtccaccaaaatggtgattgtgtctttgcacactttcactctgcttgcagcgtcatctttggttgatacacctaagcagattcagcttctgttgcagtatttgaagaatgatcccaggaaggcagtaaagagacttgctattcaagatctgaaattacttgctaataaaacaccacatacttggagtagggagaatattcaggcactttgtgagtgtgccctccagactccttatgacagcttaaaactagggatgttgtctgtcctttccacactatcagggaccatcgccatcaaacattacttcagtatagttccaggaaatgtgagttcttctcccagatcttctgatttagtcaaattagcccaagagtgctgttaccataataacaggggcattgcagctcatggagttagagtcctaactaatataactgtttcttgtcaagaaaaggatcttttggcactggaacaagatgctgtctttggcctggaatccctactggtactttgtagtcaagatgatagtccaggtgctcaggccactttaaagattgctctaaactgtatggtgaagttggccaagggcaggccccatcttagccagtcagtagttgagaccttgttgactcaattgcacagtgctcaagacgctgcccggattttgatgtgccattgcctggcagccattgccatgcaactgccggtgctgggtgatgggatgcttggtgacctcatggagctgtacaaggtgattggacgatcagccacagacaagcaacaagaacttctggtgagtttggctactgtgatttttgttgcaagtcagaaggcattgtctgtggaaagtaaggcagtaattaagcagcagcttgaaagtgtctccaatggatggactgtataccgtattgccagacaggcttccagaatgggtaatcatgacatggccaaagagctttatcagagtttgctgactcaggttgcctcagaacatttctacttctggctaaatagtttgaaggagttttcacatgcagaacagtgtctcactgggttgcaagaggaaaattatagttcagcactttcttgcattgctgaatctttaaaattctatcacaaagggattgcttccttaacagcagctagtacaccactgaatcctttaagctttcagtgtgaatttgtaaaactcaggattgaccttttacaagccttctctcaacttatctgtacttgtaatagcctgaagacaagcccaccacctgcaattgccacaacaattgccatgaccttaggaaatgacctccagaggtgtggtcgcatctccaatcagatgaaacagtccatggaagaatttcgaagccttgcttctcgatatggagatctttaccaggcatcttttgatgctgactcagcaactttgaggaatgttgaactacagcagcagagctgtttactgatatctcatgcaatagaagccctgattttggatccagaatcagcaagtttccaggaatatggatctactggaacagcccatgctgatagtgaatatgaaagaagaatgatgtctgtatataatcatgtcttggaggaggtagaatcactcaatcggaaatatacccctgtttcttatatgagatattttttccagaaactacagtctaccagcatcaagcttgctctgtcaccatcgccccggaatcctgcagagcccattgctgtccagaataaccagcagctggcgctaaaggtagagggagtggttcagcacggatctaaaccaggactcttccgcaaaattcagtctgtctgtctgaatgtttcttccacactgcagagtaaatctggacaagactacaagatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttcatttattcattgatttttgtaatgtaatattctggaaaaaattttgttttcttaaaaattttgtctgacagctgggcgtggttgctcacgcctgtaatcccagcactttgggaggctgaggtgggcggctcacgaggagatcaagaccatcctggctaacacagtgaaaccccgtctccactaaaaaatacaaaaaaattagccaagcatggtggcaggcgcctgtagtcccagctacttgggaggctgaggcaggagaatggtgtgaacctgggaggcggagcttgcagtgagccgagactgtgctccagcctgggcgacagagcgagactccgtctcaaaaaaataaataaatacattttgtctg

SEQ ID NO: 1036 - DNA, 3422 bp, Homo sapiens
cggaagaaaaaccagcaagaaggcggcgggggaagatggcggtcctggggtagagtttgcaagctttctgactaggctagtcgagtaactattcgggtcatggcgtcaaactcaactaagtctttcctggcagatgccggctatggcgaacaggaactggatgccaactctgcccttatggaattggacaaaggcctaagatctggcaaacttggtgaacagtgtgaagcagttgttcgctttcccagactttttcagaagtatccattccctattcttatcaattctgcattcctaaagttagctgatgttttcagagttggaaataatttcctgaggctatgtgttcttaaagttacccaacaaagtgagaaacatttggagaagattctaaatgtggatgaatttgtgaagagaattttttctgtgattcatagtaatgatcctgtggcaagagccatcaccctccggatgttgggaagtctggcatcaataattcctgagaggaagaatgctcatcatagtattcgtcagagtttagattcacatgataatgtagaagttgaagctgctgtttttgctgctgcaaacttctctgcacagtcaaaggattttgctgtaggaatctgtaacaaaatcagtgaaatgattcaaggtttagcgacaccagtagacttgaagctaaaattgatacccattctacagcacatgcaccatgatgcaatcttggcttccagtgctcgtcagcttttacaacagctggtcacatcctatccgtccaccaaaatggtgattgtgtctttgcacactttcactctgcttgcagcgtcatctttggttgatacacctaagcagattcagcttctgttgcagtatttgaagaatgatcccaggaaggcagtaaagagacttgctattcaagatctgaaattacttgctaataaaacaccacatacttggagtagggagaatattcaggcactttgtgagtgtgccctccagactccttatgacagcttaaaactagggatgttgtctgtcctttccacactatcagggaccatcgccatcaaacattacttcagtatagttccaggaaatgtgagttcttctcccagatcttctgatttagtcaaattagcccaagagtgctgttaccataataacaggggcattgcagctcatggagttagagtcctaactaatataactgtttcttgtcaagaaaaggatcttttggcactggaacaagatgctgtctttggcctggaatccctactggtactttgtagtcaagatgatagtccaggtgctcaggccactttaaagattgctctaaactgtatggtgaagttggccaagggcaggccccatcttagccagtcagtagttgagaccttgttgactcaattgcacagtgctcaagacgctgcccggattttgatgtgccattgcctggcagccattgccatgcaactgccggtgctgggtgatgggatgcttggtgacctcatggagctgtacaaggtgattggacgatcagccacagacaagcaacaagaacttctggtgagtttggctactgtgatttttgttgcaagtcagaaggcattgtctgtggaaagtaaggcagtaattaagcagcagcttgaaagtgtctccaatggatggactgtataccgtattgccagacaggcttccagaatgggtaatcatgacatggccaaagagctttatcagagtttgctgactcaggttgcctcagaacatttctacttctggctaaatagtttgaaggagttttcacatgcagaacagtgtctcactgggttgcaagaggaaaattatagttcagcactttcttgcattgctgaatctttaaaattctatcacaaagggattgcttccttaacagcagctagtacaccactgaatcctttaagctttcagtgtgaatttgtaaaactcaggattgaccttttacaagccttctctcaacttatctgtacttgtaatagcctgaagacaagcccaccacctgcaattgccacaacaattgccatgaccttaggaaatgacctccagaggtgtggtcgcatctccaatcagatgaaacagtccatggaagaatttcgaagccttgcttctcgatatggagatctttaccaggcatcttttgatgctgactcagcaactttgaggaatgttgaactacagcagcagagctgtttactgatatctcatgcaatagaagccctgattttggatccagaatcagcaagtttccaggaatatggatctactggaacagcccatgctgatagtgaatatgaaagaagaatgatgtctgtatataatcatgtcttggaggagcacacagcatgcctctgcaatgccatcattgctttgctgaaagttcccctttctttccagagatattttttccagaaactacagtctaccagcatcaagcttgctctgtcaccatcgccccggaatcctgcagagcccattgctgtccagaataaccagcagctggcgctaaaggtagagggagtggttcagcacggatctaaaccaggactcttccgcaaaattcagtctgtctgtctgaatgtttcttccacactgcagagtaaatctggacaagactacaagatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttcatttattcattgatttttgtaatgtaatattctggaaaaaattttgttttcttaaaaattttgtctgacagctgggcgtggttgctcacgcctgtaatcccagcactttgggaggctgaggtgggcggctcacgaggagatcaagaccatcctggctaacacagtgaaaccccgtctccactaaaaaatacaaaaaaattagccaagcatggtggcaggcgcctgtagtcccagctacttgggaggctgaggcaggagaatggtgtgaacctgggaggcggagcttgcagtgagccgagactgtgctccagcctgggcgacagagcgagactccgtctcaaaaaaataaataaatacattttgtctgaaaaataa

SEQ ID NO: 1037 - DNA, 4417 bp, Homo sapiens
agcgcgcggaagaaaaaccagcaagaaggcggcgggggaagatggcggtcctggggtagagtttgcaagctttctgactaggctagtcgagtaactattcgggtcatggcgtcaaactcaactaagtctttcctggcagatgccggctatggcgaacaggaactggatgccaactctgcccttatggaattggacaaaggcctaagatctggcaaacttggtgaacagtgtgaagcagttgttcgctttcccagactttttcagaagtatccattccctattcttatcaattctgcattcctaaagttagctgatgttttcagagttggaaataatttcctgaggctatgtgttcttaaagttacccaacaaagtgagaaacatttggagaagattctaaatgtggatgaatttgtgaagagaattttttctgtgattcatagtaatgatcctgtggcaagagccatcaccctccggatgttgggaagtctggcatcaataattcctgagaggaagaatgctcatcatagtattcgtcagagtttagattcacatgataatgtagaagttgaagctgctgtttttgctgctgcaaacttctctgcacagtcaaaggattttgctgtaggaatctgtaacaaaatcagtgaaatgattcaaggtttagcgacaccagtagacttgaagctaaaattgatacccattctacagcacatgcaccatgatgcaatcttggcttccagtgctcgtcagcttttacaacagctggtcacatcctatccgtccaccaaaatggtgattgtgtctttgcacactttcactctgcttgcagcgtcatctttggttgatacacctaagcagattcagcttctgttgcagtatttgaagaatgatcccaggaaggcagtaaagagacttgctattcaagatctgaaattacttgctaataaaacaccacatacttggagtagggagaatattcaggcactttgtgagtgtgccctccagactccttatgacagcttaaaactagggatgttgtctgtcctttccacactatcagggaccatcgccatcaaacattacttcagtatagttccaggaaatgtgagttcttctcccagatcttctgatttagtcaaattagcccaagagtgctgttaccataataacaggggcattgcagctcatggagttagagtcctaactaatataactgtttcttgtcaagaaaaggatcttttggcactggaacaagatgctgtctttggcctggaatccctactggtactttgtagtcaagatgatagtccaggtgctcaggccactttaaagattgctctaaactgtatggtgaagttggccaagggcaggccccatcttagccagtcagtagttgagaccttgttgactcaattgcacagtgctcaagacgctgcccggattttgatgtgccattgcctggcagccattgccatgcaactgccggtgctgggtgatgggatgcttggtgacctcatggagctgtacaaggtgattggacgatcagccacagacaagcaacaagaacttctggtgagtttggctactgtgatttttgttgcaagtcagaaggcattgtctgtggaaagtaaggcagtaattaagcagcagcttgaaagtgtctccaatggatggactgtataccgtattgccagacaggcttccagaatgggtaatcatgacatggccaaagagctttatcagagtttgctgactcaggttgcctcagaacatttctacttctggctaaatagtttgaaggagttttcacatgcagaacagtgtctcactgggttgcaagaggaaaattatagttcagcactttcttgcattgctgaatctttaaaattctatcacaaagggattgcttccttaacagcagctagtacaccactgaatcctttaagctttcagtgtgaatttgtaaaactcaggattgaccttttacaagccttctctcaacttatctgtacttgtaatagcctgaagacaagcccaccacctgcaattgccacaacaattgccatgaccttaggaaatgacctccagaggtgtggtcgcatctccaatcagatgaaacagtccatggaagaatttcgaagccttgcttctcgatatggagatctttaccaggcatcttttgatgctgactcagcaactttgaggaatgttgaactacagcagcagagctgtttactgatatctcatgcaatagaagccctgattttggatccagaatcagcaagtttccaggaatatggatctactggaacagcccatgctgatagtgaatatgaaagaagaatgatgtctgtatataatcatgtcttggaggaggtagaatcactcaatcggaaatatacccctgtttcttatatgcacacagcatgcctctgcaatgccatcattgctttgctgaaagttcccctttctttccagagatattttttccagaaactacagtctaccagcatcaagcttgctctgtcaccatcgccccggaatcctgcagagcccattgctgtccagaataaccagcagctggcgctaaaggtagagggagtggttcagcacggatctaaaccaggactcttccgcaaaattcagtctgtctgtctgaatgtttcttccacactgcagagtaaatctggacaagactacaagatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttcatttattcattgatttttgtaatgtaatattctggaaaaaattttgttttcttaaaaattttgtctgacagctgggcgtggttgctcacgcctgtaatcccagcactttgggaggctgaggtgggcggctcacgaggagatcaagaccatcctggctaacacagtgaaaccccgtctccactaaaaaatacaaaaaaattagccaagcatggtggcaggcgcctgtagtcccagctacttgggaggctgaggcaggagaatggtgtgaacctgggaggcggagcttgcagtgagccgagactgtgctccagcctgggcgacagagcgagactccgtctcaaaaaaataaataaatacattttgtctgaaaaataactgggatcctggccagaaagattgttctttcttgttttattattagttttttctgttgccaagcttttttttctttcaagaatagtcacatgttgagatcactgaattggtaaatttgaccgctactcttccaaaatacatcatttgctgcctgacttagacctaggattctgagttgttcattgggaggttctgaccagtcactacaaggtttatccatggtagcagaacctgagtccttctgtagatggacttgaaagtgttccgtgcaacatccagccttctggattatgaaagcccacagtctaacagtattgaaacatcctgctgtattagttcaaccacatatttatctcttcctgtgctaaagcagtctttattattttcatatttaattgaaacaaagagcagctagcaatttcatagaaaattaatttgttttttctgatgtgtctgcaactgtgtataatacagacatttcacattgtttccaaaagtgaagaacactcatttaatatcttcaatgttttaagttagaaggggtggatcttttcctttggttggtgattggtttggtttatacttgatgagttatgctagactgattgtttagagagagcagtctctttattacacaggctcagtttgttgggatgctcagggaacagagttttctggttagccagaaaacccccttttttcctattttaattctggttgaaaaccatgataaaatagactttcttagcacagtatggtagatataacttaactgctttttgattggggatcatttagggcttcaggatcacgatttctaaacatcagggatcatatggttgcagatgccgatgctataagtaatttggccggatgcagctcctaaggtaaagcagggtactttccctggaatttcctttttaaataaatatctgtttctttgcttg

SEQ ID NO: 1038 - DNA, 3127 bp, Homo sapiens
gcgcggaagaaaaaccagcaagaaggcggcgggggaagatggcggtcctggggtagagtttgcaagctttctgactaggctagtcgagtaactattcgggtcatggcgtcaaactcaactaagtctttcctggcagatgccggctatggcgaacaggaactggatgccaactctgcccttatggaattggacaaaggcctaagatctggcaaacttggtgaacagtgtgaagcagttgttcgctttcccagactttttcagaagtatccattccctattcttatcaattctgcattcctaaagttagctgatgttttcagagttgggatgttgggaagtctggcatcaataattcctgagaggaagaatgctcatcatagtattcgtcagagtttagattcacatgataatgtagaagttgaagctgctgtttttgctgctgcaaacttctctgcacagtcaaaggattttgctgtaggaatctgtaacaaaatcagtgaaatgattcaaggtttagcgacaccagtagacttgaagctaaaattgatacccattctacagcacatgcaccatgatgcaatcttggcttccagtgctcgtcagcttttacaacagctggtcacatcctatccgtccaccaaaatggtgattgtgtctttgcacactttcactctgcttgcagcgtcatctttggttgatacacctaagcagattcagcttctgttgcagtatttgaagaatgatcccaggaaggcagtaaagagacttgctattcaagatctgaaattacttgctaataaaacaccacatacttggagtagggagaatattcaggcactttgtgagtgtgccctccagactccttatgacagcttaaaactagggatgttgtctgtcctttccacactatcagggaccatcgccatcaaacattacttcagtatagttccaggaaatgtgagttcttctcccagatcttctgatttagtcaaattagcccaagagtgctgttaccataataacaggggcattgcagctcatggagttagagtcctaactaatataactgtttcttgtcaagaaaaggatcttttggcactggaacaagatgctgtctttggcctggaatccctactggtactttgtagtcaagatgatagtccaggtgctcaggccactttaaagattgctctaaactgtatggtgaagttggccaagggcaggccccatcttagccagtcagtagttgagaccttgttgactcaattgcacagtgctcaagacgctgcccggattttgatgtgccattgcctggcagccattgccatgcaactgccggtgctgggtgatgggatgcttggtgacctcatggagctgtacaaggtgattggacgatcagccacagacaagcaacaagaacttctggtgagtttggctactgtgatttttgttgcaagtcagaaggcattgtctgtggaaagtaaggcagtaattaagcagcagcttgaaagtgtctccaatggatggactgtataccgtattgccagacaggcttccagaatgggtaatcatgacatggccaaagagctttatcagagtttgctgactcaggttgcctcagaacatttctacttctggctaaatagtttgaaggagttttcacatgcagaacagtgtctcactgggttgcaagaggaaaattatagttcagcactttcttgcattgctgaatctttaaaattctatcacaaagggattgcttccttaacagcagctagtacaccactgaatcctttaagctttcagtgtgaatttgtaaaactcaggattgaccttttacaagccttctctcaacttatctgtacttgtaatagcctgaagacaagcccaccacctgcaattgccacaacaattgccatgaccttaggaaatgacctccagaggtgtggtcgcatctccaatcagatgaaacagtccatggaagaatttcgaagccttgcttctcgatatggagatctttaccaggcatcttttgatgctgactcagcaactttgaggaatgttgaactacagcagcagagctgtttactgatatctcatgcaatagaagccctgattttggatccagaatcagcaagtttccaggaatatggatctactggaacagcccatgctgatagtgaatatgaaagaagaatgatgtctgtatataatcatgtcttggaggaggtagaatcactcaatcggaaatatacccctgtttcttatatgcacacagcatgcctctgcaatgccatcattgctttgctgaaagttcccctttctttccagagatattttttccagaaactacagtctaccagcatcaagcttgctctgtcaccatcgccccggaatcctgcagagcccattgctgtccagaataaccagcagctggcgctaaaggtagagggagtggttcagcacggatctaaaccaggactcttccgcaaaattcagtctgtctgtctgaatgtttcttccacactgcagagtaaatctggacaagactacaagatacccattgacaacatgaccaatgagatggagcaaagggttgaacctcataatgattacttcagtactcaatttctgttgaactttgctatccttggaacacacaacattacagtggaatcttctgtgaaagatgccaatggtatagtatggaagactggtcccagaactaccatatttgtaaaatccctggaagacccttattcccagcaaattcgcttacaacagcagcaagcccagcagccattacagcagcagcagcaacgcaatgcctacacacggttttaaccatggaatgaatgcactgcagactctcaagagatcaatcaaattgccagaaacagtttggtttttcatatggaataagtattaaagttacagtgtagttcatttattcattgatttttgtaatgtaatattctggaaaaaattttgttttcttaaaaattttgtctgacagctgggcgtggttgctcacgcctgtaatcccagcactttgggaggctgaggtgggcggctcacgaggagatcaagaccatcctggctaacacagtgaaaccccgtctccact

SEQ ID NO: 1039 - DNA, 3321 bp, Homo sapiens
gtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagtagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacacaattagtggtgttttcttttcagacaaaatactgaaacaaatattagtttaaaaacaaactatacagaagacttcataccgtaacaataaatgtatagtttcttcaaagggagaagagattcacatatctgataacaaaataaactagcaatctagttttctaatct

SEQ ID NO: 1040 - DNA, 4633 bp, Homo sapiens
tgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagtagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacacaattagtggtgttttcttttcagacaaaatactgaaacaaatattagtttaaaaacaaactatacagaagacttcataccgtaacaataaatgtatagtttcttcaaagggagaagagattcacatatctgataacaaaataaactagcaatctagttttctaatctactttatgaggctggattttttttttagaaaagctaatttaaaatatttagaaatagctagcctatgtacagcaagttttcatgtctttttttaataaatagatttctaggagtcagtatatatttaatactcttcttccttaagaaaatagaagtttaggtcaagtgttaagctttatcactttgacactgtccttatctcacaatggaggaatttagaaaggaccttaacagtttcacaaacataaataaagccttagtcacactaaattaaaaaaaaaaattccttagggatatcttagagtagtaaagtgacttcctcatataaatagtttgaaagggtacttaagtttttcacccaaattgtgatatacaaaaaggttattaccaagcaacctacatgtcaagaaagccccagttaggaaggagccacagcatttatcttgtttataatttctttggtactcccactgtttagagcacaggttgaacaccatgttcatctaagccttattagttaaaaaatgtgttatggcaaggcaaataaactagtttaaaaaacattaaatttcaccatttgtagaaattcaagttttataatagcttgctatagcagctatagataaattagtcaccttattacaaaactaaacctttgtaaacaagtttaaatttaattttcaagaaccaaattgcactagtcaagagtgtaggaattttgagaatctaacaactagattcaaagtactgtatcacttagtataccctttaaggtagcacttatccagtccaaaactccagtgacaaaattcctagtttatcaagataaacacagtaacactggattaaaggaaaaacattgctatggtatagactgtggttggcttctatccagtaaccttgggaatgaagacatctttgtaaacaagtcctgctgtttctttaacagctaacataggaaataattaaatgtattctttagtgccaattgtaagttttaaaatcagaatggcagtgtaacttgtgaattggctagggcaatcaatcacagcactactttctgtaaaactttagtagttcagtgataccagttctacccaatcttggtgaattccaacttgtttgcttagttatcttctttagtgttttcctggtggtttttcagtgctcttcggtggtgtcataatgcctccattgcacactggtgacaactgtcccccttttctgaaggtgtttatgtaatttacttcctcc

SEQ ID NO: 1041 - DNA, 2017 bp, Homo sapiens
agtgactgctattgaaccaccaaaagtccattatgaaactgtcccaggctgtccaatcttcctggctggtccctgaaggatggaaatgctttcttggacaagacggagctaatagatctgtctacagtagatgtgattctcatctctaactatcactgtatgatggcgctgccatacatcaccgagcacaccggcttcacaggcacagtgtatgccacggaacccaccgtccagatcggcaggcttctcatggaagagctggtgaatttcattgaaagagtgccaaaggctcagtctgcctccttgtggaagaataaggacattcagaggctgttaccttctcctctcaaggatgcagtggaagtctcaacctggagaagatgctatacaatgcaagaggtgaactctgcccttagtaaaatccagctggtgggatattctcagaaaattgagctttttggtgcggtccaggtgactcctctgagctctggctatgcccttgggagctccaactggatcatccagtctcattacgagaaagtgtcttatgtctctggatcctccttgcttaccacacacccccagcccatggaccaagcttctctcaaaaacagcgatgttcttgttctgacagggcttacccagatccccactgcaaacccagatggaatggtgggagagttctgcagcaacctagctctgacagtccggaatggaggaaacgtgttggttccctgctacccttctggagtgatctatgacctcctggagtgcctatatcagtacatcgactcagccgggctttccagcgtccccctctacttcatctcccctgtggccaacagttcactggagttttcccagatctttgctgagtggctttgtcacaacaaacagagtaaggtgtatcttccagaaccaccttttcctcatgcagagctcattcagaccaataagctgaagcactaccccagcatccacggagacttcagcaacgactttagacagccctgtgtggtgttcaccgggcacccttccctccgcttcggggacgtggtccacttcatggagctctggggaaaatctagtctcaataccgtcatattcacggaaccagacttctcctacctggaagccctggctccttaccagccgctggccatgaaatgcatctactgccccatcgacacccggctgaacttcatccaggtgtcaaagctgcttaaagaagtgcagcccctgcacgtggtgtgtcctgagcagtacactcagccgcccccagcccagtcccacaggatggacctcatgatcgactgccagccccccgccatgtcctatcggcgggctgaggttctcgccctgcccttcaaacgtcggtacgagaagatcgagatcatgccagagctcgcagattcactggtgcccatggagatcaagcctggcatctccttggcaactgtctcggccgtgctgcacaccaaagataacaagcacttgcttcagccccctcctcggcccgcccagcccacgagcgggaagaagagaaagcgggtgagcgatgacgtaccagactgcaaagtcctgaagcctttgttgagcggttccatccctgtggagcagttcgtgcagaccctggagaagcatggcttcagtgatattaaggtggaggacacagccaagggccatatcgtcctgctccaggaggctgagacgctcatccagattgaagaagactcgacccatatcatctgcgacaatgacgagatgctcagagtgcgactgcgggaccttgtcctcaaattcttacagaagttctgagtgggccatctgagctacttccctgaaatcctgcagtccctcactggctgccctcacaagccacctgaggagtggcatgagaggccattaactgtgtctttgtggtgtcctctggcttaaggagtgaagaggtggctcttgagggaaatggtctggacttattcccagcactgtttcaggcaagaactttccctttcaa

SEQ ID NO: 1042 - DNA, 2544 bp, Homo sapiens
gcaggtggcggagattgcaccggaagacgcttcctgggtttgaggagttcagtgactgctattgaaccaccaaaagtccattatgaaactgtattgcctgtcagggcacccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaaggagctaaaggagtgctcgggtcatgtatttgtggattctgtgccggaattctgtttaccagagacggagctaatagatctgtctacagtagatgtgattctcatctctaactatcactgtatgatggcgctgccatacatcaccgagcacaccggcttcacaggcacagtgtatgccacggaacccaccgtccagatcggcaggcttctcatggaagagctggtgaatttcattgaaagagtgccaaaggctcagtctgcctccttgtggaagaataaggacattcagaggctgttaccttctcctctcaaggatgcagtggaagtctcaacctggagaagatgctatacaatgcaagaggtgaactctgcccttagtaaaatccagctggtgggatattctcagaaaattgagctttttggtgcggtccaggtgactcctctgagctctggctatgcccttgggagctccaactggatcatccagtctcattacgagaaagtgtcttatgtctctggatcctccttgcttaccacacacccccagcccatggaccaagcttctctcaaaaacagcgatgttcttgttctgacagggcttacccagatccccactgcaaacccagatggaatggtgggagagttctgcagcaacctagctctgacagtccggaatggaggaaacgtgttggttccctgctacccttctggagtgatctatgacctcctggagtgcctatatcagtacatcgactcagccgggctttccagcgtccccctctacttcatctcccctgtggccaacagttcactggagttttcccagatctttgctgagtggctttgtcacaacaaacagagtaaggtgtatcttccagaaccaccttttcctcatgcagagctcattcagaccaataagctgaagcactaccccagcatccacggagacttcagcaacgactttagacagccctgtgtggtgttcaccgggcacccttccctccgcttcggggacgtggtccacttcatggagctctggggaaaatctagtctcaataccgtcatattcacggaaccagacttctcctacctggaagccctggctccttaccagccgctggccatgaaatgcatctactgccccatcgacacccggctgaacttcatccaggtgtcaaagctgcttaaagaagtgcagcccctgcacgtggtgtgtcctgagcagtacactcagccgcccccagcccagtcccacaggatggacctcatgatcgactgccagccccccgccatgtcctatcggcgggctgaggttctcgccctgcccttcaaacgtcggtacgagaagatcgagatcatgccagagctcgcagattcactggtgcccatggagatcaagcctggcatctccttggcaactgtctcggccgtgctgcacaccaaagataacaagcacttgcttcagccccctcctcggcccgcccagcccacgagcgggaagaagagaaagcgggtgagcgatgacgtaccagactgcaaagtcctgaagcctttgttgagcggttccatccctgtggagcagttcgtgcagaccctggagaagcatggcttcagtgatattaaggtggaggacacagccaagggccatatcgtcctgctccaggaggctgagacgctcatccagattgaagaagactcgacccatatcatctgcgacaatgacgagatgctcagagtgcgactgcgggaccttgtcctcaaattcttacagaagttctgagtgggccatctgagctacttccctgaaatcctgcagtccctcactggctgccctcacaagccacctgaggagtggcatgagaggccattaactgtgtctttgtggtgtcctctggcttaaggagtgaagaggtggctcttgagggaaatggtctggacttattcccagcactgtttcaggcaagaactttccctttcaacttcaggctcattttcttctcaactctggctctctcaaggagctggagggtggcagaagtgggacaggagaagttttccaagaggttcatgggaggcggaggtgactggctggctgtcttgcatcagtcccaggcctcggccaggggagccagcctttggtttcgtttacttgcctacagtgctgtacgcaataagatgatgatcccaaaatatggtaaagtgaacccatctgtctgcattttctactctgagcccatttgttaataaacacttatttttatataa

SEQ ID NO: 1043 - DNA, 1992 bp, Homo sapiens
aagatctattgcctgtcagggcacccaaccttaccatgcaatgtgctcaaattcaaatcaacctggagaagatgctatacaatgcaagaggtgaactctgcccttagtaaaatccagctggtgggatattctcagaaaattgagctttttggtgcggtccaggtgactcctctgagctctggctatgcccttgggagctccaactggatcatccagtctcattacgagaaagtgtcttatgtctctggatcctccttgcttaccacacacccccagcccatggaccaagcttctctcaaaaacagcgatgttcttgttctgacagggcttacccagatccccactgcaaacccagatggaatggtgggagagttctgcagcaacctagctctgacagtccggaatggaggaaacgtgttggttccctgctacccttctggagtgatctatgacctcctggagtgcctatatcagtacatcgactcagccgggctttccagcgtccccctctacttcatctcccctgtggccaacagttcactggagttttcccagatctttgctgagtggctttgtcacaacaaacagagtaaggtgtatcttccagaaccaccttttcctcatgcagagctcattcagaccaataagctgaagcactaccccagcatccacggagacttcagcaacgactttagacagccctgtgtggtgttcaccgggcacccttccctccgcttcggggacgtggtccacttcatggagctctggggaaaatctagtctcaataccgtcatattcacggaaccagacttctcctacctggaagccctggctccttaccagccgctggccatgaaatgcatctactgccccatcgacacccggctgaacttcatccaggtgtcaaagctgcttaaagaagtgcagcccctgcacgtggtgtgtcctgagcagtacactcagccgcccccagcccagtcccacaggatggacctcatgatcgactgccagccccccgccatgtcctatcggcgggctgaggttctcgccctgcccttcaaacgtcggtacgagaagatcgagatcatgccagagctcgcagattcactggtgcccatggagatcaagcctggcatctccttggcaactgtctcggccgtgctgcacaccaaagataacaagcacttgcttcagccccctcctcggcccgcccagcccacgagcgggaagaagagaaagcgggtgagcgatgacgtaccagactgcaaagtcctgaagcctttgttgagcggttccatccctgtggagcagttcgtgcagaccctggagaagcatggcttcagtgatattaaggtggaggacacagccaagggccatatcgtcctgctccaggaggctgagacgctcatccagattgaagaagactcgacccatatcatctgcgacaatgacgagatgctcagagtgcgactgcgggaccttgtcctcaaattcttacagaagttctgagtgggccatctgagctacttccctgaaatcctgcagtccctcactggctgccctcacaagccacctgaggagtggcatgagaggccattaactgtgtctttgtggtgtcctctggcttaaggagtgaagaggtggctcttgagggaaatggtctggacttattcccagcactgtttcaggcaagaactttccctttcaacttcaggctcattttcttctcaactctggctctctcaaggagctggagggtggcagaagtgggacaggagaagttttccaagaggttcatgggaggcggaggtgactggctggctgtcttgcatcagtcccaggcctcggccaggggagccagcctttggtttcgtttacttgcctacagtgctgtacgcaataagatgatgatcccaaaatatggtaaagtgaacccatctgtctgcattttctactctgagcccatttgttaataaacacttatttttatat

SEQ ID NO: 1044 - DNA, 2759 bp, Homo sapiens
gaaaggggagtcggagccgtcgggactacacatcccagaacaccatgggccccaggcccgtaaggaagacatgatatcatgctggggtggagagggaggatgcattggcggctgggatgaatttgagctgacggaaggaggcgttcggagaggaaagggaggaaaaggaaaggcgaccacagttcccatgatgcctggaggggagactacatttcccattattcccctggaagggacgtgaggatgaaagactgcaagtcccgcgatgctctcggctggcaggtggcggagattgcaccggaagacgcttcctgggtttgaggagttcagtgactgctattgaaccaccaaaagtccattatgaaactgtattgcctgtcagggcacccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaagacggagctaatagatctgtctacagtagatgtgattctcatctctaactatcactgtatgatggcgctgccatacatcaccgagcacaccggcttcacaggcacagtgtatgccacggaacccaccgtccagatcggcaggcttctcatggaagagctggtgaatttcattgaaagagtgccaaaggctcagtctgcctccttgtggaagaataaggacattcagaggctgttaccttctcctctcaaggatgcagtggaagtctcaacctggagaagatgctatacaatgcaagaggtgaactctgcccttagtaaaatccagctggtgggatattctcagaaaattgagctttttggtgcggtccaggtgactcctctgagctctggctatgcccttgggagctccaactggatcatccagtctcattacgagaaagtgtcttatgtctctggatcctccttgcttaccacacacccccagcccatggaccaagcttctctcaaaaacagcgatgttcttgttctgacagggcttacccagatccccactgcaaacccagatggaatggtgggagagttctgcagcaacctagctctgacagtccggaatggaggaaacgtgttggttccctgctacccttctggagtgatctatgacctcctggagtgcctatatcagtacatcgactcagccgggctttccagcgtccccctctacttcatctcccctgtggccaacagttcactggagttttcccagatctttgctgagtggctttgtcacaacaaacagagtaaggtgtatcttccagaaccaccttttcctcatgcagagctcattcagaccaataagctgaagcactaccccagcatccacggagacttcagcaacgactttagacagccctgtgtggtgttcaccgggcacccttccctccgcttcggggacgtggtccacttcatggagctctggggaaaatctagtctcaataccgtcatattcacggaaccagacttctcctacctggaagccctggctccttaccagccgctggccatgaaatgcatctactgccccatcgacacccggctgaacttcatccaggtgtcaaagctgcttaaagaagtgcagcccctgcacgtggtgtgtcctgagcagtacactcagccgcccccagcccagtcccacaggatggacctcatgatcgactgccagccccccgccatgtcctatcggcgggctgaggttctcgccctgcccttcaaacgtcggtacgagaagatcgagatcatgccagagctcgcagattcactggtgcccatggagatcaagcctggcatctccttggcaactgtctcggccgtgctgcacaccaaagataacaagcacttgcttcagccccctcctcggcccgcccagcccacgagcgggaagaagagaaagcgggtgagcgatgacgtaccagactgcaaagtcctgaagcctttgttgagcggttccatccctgtggagcagttcgtgcagaccctggagaagcatggcttcagtgatattaaggtggaggacacagccaagggccatatcgtcctgctccaggaggctgagacgctcatccagattgaagaagactcgacccatatcatctgcgacaatgacgagatgctcagagtgcgactgcgggaccttgtcctcaaattcttacagaagttctgagtgggccatctgagctacttccctgaaatcctgcagtccctcactggctgccctcacaagccacctgaggagtggcatgagaggccattaactgtgtctttgtggtgtcctctggcttaaggagtgaagaggtggctcttgagggaaatggtctggacttattcccagcactgtttcaggcaagaactttccctttcaacttcaggctcattttcttctcaactctggctctctcaaggagctggagggtggcagaagtgggacaggagaagttttccaagaggttcatgggaggcggaggtgactggctggctgtcttgcatcagtcccaggcctcggccaggggagccagcctttggtttcgtttacttgcctacagtgctgtacgcaataagatgatgatcccaaaatatggtaaagtgaacccatctgtctgcattttctactctgagcccatttgttaataaacacttatttttatataa

SEQ ID NO: 1045 - DNA, 2430 bp, Homo sapiens
cagtgactgctattgaaccaccaaaagtccattatgaaactggtgagtcttcgctcctaggtcagagggcaaagtattgcctgtcagggcacccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaaggagctaaaggagtgctcgggtcatgtatttgtggattctgtgccggaattctgtttaccagagacggagctaatagatctgtctacagtagatgtgattctcatctctaactatcactgtatgatggcgctgccatacatcaccgagcacaccggcttcacaggcacagtgtatgccacggaacccaccgtccagatcggcaggcttctcatggaagagctggtgaatttcattgaaagagtgccaaaggctcagtctgcctccttgtggaagaataaggacattcagaggctgttaccttctcctctcaaggatgcagtggaagtctcaacctggagaagatgctatacaatgcaagaggtgaactctgcccttagtaaaatccagctggtgggatattctcagaaaattgagctttttggtgcggtccaggtgactcctctgagctctggctatgcccttgggagctccaactggatcatccagtctcattacgagaaagtgtcttatgtctctggatcctccttgcttaccacacacccccagcccatggaccaagcttctctcaaaaacagcgatgttcttgttctgacagggcttacccagatccccactgcaaacccagatggaatggtgggagagttctgcagcaacctagctctgacagtccggaatggaggaaacgtgttggttccctgctacccttctggagtgatctatgacctcctggagtgcctatatcagtacatcgactcagccgggctttccagcgtccccctctacttcatctcccctgtggccaacagttcactggagttttcccagatctttgctgagtggctttgtcacaacaaacagagtaaggtgtatcttccagaaccaccttttcctcatgcagagctcattcagaccaataagctgaagcactaccccagcatccacggagacttcagcaacgactttagacagccctgtgtggtgttcaccgggcacccttccctccgcttcggggacgtggtccacttcatggagctctggggaaaatctagtctcaataccgtcatattcacggaaccagacttctcctacctggaagccctggctccttaccagccgctggccatgaaatgcatctactgccccatcgacacccggctgaacttcatccaggtgtcaaagctgcttaaagaagtgcagcccctgcacgtggtgtgtcctgagcagtacactcagccgcccccagcccagtcccacaggatggacctcatgatcgactgccagccccccgccatgtcctatcggcgggctgaggttctcgccctgcccttcaaacgtcggtacgagaagatcgagatcatgccagagctcgcagattcactggtgcccatggagatcaagcctggcatctccttggcaactgtctcggccgtgctgcacaccaaagataacaagcacttgcttcagccccctcctcggcccgcccagcccacgagcgggaagaagagaaagcgggtgagcgatgacgtaccagactgcaaagtcctgaagcctttgttgagcggttccatccctgtggagcagttcgtgcagaccctggagaagcatggcttcagtgatattaaggtggaggacacagccaagggccatatcgtcctgctccaggaggctgagacgctcatccagattgaagaagactcgacccatatcatctgcgacaatgacgagatgctcagagtgcgactgcgggaccttgtcctcaaattcttacagaagttctgagtgggccatctgagctacttccctgaaatcctgcagtccctcactggctgccctcacaagccacctgaggagtggcatgagaggccattaactgtgtctttgtggtgtcctctggcttaaggagtgaagaggtggctcttgagggaaatggtctggacttattcccagcactgtttcaggcaagaactttccctttcaacttcaggctcattttcttctcaactctggctctctcaaggagctggagggtggcagaagtgggacaggagaagttttccaagaggttcatgggaggcggaggtgactggctggctgtcttgcatcagtcccaggcctcggccaggggagccagcctttggtttcgtttacttgcctacagtgctgtacg

SEQ ID NO: 1046 - DNA, 2511 bp, Homo sapiens
cggcggccgttgcagcggcggcggcgagagcggcgggagcccgaggcggcggcgctcgcggcccatcgtggggcccgagctgtgcgcctcggctcggagcccggaccgggcgggggcgccgacgtgcctcagcctgccttcgcgagggaggcgggagtgagcagaaaggcttagggcccagggggcggggaaggggggccgggcctggatccggcggggaggccgagccggaggccggaccgtggctcgcgctgtccccgggacgcggatcgaacgttggcggcgcggatcgcacgtcggcggccggtggaacgcgggagctgggcggcgcgcggactggggccatggcgtctgtgcaggcgtcccgccgccagtggtgctacctgtgcgacctgcccaagatgccgtgggccatggtgtgggacttcagcgaggccgtgtgtcgcggctgcgtgaacttcgagggcgcggaccgcatcgaactgctcatcgatgccgcccgccagctcaagcgcagccacgtgctccccgagggccgctcgcccgggcccccggcccttaagcacccggccaccaaggacctggcggcggcagccgcacaggggccccagctgccgcccccgcaggcccagccccagccgtcagggaccggcggcggcgtgtcgggccaggaccgctatgacagggccacatcatcaggccgcctccccctgccctcgcccgccctggagtacactctggggtcccgcctggccaatgggctgggccgtgaggaggccgtggctgagggggcgcgaagggccttgcttggctccatgcctggcttgatgccccctgggctgctggcagctgcagtgtctggcctgggaagccgaggcctgacgctggcacccggcttgagtcctgcccgtcccctcttcggctccgatttcgagaaagagaagcagcagaggaatgcggactgtctggcagaactgaacgaggccatgcgaggccgggcagaggaatggcacgggcgccccaaagcagtgcgggaacagctactggcgctgtccgcctgcgccccgttcaatgtgcgcttcaagaaggatcacgggctggtggggcgagtgttcgccttcgatgctactgcccgtcctccaggatacgagttcgagctgaagctcttcaccgaatacccctgtggttccggcaatgtgtacgccggcgtcctggcagtggctcgccagatgttccacgatgctctgcgggagccgggcaaggcactggcttcttcgggcttcaagtacctcgaatatgaacgccggcatggatcaggagaatggcggcagctgggcgagctgcttaccgacggcgtccgcagcttccgcgagccagctcccgcggaggccctgccccagcagtacccagagccggcccctgcggctctctgtggcccacccccgcgagccccatcccggaacctggcgcccacgccgcgccgtcgcaaggcatcccccgagccggagggcgaggcggctgggaagatgaccaccgaggagcagcagcaacggcactgggtggcacccggcggcccgtactccgctgagacccctggtgtgccctcgcccattgccgccctgaagaatgtggccgaagccctgggccactcacccaaggaccctggcggaggcggggggcctgtgcgtgcagggggcgccagccctgcagcctcctccacggcccagccgccaacccagcatcgccttgtggcccgcaacggcgaagcagaagtcagtcccacagcgggggccgaagctgtcagcgggggtggcagcggcactggggcgacccctggggcccccctgtgctgtaccctgtgcagggagcggctagaagacacccacttcgtccagtgcccctcggtgcccggacacaagttctgctttccctgctcccgggagttcatcaaggcgcagggcccggccggggaggtgtactgcccgagcggagacaagtgcccgctggtcggctcctccgtgccctgggccttcatgcagggcgagatcgccaccatccttgctggagacatcaaagttaagaaagaacgggacccctaggctaccactgcctccaggctactgccctctgcccctttgccacccaccgctgccgcggataaattattccctccccgacccagcccagtgccacctctatctgtgtacatactcccttcttccacccagatgggtcccctggggtagatgcattgtgggtggggggagaaagcttgtggctcctgtccgagggggtgtttggggtcccttggcccctccagtttccctctgtcctccttggcttggctttgctgctgcttgtagttgggggagaggtgcccccctcctccttgagaagggacctcctgaaaactcgctctttataaacgaggcaaaagcatttaattcccacccccccaccccccgctcccttctgctccttcaataaaccgaaagatgggttttttttttc

SEQ ID NO: 1047 - DNA, 4663 bp, Homo sapiens
ctcctcctccggcgtcgcgggctcctcggacatggccgcggcggtggcggtggcggccgcgtcccggcggcagtcgtgctacctgtgtgacctgccccgcatgccctgggccatgatctgggacttcaccgaacccgtctgccgcggctgcgtcaactacgagggcgccgaccgcgtcgagttcgtcatcgagacggcgcggcagctcaagcgggcgcacggctgcttcccggagggtcgctccccacccggcgccgcggcctcggccgccgccaagccgccgccgctctccgccaaggacatccttttgcagcagcagcagcagcttggccacggcggccccgaggcggccccgcgcgcgccgcaggccttggagcgctacccgttggcggccgcggccgagaggcccccgcgcctcggctctgacttcggcagcagccgcccggcagcgagcctggcccagccgccgacgccgcagccgccgcccgtgaacggcatcctggtgcccaacggcttctccaagctagaggagccgcccgagctgaatcgccagagcccgaacccgcggcgcggccacgcggtgccgcccaccctggtgccgctcatgaacggctcggccacgccgctgcccaccgcgctcggcctcggcggccgcgctgccgcctccttagccgcggtgtccggaaccgcggccgccagcctgggctccgcgcagcccaccgatctgggcgcccacaagcggccggcatccgtgtcgagcagcgctgccgtggagcacgagcagcgtgaggcggcagccaaggagaaacaaccgccgccgcctgcgcaccggggcccggccgacagcctgtccaccgcggccggggccgccgagctgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcaggcaggttgttgggtttcgaggccaacggggccaacgggtctaaagcagttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaaaagccaaatacattttctgacattgtaagattgccttactgtctgtcattccttattgctggcccctttctcaggccggaggccaagtggtggagaaggaaaggaaatgatcgaacgggcatgttgtcaagtgggcatgccactgggaaataccaccagtttaccctgaaacattgtcctcagaggagtaggaaagtggattttgaatctctattttgctcaaaagttcagttcctgagatactgatgactgagagtgctgctgggaaattttcaggattgtgtggtcttttggggttttttgtttttttttttttaagacaaagttgaccgctgttcactgtccacgtgatcagttgtaagattacaatgctgcatgctagttggttacataagatacaattccagtgatggaaggcggttataatggatggtggtgtgtacaagatggcactgccatctttgagcagagcccagctctgcagcgccacttcatctttttaaacaccctagaggtctgtttgttgttgctgttgtcctttattttgaaagagttgcaagagaagttacagtccaggtgaacttggagattgtgggattggttttgtttctgttttgttttgtttatcatttacctgtagtgctattgctgttgatactatcacctataccctgtttctagtgagtgctgaatacagtatggtacaatgacagtaacagccgcgtggtgctgccaggactgcccttgggcatatcagtgacagcccaaatgtgggtggaggaaacctgtaatttccttcttaacatgtgtttgaaataccaagtgaataatactgttctggaaaaaaatgataaactagtggaaattaaagaaattaagggttttatataatagacaggccccacctctcaaaatatttttagaagtctttttgtaaactaatttcttttgatcactattttgcatcagtaaaatgatttttttaaaaccaataaatcatcaattattagaaatagttgtctcacagtgatactggtttttcttttgtgctgttatgatttaacattgacaggaacactattttaaatccttacgttcaggtgtttgtaacttggccttataattaggctgaattatggcttcaaggtctacaatttatgtgtatggttcacagcctagcttctatttacatttgaaaatacagatttttaccaactttggattcttttttagttatatgtttgtctttcctttttaaattgttcaaaactattttttaatggtcaagttactaacacttgaaaatcagatactgcaccaaatacagtgtttttccgtagtgtttttaatgagtgcacctattactactgtgcgagaattcatgttttaccagtcattgttatattacaaacagacttgcatgattaaccagttgttacacttactttttcaagttggagtatatatgactcagtgcagactggtctctcttatgtgaatgcacacatgcagaaatgcagagtcaattttacatgcccataaagacatttgtaaagaattcagctcttatggtctgttgtataaatgtgtatctaggcactttggaatttgacctcacagatgttacaacttgatcagtcgtttgacctaatttgtggtagctatctgtatgttttgcaatcttaatacagacatgctttccaaaaagattaatacagaaccatcctgccgttttggataagtctatccagctgtggaaagggcaacctgtggtttctctgtactggtgtttaatgggggaagaatatgaacagctttaaagagctgtgtattgtggttactactattaaaaaataagatctgcacgagtctgactggcctttgggtggcctttgtggacggctcgtagctggaaagtgttgatctgggttttctggcattcttttaagttaaaaagttaacatcgggacatgggtttgatcttttgttgtacctgatgacagtgcagagattctccacagctggataaaaatgtcacaaagctacttactgtacatgggcagtatcagatttcaaatcctaatatttcagctgtgcttttaatactcaaaatattaggggatggggtgttgaagctttcccttttttgcttttaacaatttatagaatttaacagatgtactgtctttcatgtggcctcacatttaaagttatgagaacatacacatggtttacaacttttactatatacctttccttggccaccaagtattttaaaagtgtgccaccttttaacctttactttttttaagttgaaggtgatactttttctatatatgatgaaactcatgtcaactgaagtgagtgtaatctcagataccaacattattatattttaaaatcacgctatggaaatatcacctgaattctgtcatttgtcagatttacagtacctttttttctttaacttttagcattaaataaaaataaaattgggagcactgaa

SEQ ID NO: 1048 - DNA, 4615 bp, Homo sapiens
ctcctcctccggcgtcgcgggctcctcggacatggccgcggcggtggcggtggcggccgcgtcccggcggcagtcgtgctacctgtgtgacctgccccgcatgccctgggccatgatctgggacttcaccgaacccgtctgccgcggctgcgtcaactacgagggcgccgaccgcgtcgagttcgtcatcgagacggcgcggcagctcaagcgggcgcacggctgcttcccggagggtcgctccccacccggcgccgcggcctcggccgccgccaagccgccgccgctctccgccaaggacatccttttgcagcagcagcagcagcttggccacggcggccccgaggcggccccgcgcgcgccgcaggccttggagcgctacccgttggcggccgcggccgagaggcccccgcgcctcggctctgacttcggcagcagccgcccggcagcgagcctggcccagccgccgacgccgcagccgccgcccgtgaacggcatcctggtgcccaacggcttctccaagctagaggagccgcccgagctgaatcgccagagcccgaacccgcggcgcggccacgcggtgccgcccaccctggtgccgctcatgaacggctcggccacgccgctgcccaccgcgctcggcctcggcggccgcgctgccgcctccttagccgcggtgtccggaaccgcggccgccagcctgggctccgcgcagcccaccgatctgggcgcccacaagcggccggcatccgtgtcgagcagcgctgccgtggagcacgagcagcgtgaggcggcagccaaggagaaacaaccgccgccgcctgcgcaccggggcccggccgacagcctgtccaccgcggccggggccgccgagctgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcagttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaaaagccaaatacattttctgacattgtaagattgccttactgtctgtcattccttattgctggcccctttctcaggccggaggccaagtggtggagaaggaaaggaaatgatcgaacgggcatgttgtcaagtgggcatgccactgggaaataccaccagtttaccctgaaacattgtcctcagaggagtaggaaagtggattttgaatctctattttgctcaaaagttcagttcctgagatactgatgactgagagtgctgctgggaaattttcaggattgtgtggtcttttggggttttttgtttttttttttttaagacaaagttgaccgctgttcactgtccacgtgatcagttgtaagattacaatgctgcatgctagttggttacataagatacaattccagtgatggaaggcggttataatggatggtggtgtgtacaagatggcactgccatctttgagcagagcccagctctgcagcgccacttcatctttttaaacaccctagaggtctgtttgttgttgctgttgtcctttattttgaaagagttgcaagagaagttacagtccaggtgaacttggagattgtgggattggttttgtttctgttttgttttgtttatcatttacctgtagtgctattgctgttgatactatcacctataccctgtttctagtgagtgctgaatacagtatggtacaatgacagtaacagccgcgtggtgctgccaggactgcccttgggcatatcagtgacagcccaaatgtgggtggaggaaacctgtaatttccttcttaacatgtgtttgaaataccaagtgaataatactgttctggaaaaaaatgataaactagtggaaattaaagaaattaagggttttatataatagacaggccccacctctcaaaatatttttagaagtctttttgtaaactaatttcttttgatcactattttgcatcagtaaaatgatttttttaaaaccaataaatcatcaattattagaaatagttgtctcacagtgatactggtttttcttttgtgctgttatgatttaacattgacaggaacactattttaaatccttacgttcaggtgtttgtaacttggccttataattaggctgaattatggcttcaaggtctacaatttatgtgtatggttcacagcctagcttctatttacatttgaaaatacagatttttaccaactttggattcttttttagttatatgtttgtctttcctttttaaattgttcaaaactattttttaatggtcaagttactaacacttgaaaatcagatactgcaccaaatacagtgtttttccgtagtgtttttaatgagtgcacctattactactgtgcgagaattcatgttttaccagtcattgttatattacaaacagacttgcatgattaaccagttgttacacttactttttcaagttggagtatatatgactcagtgcagactggtctctcttatgtgaatgcacacatgcagaaatgcagagtcaattttacatgcccataaagacatttgtaaagaattcagctcttatggtctgttgtataaatgtgtatctaggcactttggaatttgacctcacagatgttacaacttgatcagtcgtttgacctaatttgtggtagctatctgtatgttttgcaatcttaatacagacatgctttccaaaaagattaatacagaaccatcctgccgttttggataagtctatccagctgtggaaagggcaacctgtggtttctctgtactggtgtttaatgggggaagaatatgaacagctttaaagagctgtgtattgtggttactactattaaaaaataagatctgcacgagtctgactggcctttgggtggcctttgtggacggctcgtagctggaaagtgttgatctgggttttctggcattcttttaagttaaaaagttaacatcgggacatgggtttgatcttttgttgtacctgatgacagtgcagagattctccacagctggataaaaatgtcacaaagctacttactgtacatgggcagtatcagatttcaaatcctaatatttcagctgtgcttttaatactcaaaatattaggggatggggtgttgaagctttcccttttttgcttttaacaatttatagaatttaacagatgtactgtctttcatgtggcctcacatttaaagttatgagaacatacacatggtttacaacttttactatatacctttccttggccaccaagtattttaaaagtgtgccaccttttaacctttactttttttaagttgaaggtgatactttttctatatatgatgaaactcatgtcaactgaagtgagtgtaatctcagataccaacattattatattttaaaatcacgctatggaaatatcacctgaattctgtcatttgtcagatttacagtacctttttttctttaacttttagcattaaataaaaataaaattgggagcactgaa

SEQ ID NO: 1049 - DNA, 4147 bp, Homo sapiens
cagccggagcaggagcgccgagacgcgcctccggaacgtagagtaacaatcacaaccccacattccgggcgagcgtgagcacgagcgggaagggatgcgacccgggccgaggcgccgcgcgagcgccctgcagccaacgtgagcgccgccagccgcggcggcccgggcgccggccaggcctgggggcggcgggagcctgcgtgcgtgcactcctctcctctgctctcgtgcgtcctggaagcagtggccgcggcggctccctccggggtgcaaacccagtcgccgccagcagaacggccgacgctgcggaggggagaaggtcctttctcggctgccaccccctcccccggtcctccggggaagcagcggcttcagcaagattggacccgggcaccgggtggcactgaaccctctggccctcgccccagggggcccgtcggggagaggacgcagctcgtaggggggtccccggggagaggaagagacagcccctttcgagcttccacgcaccagccactccggggagggggccaagaggcaacggcggccaccaccgggcaccctcgccccctcccctcgggccgggagcttccagcccaagtctgcagcaccaggaagaaggcgcctgagctcccctcgcgacgagtcaaccgcagtaggaggtgggggcgaagagagggctgaacccgtccgctgcccgggcggtggagcccccacggcgaggcgctgcgccggcggtggagactcgcgttccctccagcccctggggcagaactttctcgccccccctcctccctcccccgcagtcggactccctccccagccggccagtcctcccggaggagaaggcgccgcggagacagcccgggcgggggcctaccttccccagggcaggcatcatgtcggcggcgcaggtgtcctcgtcccggagacaatcttgctacctgtgcgacctgccccgcatgccctgggccatgatctgggacttctcggaacccgtatgccgcggttgcgtcaactacgagggcgctgatcgcatcgaattcgtgatcgagacagcgcgccagctgaagcgggcgcacggctgcttccaggacggccgctcccccgggccgccgccgcccgtcggggtcaagacagtggccctgtcggctaaggaagcggcggcggcggcggcagcagcggcggccgccgccgccgccgcgcaacagcaacagcaacagcagcagcagcagcagcaacagcagcagcagcagcagcagcagcagcagcaacaacagctcaaccacgttgatggttccagcaagcctgcggtgctggcggccccgtctggcctggagcgctacggcctaagcgctgccgccgccgccgccgccgccgccgccgctgcggtggaacagcgcagccgcttcgagtacccgccaccgccggtgagcctgggaagcagcagccacaccgcgcgactgcccaacggcctggggggcccaaacggcttccccaaaccaacaccagaggagggacccccagagctgaaccgtcagagccccaattcttcttcagcggcggcgtcggtggcgtctcggcgtggaacgcacggtgggctggttacggggctgcccaacccggggggtggcggaggcccccagctcaccgtgccccccaacctgctaccgcagacgctgcttaacggcccggccagcgctgcggtactccccccaccccctccccacgccctgggcagccgtgggcccccgacgcctgctcccccaggggctcctgggggccccgcttgtctcgggggtaccccgggtgtatcggccacgtcgtcctccgcgtcgtcttcgacctcttcgtcggtggcagaggtgggcgtgggtgctggtggtaagaggcccggctcggtgtcgagcacagaccaggagcgcgagttgaaggagaagcagcgcaacgccgaggccctggccgagctgagcgagagcctgcgcaaccgcgccgaggagtgggccagcaagcccaagatggtccgcgacacgctgctcacgctggcaggctgcacgccctacgaggttcgcttcaagaaggaccactcgctgctgggccgcgttttcgccttcgacgccgtctccaagcccggcatggactacgaattgaagctgttcattgagtaccccacgggctcgggcaacgtgtactccagtgcatctggtgtggccaagcagatgtatcaggactgcatgaaggacttcggccggggcctatcctcgggtttcaagtacctggagtacgaaaagaagcacggctccggggactggcgcctgcttggagacctgctccccgaagccgtgcgcttcttcaaggagggcgtgcccggcgccgacatgctgccccagccctacctggacgccagctgtcccatgctgcccactgctctggtgagtctgagccgcgcccccagcgcacccccggggaccggggccttgccgcccgccgcgccgtcgggccggggcgcagccgccagcctgcgcaagagaaaggcctctccggagcccccggactcagccgagggcgcgctgaagctgggcgaggaacagcagaggcagcagtggatggcgaaccagagcgaggcgctgaagctcaccatgtccgccgggggcttcgcggcgccggggcacgcggcggggggtccgcctccgccgcccccacctctgggaccccattccaaccggaccaccccacctgagtcagccccccagaacggtccgtcccctatggccgctctcatgtcggtggcagatactctgggcacagcgcactcgcccaaggatggcagttccgtgcactctaccactgcgtcggcgcggcgaaacagcagcagcccagtctcgccggcctccgtgccggggcagcgccgcttggcatcacgtaacggggacctgaatttacaggtggcgcccccgccgcctagcgcccacccgggcatggaccaagtgcacccccaaaacattccggattcccccatggccaacagcggacccctctgctgcaccatttgccacgaacgtttggaggatacgcatttcgttcagtgcccttccgtccccagccacaaattttgcttcccttgctctagagagagtatcaaggcccagggggccaccggcgaggtgtattgccccagcggagagaaatgccccctagtcgggtcgaatgtaccttgggccttcatgcagggcgaaatcgcgactatcttagctggggatgttaaagtgaaaaaggagagagacccttgaaccactgggcagccacctcctttgccctagaccagctcctctccaatcctgagggcccctcccccaacccaactcgaccctccctcccctcacccccaaggtgtagaattgtgaatataacgaaactgcaaaaagttagtcttatgtatagacattattttcgtcgtatgtttctatattttgaaacaaaggtatgtaacttcttcatttgaaggataagctggtttgtgttaagcagtatagtattggttgggtcatttgcatcatatcgttagcatttatttggtggcagaatgtttgcctaggtacagaattaatagcccttagcaacgactgctgctggtgtgtatttttgtaaatgttatgcactctctgaaaggaaaaacacacacaaaagaaaaagacttttttttttttttttttttttttgccaaggccagtgttgctgcctaaaaaaaaaaaaaaaaaaaaaaaaaaaaaaaaaaaatgctataaaatggtgaaagcttccttctaaactgccccaagtgttgaagtcttcactttattttgttgttttgttttgtttttctgttttgtttgcaaaatggtaagggggtgtcgggggggatggggtgtattttgttgcaagtttgtgaggggaaaatgttttggtttgtttctactgacctgaatgtgttggatctacacgtgttgttttgtttttgctttattgatgcacggatgcttttgaacagtagagcgaaatgctagacatggagaatctgctctgtttgtcctttatacatttctgtagttaacagaacactgtaatgtgccttggagcttagtaacttgtaataaattcaattgatatt

SEQ ID NO: 1050 - DNA, 3123 bp, Homo sapiens
ggccactgcgggaggcgcgcgcgcgaggcagccaagccttgccttcggaggagatgcccagggatcttagcaagcagcctgcggctgccagggatcggacctggcgagtttcccgacggaatctgagggatcccgaacctcggcctcgagggggcgctatccggcctactcgaggaccaggcagctgcagagaagctccaaggtcaaggccctgggccaggccagggcttggagagccggaatctagcccgagtcctggggaggctgaggcggggaaccagatccccgaggacaaagatgggcgggccagtgggatccaccgacgctgcccggagctgctccaacgagagccgggcctgtggcgtgaacaaactttacttcagcgcaggggcggaggaaccgggctggaggcttctcccccgggcctctgctctcctccacctgccagtgctcagcctccgcccagccttcgcccaccccagctccctccccctcccccacgcgcctctgttcactcagactcctgtctcccctctcccctcctccttctccctcttgcctttctcccccacttttctcctgtctcttcttttgtattctctcctccctcgccgccccggttgcctctcgcctcctccgggccgcaggggaggaggtgagcgcgctgcgcccggggcctgcgcggctcagagggaggcgtttctcctacttctcccgggtaatttggagaggttgtgtgtgtgtgcgcgcgcgcgtgagctccaggcgaaaaggggtaggattcagcgccgagcagagagggtcagggtttttgacgttcctcgccagctgcacaaacctcccggagcaagtgtgagtgtgggtgagagtgcgcgcgcgcgcacgggctggctgcgcttggcacgcttggtggcccagggtcccggggcccggggtcccgtctggcggcccgggattaccgtgacgtcacattgagcctctggccaccttggactgggacacctccggagcctcacagccccgcgccgcgccgcgcctcacctcgccaccacgcgcctttgggaacccgcatcttcttccttcccctgcccatccatgggcccttctgtcttccggaccccacgggccggaggggcgccttccggagcgcagggctcggcagccgggctgccctcggctctgcctccactggggccaaccaggcgaaggaaccggcgctgggcatccgcagcggtgtaaggaactgagacacctcactgctgggggcgcggaacagctgggctgagacgggaactcgacagggaagagagagacgggccagggacagccaccatgtccttcccacactttggacacccgtaccgcggcgcttcccagtttctggcgtcggcaagttccagcaccacatgctgcgaatctacccaacgctctgtctcagatgtggcatcaggctccaccccagcgcccgctctctgctgcgcaccctacgatagtcgactgctgggcagtgcgcgaccggagctgggcgccgccttgggcatctatggagcaccctatgcggccgctgcagctgcccagagctaccctggctacctgccctatagcccagagcccccctcactgtatggggcactgaatccacagtatgaatttaaggaggctgcagggagttttacatccagcctggcacaaccaggagcctattatccctatgagcggactctggggcagtaccaatatgaacggtatggcgcagtggaattgagtggcgccggtcgccgaaagaacgcgacccgggagaccaccagtacactcaaggcctggctcaacgagcaccgcaaaaacccctaccccactaagggtgagaagatcatgctggccatcatcaccaagatgaccctcacccaggtgtccacctggttcgccaacgcacgccggcgcctcaagaaagagaacaaaatgacatgggcgcccaagaacaaaggtggggaggagaggaaggcagagggaggagaggaggactcactaggctgcctaactgctgacaccaaagaagttactgctagccaggaggcccgggggctccggctgagtgacctggaagacctggaggaagaggaggaggaggaggaggaagctgaagacgaggaggtagtggccacagctggggacaggctgacggagttccgaaagggcgcgcagtcactgcctgggccgtgcgctgcagctcgagagggccgattggagcgcagggagtgcggcctggctgcgccccgcttctccttcaatgacccttccggatcggaagaagctgacttcctctcggcggagacaggcagccctaggttgaccatgcactacccatgcttggagaaaccgcgcatctggtctctggcgcacaccgcgacagccagcgctgttgaaggtgcacccccagcccggcctaggccacgaagtcctgagtgccgtatgattcctggacagcctcctgcctctgcccggcgactctcagtccccagagactccgcgtgcgacgagtcttcctgcatacccaaagcctttggaaaccccaagtttgccctgcagggactaccgctgaactgtgcgccgtgcccgcggaggagcgagcctgtagtgcagtgccagtacccgtctggagcagaagcaggttagcgcaatggctgcgatttgcgaaagaatcttggaaatgggccccacgtttcgaattcatctccaggttaagaagctgccagaccttgccagggaccaggagctctcactttgcctaagagacagacacacagaaaccctcctagcagctgtccttgcacgcagagctggggtggtgggccgacttgaaccttagcagtccccacgggagatggcagggcaccttggggaaggccaagtgggaggctgggaggctgccccacccaccgactctaccaagtctctcttcctcctgtggattcagcaaggcttcctctcctgctcacccctgtctctcacctccaccaaccccactcactttgtaacttcatcactgacccggccaataaggaccctgtgcgtcttctccccctcctaagcccttgtgtccttaaaaataatcagtccgaaccc

SEQ ID NO: 1051 - DNA, 1881 bp, Homo sapiens
gctagtgcgtgttgacgtcatgctgcgtgcgggccggtgcggaatcgctccttcaactccgcggggcagtaggagttagttagcaaagagccgaggccgggcgcgcgaccctcgtccttctgcccctggccgcacactttgcgcacatctctttttctgcatggtggatattatttttcattatccttttctgggtgctatgggtgatcattccaagaagaagcccgggacggccatgtgcgtgggctgcgggagtcagatccacgaccagtttatcctgcgggtgtcgcccgacctcgagtggcacgcggcctgcctcaagtgtgccgagtgcagccagtacctggacgagacgtgcacgtgcttcgtgagagacgggaagacctactgcaagcgggactatgtcaggctgttcggcatcaagtgcgccaagtgccaggtgggcttcagcagcagcgacctggtgatgagggcgcgggacagcgtgtaccacatcgagtgcttccgctgctccgtgtgcagccgccagctgctgcctggggacgagttctcgctgcgggagcacgagctgctctgccgcgccgaccacggcctcctgctcgagcgcgccgcggccggcagcccgcgcagccccggcccgcttcccggcgcccgcggcctgcatctgcccgacgctgggtcgggccggcagcccgcgttgcgcccgcacgtgcacaagcagacggagaagacgacccgcgtgcggactgtgctgaacgagaagcagctgcacactctgcggacctgctacgccgccaacccgcggcccgacgctctcatgaaggagcagctggtggagatgaccggcctgagcccgcgggtcatccgcgtctggttccagaacaagcgctgcaaggacaagaagaaatccattctcatgaagcagctgcagcagcagcagcacagcgacaagacgagccttcagggactgactgggacgcccctggtggcgggcagtcccatccgccatgagaacgccgtgcagggcagcgcagtggaggtgcagacgtaccagccgccgtggaaggcgctcagcgagtttgccctccagagcgacctggaccaacccgccttccaacagctggtctccttctccgagtccggctccctaggcaactcctccggcagcgacgtgacctccctgtcctcgcagctcccggacacccccaacagtatggtgccgagtcccgtggagacgtgagggggacccctccctgccagcccgcggacctcgcatgctccctgcatgagactcacccatgctcaggccattccagttccgaaagctctctcgccttcgtaattattctattgttatttatgagagagtaccgagagacacggtctggacagcccaaggcgccaggatgcaacctgctttcaccagactgcagacccctgctccgaggactcttagtttttcaaaaccagaatctgggacttaccagggttagctctgccctctcctctcctctctacgtggccgccgctctgtctctccacgccccacctgtgtccccatctcggccggcccggagctcgcccacgcggacccccgccctgccccagctcagcgctccctggcggcttcgcccgggctcctagcggggaaaaggaaggggataactcagaggaacagacactcaaactcccaaagcgcatgattgctgggaaacagtagaaaccagacttgccttgaaagtgtttaagttattcgacggaggacagagtatgtgagcctttgccgaacaaacaaacgtaagttattgttatttattgtgagaacagccagttcatagtgggacttgtattttgatcttaataaaaaataataacccgggg

SEQ ID NO: 1052 - DNA, 2958 bp, Homo sapiens
ggtgcttctaggaagtagaacgccggctcgcatgcctgcccgcccgccagcctgccgggtacggccttttccgccggggcttccaggtcaaagaattcgcctttgccgctaccgctttcttaccctccgcacccgttaagttctccggtcgggcggcagtctctgaacacttagccgcgccatccggggtcacaccgcctggaaggaggtgacgggggcggcgcggggcgcggacactccccgctgagagtccgcctgccatggactcggaatattacagcggcgaccagtcagatgatggtggtgctaccccagtacaggatgaacgggattcagggtcagacggtgaggatgatgtaaatgagcaacactccggatcagacactggaagtgtagaacgtcattcagagaatgaaactagtgatcgagaagatggcctccccaaaggacatcatgtgacagactctgagaacgatgagcccttaaatcttaatgctagtgactctgaaagtgaggagcttcacaggcaaaaggacagcgactctgaatctgaggaacgtgcagagcctcctgcaagcgattctgaaaatgaggatgtcaatcagcatgggagcgactctgagagtgaagagaccaggaaattacctggtagtgactctgaaaatgaggaacttcttaatgggcatgcaagtgactcagaaaacgaagatgttgggaagcatcccgccagtgattctgagattgaggagctccagaagagtcctgctagtgactctgaaacagaagatgctctaaaacctcaaatcagtgactctgagagtgaggaacccccaaggcaccaagccagtgactccgaaaatgaggagcctcccaaacctcgaatgagtgattctgaaagtgaggagcttcctaaacctcaggtcagtgattcagaaagtgaggaacccccaaggcaccaggccagtgactctgaaaatgaggagcttcccaaacctcgtatcagtgactcagaaagtgaggaccctccgaggcaccaggccagtgactcagaaaatgaagagcttcccaaaccccgaatcagtgattcggaaagtgaggatcccccaaggaaccaggccagtgattcggaaaatgaggagctacccaaaccccgagtcagtgactctgagagtgaggggcctcagaaggggcctgccagtgactcagaaactgaggatgcgtccagacacaaacagaagccagagtcagatgatgacagcgacagggagaataagggagaggatacagaaatgcagaatgactccttccattcagacagccatatggacagaaaaaagtttcacagttctgatagtgaggaggaagaacacaaaaagcaaaaaatggacagtgatgaagatgaaaaagagggtgaggaggagaaagtagcgaagagaaaagctgctgtgctttctgatagtgaagatgaagagaaagcatcagcaaagaagagtcgtgttgtctctgatgcagatgactctgacagtgatgctgtatcagacaagtcaggcaaaagagagaagaccatagcatctgacagtgaggaagaagctgggaaagaattgtctgataagaaaaatgaagagaaggatctgtttgggagtgacagtgagtcaggcaatgaagaagaaaatcttattgcagacatatttggagaatctggtgatgaagaggaagaagaatttacaggttttaaccaagaagatctggaagaagaaaaaggtgaaacacaggtaaaagaagcagaagattcagattctgatgataacataaagagaggaaaacatatggactttctgtcagattttgagatgatgttgcagcgaaaaaagagcatgagtggcaagcgcagacggaaccgcgatggtggcacctttattagtgatgcagacgacgtcgtgagtgccatgatcgtcaagatgaatgaagctgctgaggaagacagacagttgaacaatcaaaaaaagccagcactgaaaaaattaactttactgcctgctgtagttatgcaccttaagaagcaggaccttaaagaaacattcattgacagtggtgtgatgtctgccatcaaagaatggctctcacctctaccagataggagtttgcctgcactcaagatccgggaggagctgctgaagatcctgcaagagctgcctagtgtgagccaggagaccctgaagcatagtgggattggacgagcagtgatgtatctctataaacaccccaaggagtcaaggtctaacaaggacatggcagggaaattaatcaatgagtggtctaggcctatatttggtcttacctcaaactacaaaggaatgacaagagaagaaagggagcagagagatctagaacagatgcctcaacgacgaagaatgaacagcactggtggtcagacacccagaagagacctggaaaaggtgctgacaggagaggagaaggctcttagacctggagatcctggattctgtgcccgtgcaagggtcccaatgccttcaaacaaggactatgttgtcaggcccaaatggaatgtggaaatggagtcatccaggtttcaggcgacctccaagaagggtatcagtcgactggataaacagatgagaaagttcacagatataaggaaaaaaagcagatctgcacacgcagtgaaaatcagcattgagggcaacaaaatgccattgtgaccttgcctggaatgtgtccccatctctactctaagaaatgcgcaatggactctttggagaaagaagatattttaaaacatttttagtgtgtctgtaaatggttcagcgtgtatcagatgttgtcataggactcacatttctctcagttatatttaaaaccgttgtgtactttgtacaaaggaatactagtcatacttctataaactttacacaataaaatttcattctggtttttggg

SEQ ID NO: 1053 - DNA, 2804 bp, Homo sapiens
ttctaggaagtagaacgccggctcgcatgcctgcccgcccgccagcctgccgggtacggccttttccgccggggcttccaggtcaaagaattcgcctttgccgctaccgctttcttaccctccgcacccgttaagttctccggtcgggcggcagtctctgaacacttagccgcgccatccggggtcacaccgcctggaaggaggtgacgggggcggcgcggggcgcggacactccccgctgagagtccgcctgccatggactcggaatattacagcggcgaccagtcagatgatggtggtgctaccccagtacaggatgaacgggattcagggtcagacggtgaggatgatgtaaatgagcaacactccggatcagacactggaagtgtagaacgtcattcagagaatgaaactagtgatcgagaagatggcctccccaaaggacatcatgtgacagactctgagaacgactctgagagtgaagagaccaggaaattacctggtagtgactctgaaaatgaggaacttcttaatgggcatgcaagtgactcagaaaacgaagatgttgggaagcatcccgccagtgattctgagattgaggagctccagaagagtcctgctagtgactctgaaacagaagatgctctaaaacctcaaatcagtgactctgagagtgaggaacccccaaggcaccaagccagtgactccgaaaatgaggagcctcccaaacctcgaatgagtgattctgaaagtgaggagcttcctaaacctcaggtcagtgattcagaaagtgaggaacccccaaggcaccaggccagtgactctgaaaatgaggagcttcccaaacctcgtatcagtgactcagaaagtgaggaccctccgaggcaccaggccagtgactcagaaaatgaagagcttcccaaaccccgaatcagtgattcggaaagtgaggatcccccaaggaaccaggccagtgattcggaaaatgaggagctacccaaaccccgagtcagtgactctgagagtgaggggcctcagaaggggcctgccagtgactcagaaactgaggatgcgtccagacacaaacagaagccagagtcagatgatgacagcgacagggagaataagggagaggatacagaaatgcagaatgactccttccattcagacagccatatggacagaaaaaagtttcacagttctgatagtgaggaggaagaacacaaaaagcaaaaaatggacagtgatgaagatgaaaaagagggtgaggaggagaaagtagcgaagagaaaagctgctgtgctttctgatagtgaagatgaagagaaagcatcagcaaagaagagtcgtgttgtctctgatgcagatgactctgacagtgatgctgtatcagacaagtcaggcaaaagagagaagaccatagcatctgacagtgaggaagaagctgggaaagaattgtctgataagaaaaatgaagagaaggatctgtttgggagtgacagtgagtcaggcaatgaagaagaaaatcttattgcagacatatttggagaatctggtgatgaagaggaagaagaatttacaggttttaaccaagaagatctggaagaagaaaaaggtgaaacacaggtaaaagaagcagaagattcagattctgatgataacataaagagaggaaaacatatggactttctgtcagattttgagatgatgttgcagcgaaaaaagagcatgagtggcaagcgcagacggaaccgcgatggtggcacctttattagtgatgcagacgacgtcgtgagtgccatgatcgtcaagatgaatgaagctgctgaggaagacagacagttgaacaatcaaaaaaagccagcactgaaaaaattaactttactgcctgctgtagttatgcaccttaagaagcaggaccttaaagaaacattcattgacagtggtgtgatgtctgccatcaaagaatggctctcacctctaccagataggagtttgcctgcactcaagatccgggaggagctgctgaagatcctgcaagagctgcctagtgtgagccaggagaccctgaagcatagtgggattggacgagcagtgatgtatctctataaacaccccaaggagtcaaggtctaacaaggacatggcagggaaattaatcaatgagtggtctaggcctatatttggtcttacctcaaactacaaaggaatgacaagagaagaaagggagcagagagatctagaacagatgcctcaacgacgaagaatgaacagcactggtggtcagacacccagaagagacctggaaaaggtgctgacaggagaggagaaggctcttagacctggagatcctggattctgtgcccgtgcaagggtcccaatgccttcaaacaaggactatgttgtcaggcccaaatggaatgtggaaatggagtcatccaggtttcaggcgacctccaagaagggtatcagtcgactggataaacagatgagaaagttcacagatataaggaaaaaaagcagatctgcacacgcagtgaaaatcagcattgagggcaacaaaatgccattgtgaccttgcctggaatgtgtccccatctctactctaagaaatgcgcaatggactctttggagaaagaagatattttaaaacatttttagtgtgtctgtaaatggttcagcgtgtatcagatgttgtcataggactcacatttctctcagttatatttaaaaccgttgtgtactttgtacaaaggaatactagtcatacttctataaactttacacaataaaatttcattctgg

SEQ ID NO: 1054 - DNA, 1998 bp, Homo sapiens
attttggccccagcggtgcttctaggaagtagaacgccggctcgcatgcctgcccgcccgccagcctgccgggtacggccttttccgccggggcttccagatgatggtggtgctaccccagtacaggatgaacgggattcagggtcagacggtgaggatgatgtaaatgagcaacactccggatcagacactggaagtgtagaacgtcattcagagaatgaaactagtgatcgagaagatggcctccccaaaggacatcatgtgacagactctgagaacgatgagcccttaaatcttaatgctagtgactctgaaagtgaggagcttcacaggcaaaaggacagcgactctgaatctgaggaacgtgcagagcctcctgcaagcgattctgaaaatgaggatgtcaatcagcatgggagcgactctgagagtgaagagaccaggaaattacctggtagtgactctgaaaatgaggaacttcttaatgggcatgcaagtgactcagaaaacgaagatgttgggaagcatcccgccagtgattctgagattgaggagctccagaagagtcctgctagtgactctgaaacagaagatgctctaaaacctcaaatcagtgactctgagagtgaggaacccccaaggcaccaagccagtgactccgaaaatgaggagcctcccaaacctcgaatgagtgattctgaaagtgaggagcttcctaaacctcaggtcagtgattcagaaagtgaggaacccccaaggcaccaggccagtgactctgaaaatgaggagcttcccaaacctcgtatcagtgactcagaaagtgaggaccctccgaggcaccaggccagtgactcagaaaatgaagagcttcccaaaccccgaatcagtgattcggaaagtgaggatcccccaaggaaccaggccagtgattcggaaaatgaggagctacccaaaccccgagtcagtgactctgagagtgaggggcctcagaaggggcctgccagtgactcagaaactgaggatgcgtccagacacaaacagaagccagagtcagatgatgacagcgacagggagaataagggagaggatacagaaatgcagaatgactccttccattcagacagccatatggacagaaaaaagtttcacagttctgatagtgaggaggaagaacacaaaaagcaaaaaatggacagtgatgaagatgaaaaagagggtgaggaggagaaagtagcgaagagaaaagctgctgtgctttctgatagtgaagatgaagagaaagcatcagcaaagaagagtcgtgttgtctctgatgcagatgactctgacagtgatgctgtatcagacaagtcaggcaaaagagagaagaccatagcatctgacagtgaggaagaagctgggaaagaattgtctgataagaaaaatgaagagaaggatctgtttgggagtgacagtgagtcaggcaatgaagaagaaaatcttattgcagacatatttggagaatctggtgatgaagaggaagaagaatttacatatggactttctgtcagattttgagatgatgttgcagcgaaaaaagagcatgagtggcaagcgcagacggaaccgcgatggtggcacctttattagtgatgcagacgacgtcgtgagtgccatgatcgtcaagatgaatgaagctgctgaggaagacagacagttgaacaatcaaaaaaagccagcactgaaaaaattaactttactgcctgctgtagttatgcaccttaagaagcaggaccttaaagaaacattcattgacagtggtgtgatgtctgccatcaaagaatggctctcacctctaccagataggagtttgcctgcactcaagatccgggaggagctgctgaagatcctgcaagagctgcctagtgtgagccaggagaccctgaagcatagtgggattggacgagcagtgatgtatctctataaacaccccaaggagtcaaggtctaacaaggacat

SEQ ID NO: 1055 - DNA, 2434 bp, Homo sapiens
aaagatggccggagcggcggcggcggtggccgcgggagcagcagctggagccgccgcggcagccgtgtcggtggcggctcccggccgggcctcggcgcctccgccgcccccgcccgtgtactgtgtgtgccggcagccgtacgacgtgaaccgcttcatgatcgagtgcgatatctgcaaggactggttccacggcagctgtgttggagtagaagaacatcatgctgttgacattgacctgtatcactgtcccaactgtgcagttttacatggttcctccttgatgaaaaaaaggaggaactggcacagacatgactacacagaaattgatgatggttccaaaccagtgcaagctggaactagaactttcattaaggaattacgctctcgagtcttcccaagtgccgatgaaataattataaagatgcatggcagccagctgacacaaagatatctggagaaacatggatttgatgtccctattatggtcccaaaattagatgatctaggactcaggctcccttcacctacattttctgtgatggatgtggaacgttatgtaggtggtgacaaagtgatagatgtcattgatgtggcgaggcaggcagacagcaaaatgacacttcacaattatgttaaatacttcatgaatcctaacagaccaaaagtgttaaatgtgatcagccttgaattttcagatacaaagatgtctgaattggtggaggtccctgatatagccaaaaaactttcctgggtggaaaattattggccagatgattcagtctttcccaagccatttgttcagaaatattgcttaatgggagttcaagacagctatacagatttccacattgacttcggtggaacttcagtctggtaccatgtcctctggggtgagaagattttttatttaataaagccaacagatgaaaatttggcacgttatgaatcttggagttcatctgtgacccagagtgaggtgttctttggagataaggtggataaatgctacaaatgtgtggtaaagcagggacataccttatttgttcctacagggtggatccatgctgtgctcacttctcaggactgtatggcttttggggggaacttcctgcacaaccttaacattggcatgcagctcaggtgttatgagatggagaaaaggctaaaaacaccagatcttttcaaattccctttctttgaagccatatgttggtttgtagccaaaaacttgctggaaaccctgaaagaactgagagaagatggtttccagcctcaaacttacctagtacagggagtgaaagcactgcatactgctttaaaattatggatgaaaaaagaacttgtatctgaacatgcctttgaaattccagacaatgttagacctggacaccttattaaagaactttctaaagtaattcgagcaatagaggaggaaaacggcaaaccagttaaatctcagggaattcctattgtgtgtccagtttcacgatcctcaaatgaagcaacttccccataccattcccgaagaaagatgaggaaacttcgagatcataatgtccgaactccttctaacctagacatcctagagctccacacaagggaggtcctcaaaagattagagatgtgtccatgggaagaggacatcttgagctctaaactgaatggaaaattcaacaaacatctccaaccatcctccacagtacctgaatggagagcgaaagataatgatctacgattactgctgacaaatggaagaataattaaagatgaaaggcagccctttgcagatcaaagtctttatacagcagatagtgaaaatgaagaggataaaagaaggacaaaaaaggcaaaaatgaagatagaagagagttcaggagtagagggagtggaacatgaagaatctcaaaaaccactgaatgggttttttacacgtgtgaaatcagaactcaggagtagatcatcaggatattctgatatttctgagtcagaagactccggacccgagtgcactgcactgaaaagtatctttaccactgaagagtctgaaagttcaggtgatgaaaagaaacaagaaataacatccaactttaaggaggaatctaatgtgatgaggaacttccttcaaaagagccagaagccatctagaagtgaaattccaattaaaagggaatgtcctacctcgacgagcacagaggaagaagctattcagggcatgctgtctatggcagggttgcactattccacgtgtttacaaaggcaaatacaaagcacagactgcagtggtgaaagaaactctctccaggatcccagcagctgccatggcagtaaccatgaggttaggcagttgtatcgctatgataaaccagtggaatgtgagacgaggtctcacctatgttgcccagactggtctccaactcctgagctcaagtga

SEQ ID NO: 1056 - DNA, 9272 bp, Homo sapiens
gccgccgcggctgctgcaggaggcggcgctggctggcggctgcgctcgctccagtcggcgagcggagtagcgagcgagcgtgtgtgtgttttttaaagatggccggagcggcggcggcggtggccgcgggagcagcagctggagccgccgcggcagccgtgtcggtggcggctcccggccgggcctcggcgcctccgccgcccccgcccgtgtactgtgtgtgccggcagccgtacgacgtgaaccgcttcatgatcgagtgcgatatctgcaaggactggttccacggcagctgtgttggagtagaagaacatcatgctgttgacattgacctgtatcactgtcccaactgtgcagttttacatggttcctccttgatgaaaaaaaggaggaactggcacagacatgactacacagaaattgatgatggttccaaaccagtgcaagctggaactagaactttcattaaggaattacgctctcgagtcttcccaagtgccgatgaaataattataaagatgcatggcagccagctgacacaaagatatctggagaaacatggatttgatgtccctattatggtcccaaaattagatgatctaggactcaggctcccttcacctacattttctgtgatggatgtggaacgttatgtaggtggtgacaaagtgatagatgtcattgatgtggcgaggcaggcagacagcaaaatgacacttcacaattatgttaaatacttcatgaatcctaacagaccaaaagtgttaaatgtgatcagccttgaattttcagatacaaagatgtctgaattggtggaggtccctgatatagccaaaaaactttcctgggtggaaaattattggccagatgattcagtctttcccaagccatttgttcagaaatattgcttaatgggagttcaagacagctatacagatttccacattgacttcggtggaacttcagtctggtaccatgtcctctggggtgagaagattttttatttaataaagccaacagatgaaaatttggcacgttatgaatcttggagttcatctgtgacccagagtgaggtgttctttggagataaggtggataaatgctacaaatgtgtggtaaagcagggacataccttatttgttcctacagggtggatccatgctgtgctcacttctcaggactgtatggcttttggggggaacttcctgcacaaccttaacattggcatgcagctcaggtgttatgagatggagaaaaggctaaaaacaccagatcttttcaaattccctttctttgaagccatatgttggtttgtagccaaaaacttgctggaaaccctgaaagaactgagagaagatggtttccagcctcaaacttacctagtacagggagtgaaagcactgcatactgctttaaaattatggatgaaaaaagaacttgtatctgaacatgcctttgaaattccagacaatgttagacctggacaccttattaaagaactttctaaagtaattcgagcaatagaggaggaaaacggcaaaccagttaaatctcagggaattcctattgtgtgtccagtttcacgatcctcaaatgaagcaacttccccataccattcccgaagaaagatgaggaaacttcgagatcataatgtccgaactccttctaacctagacatcctagagctccacacaagggaggtcctcaaaagattagagatgtgtccatgggaagaggacatcttgagctctaaactgaatggaaaattcaacaaacatctccaaccatcctccacagtacctgaatggagagcgaaagataatgatctacgattactgctgacaaatggaagaataattaaagatgaaaggcagccctttgcagatcaaagtctttatacagcagatagtgaaaatgaagaggataaaagaaggacaaaaaaggcaaaaatgaagatagaagagagttcaggagtagagggagtggaacatgaagaatctcaaaaaccactgaatgggttttttacacgtgtgaaatcagaactcaggagtagatcatcaggatattctgatatttctgagtcagaagactccggacccgagtgcactgcactgaaaagtatctttaccactgaagagtctgaaagttcaggtgatgaaaagaaacaagaaataacatccaactttaaggaggaatctaatgtgatgaggaacttccttcaaaagagccagaagccatctagaagtgaaattccaattaaaagggaatgtcctacctcgacgagcacagaggaagaagctattcagggcatgctgtctatggcagggttgcactattccacgtgtttacaaaggcaaatacaaagcacagactgcagtggtgaaagaaactctctccaggatcccagcagctgccatggcagtaaccatgaggttaggcagttgtatcgctatgataaaccagtggaatgtggataccatgtcaagactgaagatccagacttgaggacttcctcctggattaaacagtttgatacttccagatttcatcctcaggatctaagtagaagccagaaatgcatcagaaaggaaggttcatcagaaattagtcagagggtacaaagtaggaattatgtggacagcagcggctcaagccttcagaatggaaagtatatgcagaattcaaacctgacttcgggggcgtgccagataagtaatggcagtctaagcccagaaaggccagttggtgaaacttccttctcggtgccccttcaccccaccaagagaccggcatcaaatccaccacctatcagcaaccaggcaacaaaaggtaaacgtccaaaaaaaggaatggcaacagccaaacaacgtcttgggaagatccttaagttgaacagaaatggccatgcacgtttctttgtgtgacagagctgctgttgcagccattcttccctttggagaccagtctaggggtgcaggagcctggagcttccgctgtccccctgcctggagcagtttgtgtgtatagtaagaacactgcccgaagaacagaatgaacctgatgctgcattttcactgtgccacacccactcagcaataaccattttggacctggtgggggagaggaagaaggagggtagaaccttaaaaagagaccttgaactggaaagggtctcttgtcagggcttgaattttattttgttgttggtagtgtcttgatgtattttcagtggtagggtaaagaattatcaataatttatttaacagatttttttttaaagttaacagcttttaaattctttttttaaagctatttatttggaagatttctggagaaatatctcactaatttagatgtaagaatgtgaaggtttttaaattatttttgatagtgtgtgtgttacatgtggggaagggccacagtaacagtaactagtctggactcttaaatttgatattcaggttaaagtcttaaacagggatttgatgcattaattattttaaattaagatgtatatgaaaatcattttattttatatatttcatgtgttttttataagctattagcttcgcttttgctaacatccaaggtgcatactgttatccaggttgattaccttatatcccaccttccctctgcactccccatcattttgtgatgacccagtaagactcttctctttgcagggaaacactttcgtagccaatgtgtaagaactccatgaaagatccctcatttctcatttcgtttgacattgtgattttcttctcaacattaaaaaaaataggcttttgcattttcatttctgctgatgatatctgggtcccaaagagagcagctttaatatatttttcctacttgtgggaaaagtattataagtttggttaaattgtcatgtttatagtttttccaagtacatttgtaactacagcaggccttcttcgtactgctgctgttggacaacaggactggcacctgctgcagaggttataccttatgatacttttatgctccatacctgatttgttgggaaatgttatttaggatattcaaatctgcatcataagccgtaatataataggattaatactacattaagttgtatagaagcaagcatgttggaatagatcttttgtgtgtatttactttttttatttcttaattttctaaagaattacttaagatatggatttggagtaaaatgggtgcttttggcagtttcttccatctatcctaacctgaccagtacatattgaggttaagtatctggttaaactttaaggtattcatttatctcctttatgtatgatttttactaaatgccagttttcatttgcttatagtagcttctattttcccttttttccatccatggcataaaaataagtgatttctgggggtggggcagaaatgttcccaagtctgacaatagagcattttacaaattcctacaaagaaaatataggcaaatagataaaatttatttttatggagaagaaatatggccatattatggatttgtcttttttttactcagcaagatagcaggacttacccttctctattaagtatcacttgaattgctaagaagaaaaaagtctgtaccatcatctttcatggttgcattcaaatgtatattttcaaagagaaatacttcttgtgtccccattccaaaatgtcatgggataaatatgaaatagtttatgaagtagcctttctggttcagagtgactggaccaaagtctgaatcttatctgggtatcaggaaaaagaatttttatggaaatccttagtgtctataaacaacccgtgtaaaccctgtctacactatgccaaaaccagtggaaagatgggtagagtcatcttatctcaggatgtcaaaaatctgggtttgactgattcccctaccttcccacacagtatattcttgtgatttttgcttttctgtagatcctgagtcggtgttacaatagtcatgtttttattttgggttaagaaatacgaggtgtaagagctataatttccttttcgtgttatatcatgatctgggttttcttttttcctttacgtttttcacagctcttgagtattttctatttttttctttagtcacaaaaattaaaattaaactttatttttatgaattaaaatgaaatttaatttatttttatgaattaaaattgtggccagtatccactgtgtccttaggctgagaagtactaatttggagtagcccgtgtgtggaattctaaagtgaaggtactgtggattcatttttagtagttttagccccttaataagtggctaagttagaaaactttcagcgaggtaatagaaccacttgaatagaatccatgtgtctttttctgaattggtgaaaattcggccactgatccagtgactcctggtcaaacgtcttataacattactggccataatgcatccctttatctcatggaaatggctgaactttgtggtagctgctgcgagtacctgggcttaacagtaatagagaacctcatttataccatacagacacagcaacttaggaagacagcactgatagcatttagctagttgtaaccaaatacaaatatgtaaaattgagaattatgattaacatatgcaactttagtaataggaatagatgataattttcctgtattgtttcaaataagtgactgttcagctgggatccattggattataatttacaatgtcacataatattatgcttttcaatattgatgagtgatgtaaacaatataaagttggcagtttgtagtagttcagtatcctagaaatacattgaacttcataagtatcagttcatttttaagcatacagaattgaagattctgactgaaatcataaactcagaggaaacaagcccatctttatcactaattacttagcttgaatacttttctatttttaaataatcctaattattgccttttcaattatagtctactgtatttatttatatgggatcaacaggtatttatcaaacatctactgtgtgcccagcactacctagtactgttggggaacatcaatttgcagttgtggtctctgcccttgaaggtatcttctccaggaaattagcagtattattttcacttctaagcaaacatgagcaaaagaggacctgttcattaaaaaacatgctgacttttttagtttcaactgagatatgccactgtagaagtgaaagtaatttcacaattaaagaaatgcttcaacttggtaattaatatggtcatacagggacttggtgtagcatgcaaggaagcagaagacctgggcttttgtcgaagttctgccatttaggtatcagctgtgtaaccttgaataagtcacttaactctttctcttagttttctcatttgtaaatttggattaaagtgtttattatgataatcaattaagaaaatctcttaacacttcatacatacagagaacttatcattaagttaaaactggcaattaatgcacctttatatatatttttaaatgaaaactaatactattcatgatgtttattttatatcaaatatatgcccagggcatgctactttaaaaatccgaggaatctccaacaaggtgctggattaaaatcagatttcgtgcttgaagtggaagaaaaatgaagttgtttatggataagagagtgagaatgtgtatcctcaagtacgttaagatgatttaactgaaagatggctttaggtttttcttgaagaattaggaaagtaccatccccacagattcagcatactcttcaggtactagataaaggtgaaggaagtcatggaattaaaatgacttagcaactccccagggaacttgtggggagaatgaggtggttagaaaggtgagaatgcacaaagacagctctgggttgggtaccaacagtttgcttggtagaaagaaaccagtgtaggaaaggagacgccaccagacatcttcaacagacaagattctttctgcctttttcaaaagatgctctctgcagcagtaagactatagatagagttgattggaatatcatgtgacccagtatgctactgctaggcataattatcaaaaattcatttttctcattaaatattgttaattgctcgccacataaagagaagctagagctcaccagtcttggtggtgtcctagaccttcctctaaagcagtcttgggaagctggatcatcagatctttagcctagacagagtgtcgctggtaaataaaggagacacaggtaacccagagtggacagtgatttgcgtggggagacacagtggatctggggcctctgatactttgcttcctaaaacagcccccagttttcggcttgccctatgagatgatgttcatgtgcttccttgaaaccaggtggaaagaaaggggaagaattaattttctcattctgttgctgttgaacgtaatgtaatcttaatactgtagccttcctagaagcccttccctctttttcatgctgtaaagtcaaatatttgatatccttaacataaattttaaaaattaaggtcattaggaagcaaatgtctatttccaaagcaatgagcttgttgtgactgtgattttattcttctatagtatttttttcctcattttaactgagaggagaaaataatactcttttgcaatatccttaggttctccccttccccctggtgccccttctagtgtcttaagactttgtcttaacaagtataacattacattttgttgttaaaacctttcgaaactgtattcagtgattcttccaagtttatctgctctgcactatttcactaataaaccctggctaccacgtagcccttgatctccaagtagtttacctatgcaagacctgtgacactctgaattcacttctctttctttcagaaagtagtcataaatggagcttaattataaaggtaaaacttgtctccaaccagtttcattttggccatttctttttcaaaatgtcagctgttttcctccaagatttttcaccaaaacaatgatcataagtgctggaatatataatactttgcaggcataaaataacccagacatactctcatatttctttggtgtattttggttggtaaaacttaccagcattaaatgtaaaatataatgaggagttaattccttacctagaactatttcttccttttaagattcataagtaaccttttatttttacagagctacgtataacttccacattacagtcagggacctgaggtgtaacttactaagtgaaccccaaggttattttatcttgcaaaagaaacctaaaccaaactaagggccttacagtttatggttagactgaatcaaaagctataacctcaatttttccaaaaacagcttctgactgcaaaagcaagtcatacagttgttaggtatgaaatagcactgatcaggaaatgcatcttcgcagatggtatttccttcagaaaagacttttctacttttaatataaattaagccataacagtttcatgctgtggaaagagggtgaaaaggttcattttaagagattatataatatgaactttcacatttactgtgaaatgtctaactttgccagtgcttcagcaagtttttttggggggtgatggggaggggtagtattggttttagaggtttcaaatctgtgaactttggagaggggacagttgttggctctggtatttactagttttgtagtaacgttttgctagcctgactgacttttcttactggtttttatgcccacggtccgaggggactgttcttcttgttgggggtgtctgcggaatagcgtctcgtcttgtttgtataggcagtcaatgtgtgtgacatgtgtgtcctttcagtccggaagcccactgtgtgacaatggcgtggggtgtggctgggaggtggggtgctgaagcttgaagagcatttctttgctgattcataacagtatttcccatcttttgcctgcaggcagggaaagtgtacagtatttattttgtttctgttttactttaaatttgtaagtctttaagtagcttacattgattattataggggaggacaagtgacttgtttaaagttgtatttagtattctttccaatttctgtattttaaaatattgaaattaaaattgtattacttctgttttgatttttttagcacttagtgtattttttgctcattttgtttgaaagtataaatgttgaaaattgtataaaatgcgtccttgaaagaaaaagaatctgaattctatatccaa

SEQ ID NO: 1057 - DNA, 8536 bp, Homo sapiens
gcggtggcggcggctgggctgcctcggggtcttcgacggccgcgttgggttttgtttcagttttcttgtgtggcgctgcagcacaaggctgcgaatctgggagtccaaaggagtgtttgcggggagggcccgaggtcgctgtgtccggggcagagcggccggttcgtcccgagtctgcgctctttcgggtccgctgctgtgtcccggtccgctctcctcagcatgagcggccggtaggagtgaggtttcatcggttccctcgcactggaggaggcagcggccgcttcggcagcgacagctatggcggtagagacgcgggcagagctggtgggtaagcggttcctgtgtgtggcggtcggcgacgaggcacgttcggagcgctgggagagcggacgcggctggcgaagctggcgagcgggggtcatccgagccgtgtcacacagggacagccgcaatccggacctggcggtgtatgtggaatttgatgatcttgaatgggataaacgagagtgggttaaagtttatgaagatttttcaactttcttggtggaataccacttaatctgggccaaaaggaatgaccctagccagactcagggatcaaagagcaaacagattcagtggcctgcattgactttcaaacctctggttgaaagaaatatacccagttcagtcactgcagtagaattccttgtagataagcaactggattttttaactgaagatagtgcctttcagccctaccaggacgacatagacagcctaaacccagttctcagggacaacccgcagcttcatgaggaagtgaaagtctgggtaaaggaacaaaaggttcaggagatttttatgcaaggtccttattccttaaatggatacagagtgagagtatatagacaagactctgccacccagtggtttactggcataattactcatcatgatctcttcacccgcaccatgatcgttatgaatgatcaggtactagaaccacagaatgtcgatccttctatggttcaaatgacctttctagatgatgttgttcactctttgttaaaaggtgaaaatattggcattacatcacgacgcaggtctcgtgccaatcaaaacgtcaacgctgttcacagccattatacacgtgcccaagcaaatagtcccagaccagcaatgaactcccaagctgctgtaccaaaacagaatacacaccagcaacagcaacaaagaagtatccgtccaaataagaggaagggctcagatagcagtataccagatgaagagaagatgaaggaggaaaaatatgattatatatcacgaggagaaaatcctaaaggtaaaaacaaacacttgatgaataaaagaaggaaacctgaggaggatgaaaagaaactaaatatgaaaagacttcgaactgacaatgtttcagacttttctgagagcagtgactcagaaaattcaaataagagaataatagataattcctcagaacagaagccagagaatgaattgaaaaataaaaatacttcaaaaataaatggagaagaaggaaaaccccataataatgagaaggcaggagaagagaccctaaaaaatagccagcctccctgggatcaaatacaggaagataaaaaacatgaagaagcagagaagcggaagtctgttgacactcagcttcaagaagatatgattattcattcgtcagaacagtccacagtttctgatcataattctaatgatttacttcctcaggaatgcaatatggataaaacacataccatggaattgctaccaaaggagaagtttgtatccagaccacccacaccaaaatgtgttattgatattacaaatgacactaatttagaaaaggtggctcaggaaaactcaagtacctttggccttcagacacttcagaaaatggatcctaatgttagtgattcaaaacactctattgcaaatgcaaaattcttggaaacagcaaaaaaagattctgaccagagctgggtcagtgatgtagttaaagtggatctaacccaatcaagtgttacaaatgcttcttcaggaaatgatcacttgaacatggaaaaagagaagtatgtctcttacatttctcctttaagtgcagtttctgtcatggaagataagctgcataagcgaagtccacctccagagactataaaatctaaacttaatacttcagtagatactcacaagataaaatccagcccatcacctgaagttgttaaacccaaaataactcattctcctgattctgtaaagtctaaggccacttatgtgaacagccaagctactggtgaaagaagattggcaaataagatagaacatgagctatcaagatgcagttttcatccaattcctactcgaagcagtacattagaaactacaaagagtcctcttatcattgataaaaatgagcattttacagtttacagagatcctgcacttattgggtcagaaacaggagctaatcatatttcacctttcctaagccagcatccttttcctcttcactcctcatctcatagaacctgtttaaatccaggtacccatcatcctgccttaactcctgcaccccatttactagccggatcatctagtcaaactccattacctaccattaacactcatcctctgactagtggtccacaccatgctgttcatcaccctcatttacttcccactgtgttacctggagtgcctactgcctccttacttggtggccacccacgactagagagtgctcatgccagcagcttgagccacttagcgctagcacaccagcaacaacaacagttgttacagcaccagtcacctcatcttcttggacaagcccatccttctgcttcatataatcagcttggactttatccaattatttggcagtatccaaatggaacacatgcatactcaggacttggtttgccttcttctaagtgggttcacccagaaaatgcagttaatgctgaagcttcattaaggaggaattctcccagtccttggctacatcagcccacccctgtgacctcagcagatggtattggattacttagtcacattcctgtcagaccttccagtgcagagcctcatcggcctcttaaaattacagcccattccagtccaccattgacaaaaactttagtagatcatcataaggaagaattagaaagaaaagcttttatggaaccattacggtctgttgcatccacatcagccaaaaatgacctggatctaaataggtcacagactggaaaagattgtcacttacataggcattttgtggatccagtattaaatcagttacagaggccaccccaggagactggagagaggttaaacaaatacaaagaggaacaccgtcgaattcttcaagaaagtattgatgttgctccctttacaactaaaatcaagggacttgagggtgagagagagaattattccagagtggcatcatcatcttccagtcctaaaagccatatcatcaaacaagatatggatgtagaacgctcagtatcagatctttataaaatgaagcactcagtgcctcagagtttaccccaaagtaactatttcactacattgtctaatagtgtggtcaatgaaccaccaagatcatacccatccaaagaagtttcaaatatttacggtgataaacagagtaatgcccttgcagcggcagcagctaatcctcaaactctgacttcatttataacatctctttcaaagcctccacctttgattaaacaccaaccagaaagtgaaggtttagtaggcaagataccagaacatcttccacatcagattgcatctcactcagtaacaaccttcagaaatgattgtaggagtcctacccatttgacagtttcttctacaaatacactccgcagtatgcctgcattacatagagcaccagtatttcacccaccaatccatcacagcctggaaagaaaggaaggcagctatagtagtctttcccctccaactttaactccggtgatgccagtaaatgctggtggtaaagttcaagaatcacagaagcctccaactctaatacccgaaccaaaagactcccaggcaaattttaagagttcttcagaacagagtttgacggagatgtggagacctaataataacctcagcaaagagaaaactgaatggcatgtggagaaaagcagcggaaagttacaggctgctatggcatctgtcattgtgcgtccatcttctagtacaaaaactgatagtatgccagcaatgcagttagcttctaaagatcgtgttagtgaaagatcttcagctggggcacataaaacagattgcctcaaactagcagaagccggagaaactggaagaatcattttgccaaatgtgaattcagacagtgttcacacaaaatctgaaaaaaactttcaggctgtctcacagggcagtgttcccagttcagtcatgtctgctgtaaatacgatgtgtaataccaaaacggatgtaatcacatctgctgccgatactaccagtgtttccagctggggtggttcagaagtaatttcctctttatcaaataccattttggcctctacatcatcagaatgtgtatcttcaaaaagtgtcagtcagccagtggctcaaaaacaagaatgcaaggtcagcaccacagcaccagttacattagccagtagtaagacaggaagtgttgttcaacccagttctgggttctcaggcacaactgattttatccatttaaaaaagcacaaggcagcattggctgcagctcagtataaaagtagtaatgccagtgagactgaacctaatgctataaaaaatcagacactttcagcctcccttcctctggatagcactgtaatctgtagtacaattaacaaagcaaactctgtaggaaatgggcaagcttcccagacaagtcaaccaaactaccatactaaactgaaaaaggcctggctcaccagacactcagaagaagataaaaatactaataaaatggaaaattcagggaattctgtatcagaaattattaagccatgttctgtcaacttaatagcctctacatctagtgatatacaaaatagtgtagatagtaagatcatagttgataaatatgtaaaagatgataaagtcaacaggagaaaagccaaaagaacttatgaatctggctctgaaagtggagactcagatgaaagtgaaagcaagtcagagcaaaggactaaaagacaacctaagccaacttacaaaaagaagcaaaatgatttgcaaaagagaaaaggtgaaatagaagaagatttgaaacccaatggagttctcagcaggagtgccaaagaaagaagtaaactgaagttgcaaagcaacagtaatagttgtcatttagtaaaaacggagtagttagaatagatggtttctcttctcctgaccaatatgatgatgaagctatgagtttgtggacacatgaaaattttgaagatgatgaactagatatagagacttctaaatatatcttggatataataggtgataagttctgtcaattagtaacatctgaaaaaacagctttgtcctgggtgaaaaaggatgccaaaattgcctggaaaagagcagtgagaggagtccgggagatgtgtgatgcatgtgaagcaacattgtttaacattcactgggtctgccaaaaatgtggatttgtggtctgcttagattgttacaaggcaaaggaaaggaagagttctagagataaagaactatatgcttggatgaagtgtgtgaagggacagcctcatgatcacaaacatttaatgccaacccaaattatacctggttctgttttgacagatcttctagatgccatgcacactcttagggaaaaatatggtattaaatcccattgtcattgtactaacaaacagaatttacaagttggaaattttcctacaatgaatggtgtatctcaagttttacagaatgttcttaatcacagtaataaaatttctctgtgcatgcctgagtctcagcagcaaaatactcctccgaagtctgagaaaaatggtggcagcagcccagagagtgatgtaggcacagataacaagttaactcctccagaatcccagtcaccactgcactggttagcagatcttgcagagcaaaaagccagagaggaaaaaaaagaaaacaaagaacttacccttgaaaaccaaattaaagaagaaagagaacaagacaactctgaatctccaaatggcagaacatcacctcttgtgtcccagaataatgaacaaggctcaaccttacgggatttgctgactacaacagctggaaagctacgtgtggggtctacagatgctggcattgcctttgccccagtatattcaatgggagccccaagtagcaaaagtggacggactatgcctaacattcttgatgacataattgcttcagttgttgaaaacaaaattccaccaagtaaaacctccaagataaatgtaaaaccagagcttaaagaagagcctgaagaaagcataatatctgcagtggatgaaaataataaattatacagtgatataccacattcttggatctgtgagaagcatattttatggcttaaggattataagaatagcagtaattggaagcttttcaaagaatgttggaaacaaggacagcctgcagtggtttctggtgtgcataagaaaatgaacattagcctatggaaggcggaatcaattagtcttgattttggagaccaccaagctgatctcctgaactgcaaagatagcatcatttcaaatgccaatgttaaggaattctgggatggttttgaagaagtttcaaaacggcagaaaaacaagagtggagaaacagttgttttaaaattgaaagactggccttcaggagaagacttcaagactatgatgccagcaagatacgaagatcttttaaaaagtctgccattgccagaatattgtaatccagaaggaaaattcaatttggcctctcatttgccaggattttttgtacgtcctgatctaggacccaggttgtgcagtgcctatggtgtagttgctgctaaagatcatgatataggaacaacaaatctccatattgaagtttctgatgttgtaaatatactagtttatgttggcatagcaaaaggaaatggcattctctcaaaagcaggaattctcaagaaatttgaggaagaagatttggatgacattttaaggaaaagattgaaggactcaagtgaaatacctggtgctctgtggcatatttatgctgggaaagatgttgacaagataagggaatttcttcaaaagatttcaaaagaacaaggccttgaagttctaccagaacatgatccaatacgtgaccaaagttggtatgtgaacaaaaagctccgtcaaaggctgcttgaagaatatggagtcagaacctgtactcttattcagttccttggtgatgctattgttttgccagcgggagcacttcatcaggttcagaattttcacagctgtattcaggtaactgaagattttgtgtctccagaacatcttgtagagtcatttcatttaacacaggaactgagacttttgaaggaagaaatcaattatgatgataaactacaggttaaaaatattttgtatcatgcagtcaaagaaatggtgagagccttgaagatacacgaggatgaagtagaggatatggaagaaaattaagtgtgatccagtttgatatttttaggttgttgaactgggattacttaaccttgaatgatgatatgtatgcacactgactttaagcttcataaaaccatcagtgccaagaaattctctttgtagtaattacttgttactgacaccacagcagtatagcatatgtcacagctcctgtgattcaatgttataaaacaagcagaattttaaaagcagcactatatagctgttttgtattatagtgtatatgatgtttgtgaaaatgccagatttaaaatgatgtatttatttttggtaaaaaataaaaaattctatgctatattgttgatcaagtgtaaatgtgaccttgtacagtttactaaaattactgatatttttcactacattgagacagttactgtgagaataggacacaaacaccagctattgcctgcatctgggaaattgctgaatcgcacagcagtcatgtcataatcagaaaattactgccaaataattgtaaaatttgtaaagtataaagtatataaagtagatactaaatacagacacttcaatattttgttgaagctattgactgtacaattaaacattttcaaaaggtgtaatttatttaaaattgtctcattttggtaaaatttatgtgaacttttaaagctaaatattaaacttaatatgctatgtaaatatatacatatatacatttaatgatgtatttttttaaaacattggcttgcttttgttaaagtgcaagtgttacatatggctttgtacattaaagttgaaaggggttttacattttccattaaaaggactttatc

SEQ ID NO: 1058 - DNA, 8666 bp, Homo sapiens
cacaaggctgcgaatctgggagtccaaaggagtgtttgcggggagggcccgaggtcgctgtgtccggggcagagcggccggttcgtcccgagtctgcgctctttcgggtccgctgctgtgtcccggtccgctctcctcagcatgagcggccggtaggagtgaggtttcatcggttccctcgcactggaggaggcagcggccgcttcggcagcgacagctatggcggtagagacgcgggcagagctggtgggtaagcggttcctgtgtgtggcggtcggcgacgaggcacgttcggagcgctgggagagcggacgcggctggcgaagctggcgagcgggggtcatccgagccgtgtcacacagggacagccgcaatccggacctggcggtgtatgtggaatttgatgatcttgaatgggataaacgagagtgggttaaagtttatgaagatttttcaactttcttggtggaataccacttaatctgggccaaaaggaatgaccctagccagactcagggatcaaagagcaaacagattcagtggcctgcattgactttcaaacctctggttgaaagaaatatacccagttcagtcactgcagtagaattccttgtagataagcaactggattttttaactgaagatagtgcctttcagccctaccaggacgacatagacagcctaaacccagttctcagggacaacccgcagcttcatgaggaagtgaaagtctgggtaaaggaacaaaaggttcaggagatttttatgcaaggtccttattccttaaatggatacagagtgagagtatatagacaagactctgccacccagtggtttactggcataattactcatcatgatctcttcacccgcaccatgatcgttatgaatgatcaggtactagaaccacagaatgtcgatccttctatggttcaaatgacctttctagatgatgttgttcactctttgttaaaaggtgaaaatattggcattacatcacgacgcaggtctcgtgccaatcaaaacgtcaacgctgttcacagccattatacacgtgcccaagcaaatagtcccagaccagcaatgaactcccaagctgctgtaccaaaacagaatacacaccagcaacagcaacaaagaagtatccgtccaaataagaggaagggctcagatagcagtataccagatgaagagaagatgaaggaggaaaaatatgattatatatcacgaggagaaaatcctaaaggtaaaaacaaacacttgatgaataaaagaaggaaacctgaggaggatgaaaagaaactaaatatgaaaagacttcgaactgacaatgtttcagacttttctgagagcagtgactcagaaaattcaaataagagaataatagataattcctcagaacagaagccagagaatgaattgaaaaataaaaatacttcaaaaataaatggagaagaaggaaaaccccataataatgagaaggcaggagaagagaccctaaaaaatagccagcctccctgggatcaaatacaggaagataaaaaacatgaagaagcagagaagcggaagtctgttgacactcagcttcaagaagatatgattattcattcgtcagaacagtccacagtttctgatcataattctaatgatttacttcctcaggaatgcaatatggataaaacacataccatggaattgctaccaaaggagaagtttgtatccagaccacccacaccaaaatgtgttattgatattacaaatgacactaatttagaaaaggtggctcaggaaaactcaagtacctttggccttcagacacttcagaaaatggatcctaatgttagtgattcaaaacactctattgcaaatgcaaaattcttggaaacagcaaaaaaagattctgaccagagctgggtcagtgatgtagttaaagtggatctaacccaatcaagtgttacaaatgcttcttcaggaaatgatcacttgaacatggaaaaagagaagtatgtctcttacatttctcctttaagtgcagtttctgtcatggaagataagctgcataagcgaagtccacctccagagactataaaatctaaacttaatacttcagtagatactcacaagataaaatccagcccatcacctgaagttgttaaacccaaaataactcattctcctgattctgtaaagtctaaggccacttatgtgaacagccaagctactggtgaaagaagattggcaaataagatagaacatgagctatcaagatgcagttttcatccaattcctactcgaagcagtacattagaaactacaaagagtcctcttatcattgataaaaatgagcattttacagtttacagagatcctgcacttattgggtcagaaacaggagctaatcatatttcacctttcctaagccagcatccttttcctcttcactcctcatctcatagaacctgtttaaatccaggtacccatcatcctgccttaactcctgcaccccatttactagccggatcatctagtcaaactccattacctaccattaacactcatcctctgactagtggtccacaccatgctgttcatcaccctcatttacttcccactgtgttacctggagtgcctactgcctccttacttggtggccacccacgactagagagtgctcatgccagcagcttgagccacttagcgctagcacaccagcaacaacaacagttgttacagcaccagtcacctcatcttcttggacaagcccatccttctgcttcatataatcagcttggactttatccaattatttggcagtatccaaatggaacacatgcatactcaggacttggtttgccttcttctaagtgggttcacccagaaaatgcagttaatgctgaagcttcattaaggaggaattctcccagtccttggctacatcagcccacccctgtgacctcagcagatggtattggattacttagtcacattcctgtcagaccttccagtgcagagcctcatcggcctcttaaaattacagcccattccagtccaccattgacaaaaactttagtagatcatcataaggaagaattagaaagaaaagcttttatggaaccattacggtctgttgcatccacatcagccaaaaatgacctggatctaaataggtcacagactggaaaagattgtcacttacataggcattttgtggatccagtattaaatcagttacagaggccaccccaggagactggagagaggttaaacaaatacaaagaggaacaccgtcgaattcttcaagaaagtattgatgttgctccctttacaactaaaatcaagggacttgagggtgagagagagaattattccagagtggcatcatcatcttccagtcctaaaagccatatcatcaaacaagatatggatgtagaacgctcagtatcagatctttataaaatgaagcactcagtgcctcagagtttaccccaaagtaactatttcactacattgtctaatagtgtggtcaatgaaccaccaagatcatacccatccaaagaagtttcaaatatttacggtgataaacagagtaatgcccttgcagcggcagcagctaatcctcaaactctgacttcatttataacatctctttcaaagcctccacctttgattaaacaccaaccagaaagtgaaggtttagtaggcaagataccagaacatcttccacatcagattgcatctcactcagtaacaaccttcagaaatgattgtaggagtcctacccatttgacagtttcttctacaaatacactccgcagtatgcctgcattacatagagcaccagtatttcacccaccaatccatcacagcctggaaagaaaggaaggcagctatagtagtctttcccctccaactttaactccggtgatgccagtaaatgctggtggtaaagttcaagaatcacagaagcctccaactctaatacccgaaccaaaagactcccaggcaaattttaagagttcttcagaacagagtttgacggagatgtggagacctaataataacctcagcaaagagaaaactgaatggcatgtggagaaaagcagcggaaagttacaggctgctatggcatctgtcattgtgcgtccatcttctagtacaaaaactgatagtatgccagcaatgcagttagcttctaaagatcgtgttagtgaaagatcttcagctggggcacataaaacagattgcctcaaactagcagaagccggagaaactggaagaatcattttgccaaatgtgaattcagacagtgttcacacaaaatctgaaaaaaactttcaggctgtctcacagggcagtgttcccagttcagtcatgtctgctgtaaatacgatgtgtaataccaaaacggatgtaatcacatctgctgccgatactaccagtgtttccagctggggtggttcagaagtaatttcctctttatcaaataccattttggcctctacatcatcagaatgtgtatcttcaaaaagtgtcagtcagccagtggctcaaaaacaagaatgcaaggtcagcaccacagcaccagttacattagccagtagtaagacaggaagtgttgttcaacccagttctgggttctcaggcacaactgattttatccatttaaaaaagcacaaggcagcattggctgcagctcagtataaaagtagtaatgccagtgagactgaacctaatgctataaaaaatcagacactttcagcctcccttcctctggatagcactgtaatctgtagtacaattaacaaagcaaactctgtaggaaatgggcaagcttcccagacaagtcaaccaaactaccatactaaactgaaaaaggcctggctcaccagacactcagaagaagataaaaatactaataaaatggaaaattcagggaattctgtatcagaaattattaagccatgttctgtcaacttaatagcctctacatctagtgatatacaaaatagtgtagatagtaagatcatagttgataaatatgtaaaagatgataaagtcaacaggagaaaagccaaaagaacttatgaatctggctctgaaagtggagactcagatgaaagtgaaagcaagtcagagcaaaggactaaaagacaacctaagccaacttacaaaaagaagcaaaatgatttgcaaaagagaaaaggtgaaatagaagaagatttgaaacccaatggagttctcagcaggagtgccaaagaaagaagtaaactgaagttgcaaagcaacagtaatactggcattcctcgttcagtattgaaagattggcgtaaagtcaagaagctgaagcaaactggggaatcctttttacaggatgactcctgctgtgagatagggcctaatttacaaaagtgtcgagaatgtagacttattcgcagtaaaaaaggagaagaaccagctcactcaccagtattttgtagattttactactttagacggttgtcatttagtaaaaacggagtagttagaatagatggtttctcttctcctgaccaatatgatgatgaagctatgagtttgtggacacatgaaaattttgaagatgatgaactagatatagagacttctaaatatatcttggatataataggtgataagttctgtcaattagtaacatctgaaaaaacagctttgtcctgggtgaaaaaggatgccaaaattgcctggaaaagagcagtgagaggagtccgggagatgtgtgatgcatgtgaagcaacattgtttaacattcactgggtctgccaaaaatgtggatttgtggtctgcttagattgttacaaggcaaaggaaaggaagagttctagagataaagaactatatgcttggatgaagtgtgtgaagggacagcctcatgatcacaaacatttaatgccaacccaaattatacctggttctgttttgacagatcttctagatgccatgcacactcttagggaaaaatatggtattaaatcccattgtcattgtactaacaaacagaatttacaagttggaaattttcctacaatgaatggtgtatctcaagttttacagaatgttcttaatcacagtaataaaatttctctgtgcatgcctgagtctcagcagcaaaatactcctccgaagtctgagaaaaatggtggcagcagcccagagagtgatgtaggcacagataacaagttaactcctccagaatcccagtcaccactgcactggttagcagatcttgcagagcaaaaagccagagaggaaaaaaaagaaaacaaagaacttacccttgaaaaccaaattaaagaagaaagagaacaagacaactctgaatctccaaatggcagaacatcacctcttgtgtcccagaataatgaacaaggctcaaccttacgggatttgctgactacaacagctggaaagctacgtgtggggtctacagatgctggcattgcctttgccccagtatattcaatgggagccccaagtagcaaaagtggacggactatgcctaacattcttgatgacataattgcttcagttgttgaaaacaaaattccaccaagtaaaacctccaagataaatgtaaaaccagagcttaaagaagagcctgaagaaagcataatatctgcagtggatgaaaataataaattatacagtgatataccacattcttggatctgtgagaagcatattttatggcttaaggattataagaatagcagtaattggaagcttttcaaagaatgttggaaacaaggacagcctgcagtggtttctggtgtgcataagaaaatgaacattagcctatggaaggcggaatcaattagtcttgattttggagaccaccaagctgatctcctgaactgcaaagatagcatcatttcaaatgccaatgttaaggaattctgggatggttttgaagaagtttcaaaacggcagaaaaacaagagtggagaaacagttgttttaaaattgaaagactggccttcaggagaagacttcaagactatgatgccagcaagatacgaagatcttttaaaaagtctgccattgccagaatattgtaatccagaaggaaaattcaatttggcctctcatttgccaggattttttgtacgtcctgatctaggacccaggttgtgcagtgcctatggtgtagttgctgctaaagatcatgatataggaacaacaaatctccatattgaagtttctgatgttgtaaatatactagtttatgttggcatagcaaaaggaaatggcattctctcaaaagcaggaattctcaagaaatttgaggaagaagatttggatgacattttaaggaaaagattgaaggactcaagtgaaatacctggtgctctgtggcatatttatgctgggaaagatgttgacaagataagggaatttcttcaaaagatttcaaaagaacaaggccttgaagttctaccagaacatgatccaatacgtgaccaaagttggtatgtgaacaaaaagctccgtcaaaggctgcttgaagaatatggagtcagaacctgtactcttattcagttccttggtgatgctattgttttgccagcgggagcacttcatcaggttcagaattttcacagctgtattcaggtaactgaagattttgtgtctccagaacatcttgtagagtcatttcatttaacacaggaactgagacttttgaaggaagaaatcaattatgatgataaactacaggttaaaaatattttgtatcatgcagtcaaagaaatggtgagagccttgaagatacacgaggatgaagtagaggatatggaagaaaattaagtgtgatccagtttgatatttttaggttgttgaactgggattacttaaccttgaatgatgatatgtatgcacactgactttaagcttcataaaaccatcagtgccaagaaattctctttgtagtaattacttgttactgacaccacagcagtatagcatatgtcacagctcctgtgattcaatgttataaaacaagcagaattttaaaagcagcactatatagctgttttgtattatagtgtatatgatgtttgtgaaaatgccagatttaaaatgatgtatttatttttggtaaaaaataaaaaattctatgctatattgttgatcaagtgtaaatgtgaccttgtacagtttactaaaattactgatatttttcactacattgagacagttactgtgagaataggacacaaacaccagctattgcctgcatctgggaaattgctgaatcgcacagcagtcatgtcataatcagaaaattactgccaaataattgtaaaatttgtaaagtataaagtatataaagtagatactaaatacagacacttcaatattttgttgaagctattgactgtacaattaaacattttcaaaaggtgtaatttatttaaaattgtctcattttggtaaaatttatgtgaacttttaaagctaaatattaaacttaatatgctatgtaaatatatacatatatacatttaatgatgtatttttttaaaacattggcttgcttttgttaaagtgcaagtgttacatatggctttgtacattaaagttgaaaggggttttacattttccattaaaaggactttatcaaaaattga

SEQ ID NO: 1059 - DNA, 8391 bp, Homo sapiens
tcgttctcatttgggtgtctgcactgttggaagctactgcactgtgtttccacgcagacagagtacagtgggaaaggctttctccagctgatggatggctgttctctttatttggagtatcttactggttatgtaagcgacctcgagagaaattatcctgacccagatcggaggatgcagtagtgcttcagctgcaggatttcttagtcgttaacaccacagtgctgatgacaaagagcgagttgtaatcctcatcactgccagggctgagccagagcagacagaaaatcgtcatttgctcgttggagacttgttaggttacagctcctgcttcgttctgtggtcttggcttttcttcctatacaatgacgccgctgcaagtgagctcagaaatgcttggtttgagagccatttgcctgtgatttttgaagactaaagaagtatttacactagatactcttccagaacaaaatagaaatttcagcaaatacttactgacctttaaagccttgttgtggatttctgagatttaaagatactttaaaattctcaagaacaaagtccttattccttaaatggatacagagtgagagtatatagacaagactctgccacccagtggtttactggcataattactcatcatgatctcttcacccgcaccatgatcgttatgaatgatcaggtactagaaccacagaatgtcgatccttctatggttcaaatgacctttctagatgatgttgttcactctttgttaaaaggtgaaaatattggcattacatcacgacgcaggtctcgtgccaatcaaaacgtcaacgctgttcacagccattatacacgtgcccaagcaaatagtcccagaccagcaatgaactcccaagctgctgtaccaaaacagaatacacaccagcaacagcaacaaagaagtatccgtccaaataagaggaagggctcagatagcagtataccagatgaagagaagatgaaggaggaaaaatatgattatatatcacgaggagaaaatcctaaaggtaaaaacaaacacttgatgaataaaagaaggaaacctgaggaggatgaaaagaaactaaatatgaaaagacttcgaactgacaatgtttcagacttttctgagagcagtgactcagaaaattcaaataagagaataatagataattcctcagaacagaagccagagaatgaattgaaaaataaaaatacttcaaaaataaatggagaagaaggaaaaccccataataatgagaaggcaggagaagagaccctaaaaaatagccagcctccctgggatcaaatacaggaagataaaaaacatgaagaagcagagaagcggaagtctgttgacactcagcttcaagaagatatgattattcattcgtcagaacagtccacagtttctgatcataattctaatgatttacttcctcaggaatgcaatatggataaaacacataccatggaattgctaccaaaggagaagtttgtatccagaccacccacaccaaaatgtgttattgatattacaaatgacactaatttagaaaaggtggctcaggaaaactcaagtacctttggccttcagacacttcagaaaatggatcctaatgttagtgattcaaaacactctattgcaaatgcaaaattcttggaaacagcaaaaaaagattctgaccagagctgggtcagtgatgtagttaaagtggatctaacccaatcaagtgttacaaatgcttcttcaggaaatgatcacttgaacatggaaaaagagaagtatgtctcttacatttctcctttaagtgcagtttctgtcatggaagataagctgcataagcgaagtccacctccagagactataaaatctaaacttaatacttcagtagatactcacaagataaaatccagcccatcacctgaagttgttaaacccaaaataactcattctcctgattctgtaaagtctaaggccacttatgtgaacagccaagctactggtgaaagaagattggcaaataagatagaacatgagctatcaagatgcagttttcatccaattcctactcgaagcagtacattagaaactacaaagagtcctcttatcattgataaaaatgagcattttacagtttacagagatcctgcacttattgggtcagaaacaggagctaatcatatttcacctttcctaagccagcatccttttcctcttcactcctcatctcatagaacctgtttaaatccaggtacccatcatcctgccttaactcctgcaccccatttactagccggatcatctagtcaaactccattacctaccattaacactcatcctctgactagtggtccacaccatgctgttcatcaccctcatttacttcccactgtgttacctggagtgcctactgcctccttacttggtggccacccacgactagagagtgctcatgccagcagcttgagccacttagcgctagcacaccagcaacaacaacagttgttacagcaccagtcacctcatcttcttggacaagcccatccttctgcttcatataatcagcttggactttatccaattatttggcagtatccaaatggaacacatgcatactcaggacttggtttgccttcttctaagtgggttcacccagaaaatgcagttaatgctgaagcttcattaaggaggaattctcccagtccttggctacatcagcccacccctgtgacctcagcagatggtattggattacttagtcacattcctgtcagaccttccagtgcagagcctcatcggcctcttaaaattacagcccattccagtccaccattgacaaaaactttagtagatcatcataaggaagaattagaaagaaaagcttttatggaaccattacggtctgttgcatccacatcagccaaaaatgacctggatctaaataggtcacagactggaaaagattgtcacttacataggcattttgtggatccagtattaaatcagttacagaggccaccccaggagactggagagaggttaaacaaatacaaagaggaacaccgtcgaattcttcaagaaagtattgatgttgctccctttacaactaaaatcaagggacttgagggtgagagagagaattattccagagtggcatcatcatcttccagtcctaaaagccatatcatcaaacaagatatggatgtagaacgctcagtatcagatctttataaaatgaagcactcagtgcctcagagtttaccccaaagtaactatttcactacattgtctaatagtgtggtcaatgaaccaccaagatcatacccatccaaagaagtttcaaatatttacggtgataaacagagtaatgcccttgcagcggcagcagctaatcctcaaactctgacttcatttataacatctctttcaaagcctccacctttgattaaacaccaaccagaaagtgaaggtttagtaggcaagataccagaacatcttccacatcagattgcatctcactcagtaacaaccttcagaaatgattgtaggagtcctacccatttgacagtttcttctacaaatacactccgcagtatgcctgcattacatagagcaccagtatttcacccaccaatccatcacagcctggaaagaaaggaaggcagctatagtagtctttcccctccaactttaactccggtgatgccagtaaatgctggtggtaaagttcaagaatcacagaagcctccaactctaatacccgaaccaaaagactcccaggcaaattttaagagttcttcagaacagagtttgacggagatgtggagacctaataataacctcagcaaagagaaaactgaatggcatgtggagaaaagcagcggaaagttacaggctgctatggcatctgtcattgtgcgtccatcttctagtacaaaaactgatagtatgccagcaatgcagttagcttctaaagatcgtgttagtgaaagatcttcagctggggcacataaaacagattgcctcaaactagcagaagccggagaaactggaagaatcattttgccaaatgtgaattcagacagtgttcacacaaaatctgaaaaaaactttcaggctgtctcacagggcagtgttcccagttcagtcatgtctgctgtaaatacgatgtgtaataccaaaacggatgtaatcacatctgctgccgatactaccagtgtttccagctggggtggttcagaagtaatttcctctttatcaaataccattttggcctctacatcatcagaatgtgtatcttcaaaaagtgtcagtcagccagtggctcaaaaacaagaatgcaaggtcagcaccacagcaccagttacattagccagtagtaagacaggaagtgttgttcaacccagttctgggttctcaggcacaactgattttatccatttaaaaaagcacaaggcagcattggctgcagctcagtataaaagtagtaatgccagtgagactgaacctaatgctataaaaaatcagacactttcagcctcccttcctctggatagcactgtaatctgtagtacaattaacaaagcaaactctgtaggaaatgggcaagcttcccagacaagtcaaccaaactaccatactaaactgaaaaaggcctggctcaccagacactcagaagaagataaaaatactaataaaatggaaaattcagggaattctgtatcagaaattattaagccatgttctgtcaacttaatagcctctacatctagtgatatacaaaatagtgtagatagtaagatcatagttgataaatatgtaaaagatgataaagtcaacaggagaaaagccaaaagaacttatgaatctggctctgaaagtggagactcagatgaaagtgaaagcaagtcagagcaaaggactaaaagacaacctaagccaacttacaaaaagaagcaaaatgatttgcaaaagagaaaaggtgaaatagaagaagatttgaaacccaatggagttctcagcaggagtgccaaagaaagaagtaaactgaagttgcaaagcaacagtaatactggcattcctcgttcagtattgaaagattggcgtaaagtcaagaagctgaagcaaactggggaatcctttttacaggatgactcctgctgtgagatagggcctaatttacaaaagtgtcgagaatgtagacttattcgcagtaaaaaaggagaagaaccagctcactcaccagtattttgtagattttactactttagacggttgtcatttagtaaaaacggagtagttagaatagatggtttctcttctcctgaccaatatgatgatgaagctatgagtttgtggacacatgaaaattttgaagatgatgaactagatatagagacttctaaatatatcttggatataataggtgataagttctgtcaattagtaacatctgaaaaaacagctttgtcctgggtgaaaaaggatgccaaaattgcctggaaaagagcagtgagaggagtccgggagatgtgtgatgcatgtgaagcaacattgtttaacattcactgggtctgccaaaaatgtggatttgtggtctgcttagattgttacaaggcaaaggaaaggaagagttctagagataaagaactatatgcttggatgaagtgtgtgaagggacagcctcatgatcacaaacatttaatgccaacccaaattatacctggttctgttttgacagatcttctagatgccatgcacactcttagggaaaaatatggtattaaatcccattgtcattgtactaacaaacagaatttacaagttggaaattttcctacaatgaatggtgtatctcaatctcagcagcaaaatactcctccgaagtctgagaaaaatggtggcagcagcccagagagtgatgtaggcacagataacaagttaactcctccagaatcccagtcaccactgcactggttagcagatcttgcagagcaaaaagccagagaggaaaaaaaagaaaacaaagaacttacccttgaaaaccaaattaaagaagaaagagaacaagacaactctgaatctccaaatggcagaacatcacctcttgtgtcccagaataatgaacaaggctcaaccttacgggatttgctgactacaacagctggaaagctacgtgtggggtctacagatgctggcattgcctttgccccagtatattcaatgggagccccaagtagcaaaagtggacggactatgcctaacattcttgatgacataattgcttcagttgttgaaaacaaaattccaccaagtaaaacctccaagataaatgtaaaaccagagcttaaagaagagcctgaagaaagcataatatctgcagtggatgaaaataataaattatacagtgatataccacattcttggatctgtgagaagcatattttatggcttaaggattataagaatagcagtaattggaagcttttcaaagaatgttggaaacaaggacagcctgcagtggtttctggtgtgcataagaaaatgaacattagcctatggaaggcggaatcaattagtcttgattttggagaccaccaagctgatctcctgaactgcaaagatagcatcatttcaaatgccaatgttaaggaattctgggatggttttgaagaagtttcaaaacggcagaaaaacaagagtggagaaacagttgttttaaaattgaaagactggccttcaggagaagacttcaagactatgatgccagcaagatacgaagatcttttaaaaagtctgccattgccagaatattgtaatccagaaggaaaattcaatttggcctctcatttgccaggattttttgtacgtcctgatctaggacccaggttgtgcagtgcctatggtgtagttgctgctaaagatcatgatataggaacaacaaatctccatattgaagtttctgatgttgtaaatatactagtttatgttggcatagcaaaaggaaatggcattctctcaaaagcaggaattctcaagaaatttgaggaagaagatttggatgacattttaaggaaaagattgaaggactcaagtgaaatacctggtgctctgtggcatatttatgctgggaaagatgttgacaagataagggaatttcttcaaaagatttcaaaagaacaaggccttgaagttctaccagaacatgatccaatacgtgaccaaagttggtatgtgaacaaaaagctccgtcaaaggctgcttgaagaatatggagtcagaacctgtactcttattcagttccttggtgatgctattgttttgccagcgggagcacttcatcaggttcagaattttcacagctgtattcaggtaactgaagattttgtgtctccagaacatcttgtagagtcatttcatttaacacaggaactgagacttttgaaggaagaaatcaattatgatgataaactacaggttaaaaatattttgtatcatgcagtcaaagaaatggtgagagccttgaagatacacgaggatgaagtagaggatatggaagaaaattaagtgtgatccagtttgatatttttaggttgttgaactgggattacttaaccttgaatgatgatatgtatgcacactgactttaagcttcataaaaccatcagtgccaagaaattctctttgtagtaattacttgttactgacaccacagcagtatagcatatgtcacagctcctgtgattcaatgttataaaacaagcagaattttaaaagcagcactatatagctgttttgtattatagtgtatatgatgtttgtgaaaatgccagatttaaaatgatgtatttatttttggtaaaaaataaaaaattctatgctatattgttgatcaagtgtaaatgtgaccttgtacagtttactaaaattactgatatttttcactacattgagacagttactgtgagaataggacacaaacaccagctattgcctgcatctgggaaattgctgaatcgcacagcagtcatgtcataatcagaaaattactgccaaataattgtaaaatttgtaaagtataaagtatataaagtagatactaaatacagacacttcaatattttgttgaagctattgactgtacaattaaacattttcaaaaggtgtaatttatttaaaattgtctcattttggtaaaatttatgtgaacttttaaagctaaatattaaacttaatatgctatgtaaatatatacatatatacatttaatgatgtatttttttaaaacattggcttgcttttgttaaagtgcaagtgttacatatggctttgtacattaaagttgaaaggggttttacattttccattaaaaggactttatc

SEQ ID NO: 1060 - DNA, 8149 bp, Homo sapiens
cctgacccagatcggaggatgcagtagtgcttcagctgcaggatttcttagtcgttaacaccacagtgctgatgacaaagagcgagttgtaatcctcatcactgccagggctgagccagagcagacagaaaatcgtcatttgctcgttggagacttgttaggttacagctcctgcttcgttctgtggtcttggcttttcttcctatacaatgacgccgctgcaagtgagctcagaaatgcttggtttgagagccatttgcctgtgatttttgaagactaaagaagtatttacactagatactcttccagaacaaaatagaaatttcagcaaatacttactgacctttaaagccttgttgtggatttctgagatttaaagatactttaaaattctcaagaacaaaactttcaaacctctggttgaaagaaatatacccagttcagtcactgcagtagaattccttgtagataagcaactggattttttaactgaagatagtgcctttcagccctaccaggacgacatagacagcctaaacccagttctcagggacaacccgcagcttcatgaggaagtgaaagtctgggtaaaggaacaaaaggttcaggagatttttatgcaaggtccttattccttaaatggatacagagtgagagtatatagacaagactctgccacccagtggtttactggcataattactcatcatgatctcttcacccgcaccatgatcgttatgaatgatcaggtactagaaccacagaatgtcgatccttctatggttcaaatgacctttctagatgatgttgttcactctttgttaaaaggtgaaaatattggcattacatcacgacgcaggtctcgtgccaatcaaaacgtcaacgctgttcacagccattatacacgtgcccaagcaaatagtcccagaccagcaatgaactcccaagctgctgtaccaaaacagaatacacaccagcaacagcaacaaagaagtatccgtccaaataagaggaagggctcagatagcagtataccagatgaagagaagatgaaggaggaaaaatatgattatatatcacgaggagaaaatcctaaaggtaaaaacaaacacttgatgaataaaagaaggaaacctgaggaggatgaaaagaaactaaatatgaaaagacttcgaactgacaatgtttcagacttttctgagagcagtgactcagaaaattcaaataagagaataatagataattcctcagaacagaagccagagaatgaattgaaaaataaaaatacttcaaaaataaatggagaagaaggaaaaccccataataatgagaaggcaggagaagagaccctaaaaaatagccagcctccctgggatcaaatacaggaagataaaaaacatgaagaagcagagaagcggaagtctgttgacactcagcttcaagaagatatgattattcattcgtcagaacagtccacagtttctgatcataattctaatgatttacttcctcaggaatgcaatatggataaaacacataccatggaattgctaccaaaggagaagtttgtatccagaccacccacaccaaaatgtgttattgatattacaaatgacactaatttagaaaaggtggctcaggaaaactcaagtacctttggccttcagacacttcagaaaatggatcctaatgttagtgattcaaaacactctattgcaaatgcaaaattcttggaaacagcaaaaaaagattctgaccagagctgggtcagtgatgtagttaaagtggatctaacccaatcaagtgttacaaatgcttcttcaggaaatgatcacttgaacatggaaaaagagaagtatgtctcttacatttctcctttaagtgcagtttctgtcatggaagataagctgcataagcgaagtccacctccagagactataaaatctaaacttaatacttcagtagatactcacaagataaaatccagcccatcacctgaagttgttaaacccaaaataactcattctcctgattctgtaaagtctaaggccacttatgtgaacagccaagctactggtgaaagaagattggcaaataagatagaacatgagctatcaagatgcagttttcatccaattcctactcgaagcagtacattagaaactacaaagagtcctcttatcattgataaaaatgagcattttacagtttacagagatcctgcacttattgggtcagaaacaggagctaatcatatttcacctttcctaagccagcatccttttcctcttcactcctcatctcatagaacctgtttaaatccaggtacccatcatcctgccttaactcctgcaccccatttactagccggatcatctagtcaaactccattacctaccattaacactcatcctctgactagtggtccacaccatgctgttcatcaccctcatttacttcccactgtgttacctggagtgcctactgcctccttacttggtggccacccacgactagagagtgctcatgccagcagcttgagccacttagcgctagcacaccagcaacaacaacagttgttacagcaccagtcacctcatcttcttggacaagcccatccttctgcttcatataatcagcttggactttatccaattatttggcagtatccaaatggaacacatgcatactcaggacttggtttgccttcttctaagtgggttcacccagaaaatgcagttaatgctgaagcttcattaaggaggaattctcccagtccttggctacatcagcccacccctgtgacctcagcagatggtattggattacttagtcacattcctgtcagaccttccagtgcagagcctcatcggcctcttaaaattacagcccattccagtccaccattgacaaaaactttagtagatcatcataaggaagaattagaaagaaaagcttttatggaaccattacggtctgttgcatccacatcagccaaaaatgacctggatctaaataggtcacagactggaaaagattgtcacttacataggcattttgtggatccagtattaaatcagttacagaggccaccccaggagactggagagaggttaaacaaatacaaagaggaacaccgtcgaattcttcaagaaagtattgatgttgctccctttacaactaaaatcaagggacttgagggtgagagagagaattattccagagtggcatcatcatcttccagtcctaaaagccatatcatcaaacaagatatggatgtagaacgctcagtatcagatctttataaaatgaagcactcagtgcctcagagtttaccccaaagtaactatttcactacattgtctaatagtgtggtcaatgaaccaccaagatcatacccatccaaagaagtttcaaatatttacggtgataaacagagtaatgcccttgcagcggcagcagctaatcctcaaactctgacttcatttataacatctctttcaaagcctccacctttgattaaacaccaaccagaaagtgaaggtttagtaggcaagataccagaacatcttccacatcagattgcatctcactcagtaacaaccttcagaaatgattgtaggagtcctacccatttgacagtttcttctacaaatacactccgcagtatgcctgcattacatagagcaccagtatttcacccaccaatccatcacagcctggaaagaaaggaaggcagctatagtagtctttcccctccaactttaactccggtgatgccagtaaatgctggtggtaaagttcaagaatcacagaagcctccaactctaatacccgaaccaaaagactcccaggcaaattttaagagttcttcagaacagagtttgacggagatgtggagacctaataataacctcagcaaagagaaaactgaatggcatgtggagaaaagcagcggaaagttacaggctgctatggcatctgtcattgtgcgtccatcttctagtacaaaaactgatagtatgccagcaatgcagttagcttctaaagatcgtgttagtgaaagatcttcagctggggcacataaaacagattgcctcaaactagcagaagccggagaaactggaagaatcattttgccaaatgtgaattcagacagtgttcacacaaaatctgaaaaaaactttcaggctgtctcacagggcagtgttcccagttcagtcatgtctgctgtaaatacgatgtgtaataccaaaacggatgtaatcacatctgctgccgatactaccagtgtttccagctggggtggttcagaagtaatttcctctttatcaaataccattttggcctctacatcatcagaatgtgtatcttcaaaaagtgtcagtcagccagtggctcaaaaacaagaatgcaaggtcagcaccacagcaccagttacattagccagtagtaagacaggaagtgttgttcaacccagttctgggttctcaggcacaactgattttatccatttaaaaaagcacaaggcagcattggctgcagctcagtataaaagtagtaatgccagtgagactgaacctaatgctataaaaaatcagacactttcagcctcccttcctctggatagcactgtaatctgtagtacaattaacaaagcaaactctgtaggaaatgggcaagcttcccagacaagtcaaccaaactaccatactaaactgaaaaaggcctggctcaccagacactcagaagaagataaaaatactaataaaatggaaaattcagggaattctgtatcagaaattattaagccatgttctgtcaacttaatagcctctacatctagtgatatacaaaatagtgtagatagtaagatcatagttgataaatatgtaaaagatgataaagtcaacaggagaaaagccaaaagaacttatgaatctggctctgaaagtggagactcagatgaaagtgaaagcaagtcagagcaaaggactaaaagacaacctaagccaacttacaaaaagaagcaaaatgatttgcaaaagagaaaaggtgaaatagaagaagatttgaaacccaatggagttctcagcaggagtgccaaagaaagaagtaaactgaagttgcaaagcaacagtaatactggcattcctcgttcagtattgaaagattggcgtaaagtcaagaagctgaagcaaactggggaatcctttttacaggatgactcctgctgtgagatagggcctaatttacaaaagtgtcgagaatgtagacttattcgcagtaaaaaaggagaagaaccagctcactcaccagtattttgtagattttactactttagacggttgtcatttagtaaaaacggagtagttagaatagatggtttctcttctcctgaccaatatgatgatgaagctatgagtttgtggacacatgaaaattttgaagatgatgaactagatatagagacttctaaatatatcttggatataataggtgataagttctgtcaattagtaacatctgaaaaaacagctttgtcctgggtgaaaaaggatgccaaaattgcctggaaaagagcagtgagaggagtccgggagatgtgtgatgcatgtgaagcaacattgtttaacattcactgggtctgccaaaaatgtggatttgtggtctgcttagattgttacaaggcaaaggaaaggaagagttctagagataaagaactatatgcttggatgaagtgtgtgaagggacagcctcatgatcacaaacatttaatgccaacccaaattatacctggttctgttttgacagatcttctagatgccatgcacactcttagggaaaaatatggtattaaatcccattgtcattgtactaacaaacagaatttacaagttggaaattttcctacaatgaatggtgtatctcaagttttacagaatgttcttaatcacagtaataaaatttctctgtgcatgcctgagtctcagcagcaaaatactcctccgaagtctgagaaaaatggtggcagcagcccagagagtgatgtaggcacagataacaagttaactcctccagaatcccagtcaccactgcactggttagcagatcttgcagagcaaaaagccagagaggaaaaaaaagaaaacaaagaacttacccttgaaaaccaaattaaagaagaaagagaacaagacaactctgaatctccaaatggcagaacatcacctcttgtgtcccagaataatgaacaaggctcaaccttacgggatttgctgactacaacagctggaaagctacgtgtggggtctacagatgctggcattgcctttgccccagtatattcaatgggagccccaagtagcaaaagtggacggactatgcctaacattcttgatgacataattgcttcagttgttgaaaacaaaattccaccaagtaaaacctccaagataaatgtaaaaccagagcttaaagaagagcctgaagaaagcataatatctgcagtggatgaaaataataaattatacagtgatataccacattcttggatctgtgagaagcatattttatggcttaaggattataagaatagcagtaattggaagcttttcaaagaatgttggaaacaaggacagcctgcagtggtttctggtgtgcataagaaaatgaacattagcctatggaaggcggaatcaattagtcttgattttggagaccaccaagctgatctcctgaactgcaaagatagcatcatttcaaatgccaatgttaaggaattctgggatggttttgaagaagtttcaaaacggcagaaaaacaagagtggagaaacagttgttttaaaattgaaagactggccttcaggagaagacttcaagactatgatgccagcaagatacgaagatcttttaaaaagtctgccattgccagaatattgtaatccagaaggaaaattcaatttggcctctcatttgccaggattttttgtacgtcctgatctaggacccaggttgtgcagtgcctatggtgtagttgctgctaaagatcatgatataggaacaacaaatctccatattgaagtttctgatgttgtaaatatactagtttatgttggcatagcaaaaggaaatggcattctctcaaaagcaggaattctcaagaaatttgaggaagaagatttggatgacattttaaggaaaagattgaaggactcaagtgaaatacctggtgctctgtggcatatttatgctgggaaagatgttgacaagataagggaatttcttcaaaagatttcaaaagaacaaggccttgaagttctaccagaacatgatccaatacgtgaccaaagttggtatgtgaacaaaaagctccgtcaaaggctgcttgaagaatatggagtcagaacctgtactcttattcagttccttggtgatgctattgttttgccagcgggagcacttcatcaggttcagaattttcacagctgtattcaggtaactgaagattttgtgtctccagaacatcttgtagagtcatttcatttaacacaggaactgagacttttgaaggaagaaatcaattatgatgataaactacaggttaaaaatattttgtatcatgcagtcaaagaaatggtgagagccttgaagatacacgaggatgaagtagaggatatggaagaaaattaagtgtgatccagtttgatatttttaggttgttgaactgggattacttaaccttgaatgatgatatgtatgcacactgactttaagcttcataaaaccatcagtgccaagaaattctctttgtagtaattacttgttactgacaccacagcagtatagcatatgtcacagctcctgtgattcaatgttataaaacaagcagaattttaaaagcagcactatatagctgttttgtattatagtgtatatgatgtttgtgaaaatgccagatttaaaatgatgtatttatttttggtaaaaaataaaaaattctatgctatattgttgatcaagtgtaaatgtgaccttgtacagtttactaaaattactgatatttttcactacattgagacagttactgtgagaataggacacaaacaccagctattgcctgcatctgggaaattgctgaatcgcac

SEQ ID NO: 1061 - DNA, 5755 bp, Homo sapiens
gttttactaaagtgaatttttttttgtttgcttcgttcgtctttggctctttttttttccttcccaatttcggatttatttcaaggcgaatctggctttgggggaagaggaagaaaagtcggattacaagatcaaccaccaccaacaacaataaaaaccaccaggatatttttttgcaaatttctgacggctttaaattcatgaagcaattgtccccttttgcaatcagcatttggatctcagaatgagcaaggaaagacccaagaggaatatcattcagaagaaatacgatgacagtgatgggattccgtggtcagaagaacgggtggtacgtaaagtcctttatttgtctctgaaggagttcaagaattcccagaagaggcagcatgcggaaggcattgctgggagcctgaaaactgtgaatgggctccttggtaatgaccagtctaagggattaggaccagcatcagaacagtcagagaatgaaaaggacgatgcatcccaagtgtcctccactagcaacgatgttagttcttcagattttgaagaagggccgtcgaggaaaaggcccaggctgcaagcacaaaggaagtttgctcagtctcagccgaatagtcccagcacaactccagtaaagatagtggagccattgctaccccctccagctactcagatatcagacctctctaaaaggaagcctaagacagaagattttcttacctttctctgccttcgaggttctcctgcgctgcccaacagcatggtgtattttggaagctctcaggatgaggaggaagtcgaggaggaagatgatgagacagaagacgtcaaaacagccaccaacaatgcttcatcttcatgccagtcgacccccaggaaaggaaaaacccacaaacatgttcacaacgggcatgttttcaatggttccagcaggtcaacacgggagaaggaacctgttcaaaaacacaaaagcaaagaggccactcccgcaaaggagaagcacagcgatcaccgggctgacagccgccgggagcaggcttcagctaaccaccccgcagcggccccctccacgggttcctcggccaaggggcttgctgccacccatcaccacccccctctgcatcggtcggctcaggacttacggaaacaggtttctaaggtaaacggagtcactcgaatgtcatctctgggtgcaggtgtaaccagtgccaaaaagatgcgcgaggtcagaccttcaccatccaaaactgtgaagtacactgccacggtgacgaagggggctgtcacatacaccaaagccaagagagaactggtcaaggacaccaaacccaatcaccacaagcccagttccgctgtcaaccacacaatctcagggaaaactgaaagtagcaatgcaaaaacccgcaaacaggtgctatccctcgggggggcgtccaagtccactgggcccgccgtcaatggcctcaaggtcagtggcaggttgaacccaaagtcatgcactaaggaggtgggggggcggcagctgcgggagggcctgcagctgcgggaggggctgcggaactccaagaggagactggaagaggcacaccaggcggagaagccgcagtcgccccccaagaagatgaaaggggcggctggccccgccgaaggccctggcaagaaggccccggccgagagaggtctgctgaacggacacgtgaagaaggaagtgccggagcgcagtctggagaggaatcggccgaagcgggccacggccgggaagagcacgccaggcagacaagcacatggcaaggcggacagcgcctcctgtgaaaatcgttctacctcgcaaccggagtccgtgcacaagccgcaggactcgggcaaggccgagaagggcggcggcaaggccgggtgggcggccatggacgagatccccgtcctcaggccctccgccaaggagttccacgatccgctcatctacatcgagtcggtccgcgctcaggtggagaagttcgggatgtgcagggtgatcccccctccggactggcggcccgagtgcaagctcaacgatgagatgcggtttgtcacgcagattcagcacatccacaagctgggccggcgctggggccccaacgtgcagcggctggcctgcatcaagaagcacctcaaatctcagggcatcaccatggacgagctcccgctcatagggggctgtgagctcgacctggcctgctttttccggctgattaatgagatgggcggcatgcagcaagtgactgacctcaaaaaatggaacaaactagcagacatgctgcgcatccccagaactgcccaggaccggctggccaagctgcaggaggcctactgccagtacctactctcctacgactccctgtccccagaggagcaccggcggctggagaaggaggtgctgatggagaaggagatcctggagaagcgcaaggggccgctggaaggccacacagagaacgaccaccacaagttccaccctctgccccgcttcgagcccaagaatgggctcatccacggcgtggcccccaggaacggcttccgcagcaagctcaaggaggtgggccaggcccagttgaagactggccggcggcgactcttcgctcaggaaaaagaagtggtcaaggaagaggaggaggacaaaggcgtcctcaatgacttccacaagtgcatctataagggaaggtctgtttctctaacaactttttatcgaacagcgaggaatatcatgagcatgtgtttcagcaaggagcctgccccagccgaaatcgagcaagagtactggaggctagtggaagagaaggactgccacgtggcagtgcactgcggcaaggtggacaccaacactcacggcagtggattcccagtaggaaaatcagaacccttttcgaggcatggatggaacctcaccgtcctccccaataacacagggtccatcctgcgtcacctcggtgctgtgcctggagtgactattccctggctaaatattggcatggtcttttctacctcatgctggtctcgagaccaaaatcaccttccatacattgactacttacacactggtgctgactgcatttggtattgcattcctgctgaggaggagaacaagctggaagatgtggtccacaccctgctgcaagccaatggcaccccagggctgcagatgctggaaagcaacgtcatgatctccccggaggtgctgtgcaaagaggggatcaaggtgcacaggaccgtgcagcagagtggccagtttgtcgtctgcttcccgggatcctttgtgtccaaagtgtgctgtgggtacagcgtgtctgaaaccgtgcactttgctaccacccagtggacaagtatgggctttgagaccgccaaggaaatgaagcgtcgccatatagctaagccattctccatggagaagttactctaccagattgcacaagcagaagcaaaaaaagaaaacggtcccactctcagtaccatctcagccctcctggatgagctcagggatacagagctgcggcagcgcaggcagctgttcgaggctggcctccactcctccgcacgctatggcagccacgatggcagcagcacggtggcggacgggaagaaaaagcctcgaaagtggctgcagttggagacgtcagagaggaggtgtcagatctgccagcacctgtgctacctgtccatggtggtacaagagaacgaaaacgtcgtgttctgtctggagtgtgctctgcgccacgtggagaaacagaagtcctgccgagggctgaagttgatgtaccgctacgatgaggaacagattatcagtctggtcaatcagatctgcggcaaagtgtctggtaaaaacggcagcattgagaactgtctcagtaaacccacaccaaaaagaggtccccgcaagagagcgacagtggacgtgcccccctcccgtctgtcagcctccagttcatccaaaagtgcttcgagctcatcatgaagatgccaacgcccgtggtcgatttatatatatttttttgtaattattatattctagtttggagtacttgctgtaggattcaagctgtctttgcactagctctaaagaagattttcttctggttttagagaactaattttgttttagcattaaactgttgaacttttttttgtacttagaaaacctagatactgcagtcagattttggaaactgccgtatagtcactgttttaaaaaccccggaggggctgtattaatttgtattgccccatggctgacaaaagcctttttttttggttttgatttttttttttttgtaactgttggggggaaaaaggctttttaacccatttttgaagagggtgaagtttggagaacaaatttaaaaaccatcagtcatgtgagcagattttttagaagggataggagacacacgcgcacacacacacacacacgaaacttgaaatggctttgctttggctgtcgtcttctgccgtgtgccagatgagcttgtgatctgggaagccggggcacccccgttttgtttctctgggcggttgtggcagctgaaggcggacgttgtttcctaaccataggtggaacgaggagacgggagcgagtgggctctccaccagcacatcactatgcatctgttccaggaaagaagaaaagcgagcgaggaagacggaaaagactgcctgccttggaggggtcacatgagggagacctgtgcctgatttcattaggaaatccattctgttattttttggtgctgttggctactttatcaaaaaacccttcaatagcatccttaagatttaaaaaaaaaaaaaaaaaaaaggaaaaaaaagtgatggaagccgtaagtgcttctttgtcatcgacgtgcaatctttctaacattccatctccatctcaccgcttcttgtttgacaccttcacaagtcagcattaatctttcttttaaaacttgtttcatttatgatcatgtagagagccactaggaggcctgcagttatttttgaatgtgaaaatgcatttgcgttcatcttgtctattttttctcttcatgttgtaacaaaaaggaaaaaagaaaaaaaaatcccatcccttttgtacatatgcctgtaaattgttttaaatacttgagcctttttctcggtggggggtggggaggggggtgagaagacaagatgaagaaaagccttacatttcagtttcttcatcggttggattggatgcttacagggtttttcttgtaacatttataagtgctgcttacatcactgaacaacaacaaaaaaataataatggagtagctgttgcccttctccggttgtgtgtacagtatgtgtggaataaaaaagggaaactgttttcacaagctgttctttgtttcataattggattcatcaatcccgtagctacccatattgcactgagcttgccagtggtgactgccaggaacgtcctatgatccactttgttggttgttgttgcagaagactgaactgttttggaatatttaacaattacagaaacagtcaagtgttttccaatgtggttgtccggtttctatggccttgctgtgtactttccctctttttgacagtaaacttctgcctatggcttacagtttgacatttaatttattagcgctgctctgcacccctcccttgggagggagacttcatgtggtttattgcgagttttttgtttacttttcaggtttgtactacaaggtttaataataaaaacaaagttttttgg

SEQ ID NO: 1062 - DNA, 3864 bp, Homo sapiens
gaagatgcgctcggcctctgccttccgctccggagcgtcgcgcttcccaccaggatgacagtgatgggattccgtggtcagaagaacgggtggtacgtaaagtcctttatttgtctctgaaggagttcaagaattcccagaagaggcagcatgcggaaggcattgctgggagcctgaaaactgtgaatgggctccttggtaatgaccagtctaagggattaggaccagcatcagaacagtcagagaatgaaaaggacgatgcatcccaagtgtcctccactagcaacgatgttagttcttcagattttgaagaagggccgtcgaggaaaaggcccaggctgcaagcacaaaggaagtttgctcagtctcagccgaatagtcccagcacaactccagtaaagatagtggagccattgctaccccctccagctactcagatatcagacctctctaaaaggaagcctaagacagaagattttcttacctttctctgccttcgaggttctcctgcgctgcccaacagcatggtgtattttggaagctctcaggatgaggaggaagtcgaggaggaagatgatgagacagaagacgtcaaaacagccaccaacaatgcttcatcttcatgccagtcgacccccaggaaaggaaaaacccacaaacatgttcacaacgggcatgttttcaatggttccagcaggtcaacacgggagaaggaacctgttcaaaaacacaaaagcaaagaggccactcccgcaaaggagaagcacagcgatcaccgggctgacagccgccgggagcaggcttcagctaaccaccccgcagcggccccctccacgggttcctcggccaaggggcttgctgccacccatcaccacccccctctgcatcggtcggctcaggacttacggaaacaggtttctaaggtaaacggagtcactcgaatgtcatctctgggtgcaggtgtaaccagtgccaaaaagatgcgcgaggtcagaccttcaccatccaaaactgtgaagtacactgccacggtgacgaagggggctgtcacatacaccaaagccaagagagaactggtcaaggacaccaaacccaatcaccacaagcccagttccgctgtcaaccacacaatctcagggaaaactgaaagtagcaatgcaaaaacccgcaaacaggtgctatccctcgggggggcgtccaagtccactgggcccgccgtcaatggcctcaaggtcagtggcaggttgaacccaaagtcatgcactaaggaggtgggggggcggcagctgcgggagggcctgcagctgcgggaggggctgcggaactccaagaggagactggaagaggcacaccaggcggagaagccgcagtcgccccccaagaagatgaaaggggcggctggccccgccgaaggccctggcaagaaggccccggccgagagaggtctgctgaacggacacgtgaagaaggaagtgccggagcgcagtctggagaggaatcggccgaagcgggccacggccgggaagagcacgccaggcagacaagcacatggcaaggcggacagcgcctcctgtgaaaatcgttctacctcgcaaccggagtccgtgcacaagccgcaggactcgggcaaggccgagaagggcggcggcaaggccgggtgggcggccatggacgagatccccgtcctcaggccctccgccaaggagttccacgatccgctcatctacatcgagtcggtccgcgctcaggtggagaagttcgggatgtgcagggtgatcccccctccggactggcggcccgagtgcaagctcaacgatgagatgcggtttgtcacgcagattcagcacatccacaagctgggccggcgctggggccccaacgtgcagcggctggcctgcatcaagaagcacctcaaatctcagggcatcaccatggacgagctcccgctcatagggggctgtgagctcgacctggcctgctttttccggctgattaatgagatgggcggcatgcagcaagtgactgacctcaaaaaatggaacaaactagcagacatgctgcgcatccccagaactgcccaggaccggctggccaagctgcaggaggcctactgccagtacctactctcctacgactccctgtccccagaggagcaccggcggctggagaaggaggtgctgatggagaaggagatcctggagaagcgcaaggggccgctggaaggccacacagagaacgaccaccacaagttccaccctctgccccgcttcgagcccaagaatgggctcatccacggcgtggcccccaggaacggcttccgcagcaagctcaaggaggtgggccaggcccagttgaagactggccggcggcgactcttcgctcaggaaaaagaagtggtcaaggaagaggaggaggacaaaggcgtcctcaatgacttccacaagtgcatctataagggaaggtctgtttctctaacaactttttatcgaacagcgaggaatatcatgagcatgtgtttcagcaaggagcctgccccagccgaaatcgagcaagagtactggaggctagtggaagagaaggactgccacgtggcagtgcactgcggcaaggtggacaccaacactcacggcagtggattcccagtaggaaaatcagaacccttttcgaggcatggatggaacctcaccgtcctccccaataacacagggtccatcctgcgtcacctcggtgctgtgcctggagtgactattccctggctaaatattggcatggtcttttctacctcatgctggtctcgagaccaaaatcaccttccatacattgactacttacacactggtgctgactgcatttggtattgcattcctgctgaggaggagaacaagctggaagatgtggtccacaccctgctgcaagccaatggcaccccagggctgcagatgctggaaagcaacgtcatgatctccccggaggtgctgtgcaaagaggggatcaaggtgcacaggaccgtgcagcagagtggccagtttgtcgtctgcttcccgggatcctttgtgtccaaagtgtgctgtgggtacagcgtgtctgaaaccgtgcactttgctaccacccagtggacaagtatgggctttgagaccgccaaggaaatgaagcgtcgccatatagctaagccattctccatggagaagttactctaccagattgcacaagcagaagcaaaaaaagaaaacggtcccactctcagtaccatctcagccctcctggatgagctcagggatacagagctgcggcagcgcaggcagctgttcgaggctggcctccactcctccgcacgctatggcagccacgatggcagcagcacggtggcggacgggaagaaaaagcctcgaaagtggctgcagttggagacgtcagagaggaggtgtcagatctgccagcacctgtgctacctgtccatggtggtacaagagaacgaaaacgtcgtgttctgtctggagtgtgctctgcgccacgtggagaaacagaagtcctgccgagggctgaagttgatgtaccgctacgatgaggaacagattatcagtctggtcaatcagatctgcggcaaagtgtctggtaaaaacggcagcattgagaactgtctcagtaaacccacaccaaaaagaggtccccgcaagagagcgacagtggacgtgcccccctcccgtctgtcagcctccagttcatccaaaagtgcttcgagctcatcatgaagatgccaacgcccgtggtcgatttatatatatttttttgtaattattatattctagtttggagtacttgctgtaggattcaagctgtctttgcactagctctaaagaagatttt

SEQ ID NO: 1063 - DNA, 1919 bp, Homo sapiens
aacttccagaagatcaaggggaccattctaaggtgccccgggaataggcggctctccccggggccgggcgtcctggggcactcctacccagcagcccggctgcaggatgacagtgatgggattccgtggtcagaagaacgggtggtacgtaaagtcctttatttgtctctgaaggagttcaagaattcccagaagaggcagcatgcggaaggcattgctgggagcctgaaaactgtgaatgggctccttggtaatgaccagtctaagggattaggaccagcatcagaacagtcagagaatgaaaaggacgatgcatcccaagtgtcctccactagcaacgatgttagttcttcagattttgaagaagggccgtcgaggaaaaggttctcctgcgctgcccaacagcatggtgtattttggaagctctcaggatgaggaggaagtcgaggaggaagatgatgagacagaagacgtcaaaacagccaccaacaatgcttcatcttcatgccagtcgacccccaggaaaggaaaaacccacaaacatgttcacaacgggcatgttttcaatggttccagcaggtcaacacgggagaaggaacctgttcaaaaacacaaaagcaaagaggccactcccgcaaaggagaagcacagcgatcaccgggctgacagccgccgggagcaggcttcagctaaccaccccgcagcggccccctccacgggttcctcggccaaggggcttgctgccacccatcaccacccccctctgcatcggtcggctcaggacttacggaaacaggtttctaaggtaaacggagtcactcgaatgtcatctctgggtgcaggtgtaaccagtgccaaaaagatgcgcgaggtcagaccttcaccatccaaaactgtgaagtacactgccacggtgacgaagggggctgtcacatacaccaaagccaagagagaactggtcaaggacaccaaacccaatcaccacaagcccagttccgctgtcaaccacacaatctcagggaaaactgaaagtagcaatgcaaaaacccgcaaacaggtgctatccctcgggggggcgtccaagtccactgggcccgccgtcaatggcctcaaggtcagtggcaggttgaacccaaagtcatgcactaaggaggtgggggggcggcagctgcgggagggcctgcagctgcgggaggggctgcggaactccaagaggagactggaagaggcacaccaggcggagaagccgcagtcgccccccaagaagatgaaaggggcggctggccccgccgaaggccctggcaagaaggccccggccgagagaggtctgctgaacggacacgtgaagaaggaagtgccggagcgcagtctggagaggaatcggccgaagcgggccacggccgggaagagcacgccaggcagacaagcacatggcaaggcggacagcgcctcctgtgaaaatcgttctacctcgcaaccggagtccgtgcacaagccgcaggactcgggcaaggccgagaagggcggcggcaaggccgggtgggcggccatggacgagatccccgtcctcaggccctccgccaaggagttccacgatccgctcatctacatcgagtcggtccgcgctcaggtggagaagttcgggatgtgcagggtgatcccccctccggactggcggcccgagtgcaagctcaacgatgagatgcggtttgtcacgcagattcagcacatccacaagctgggccggcgctggggccccaacgtgcagcggctggcctgcatcaagaagcacctcaaatctctgggcggttgtggcagctgaaggcggacgttgtttcctaaccataggtggaacgaggagacgggagcgagtgggctctccaccagcacatcactatgcatctgttccaggaaagaag

SEQ ID NO: 1064 - DNA, 3216 bp, Homo sapiens
aagtgctccggagcctgcctcactgcgctcttcctccctccctccctctgtccttcttcctctctgtctctctgcaatgatccggctctgaggatggctgctccacgggtctgtcaggtgcagtttttggtggcttatcttgaggaacctgggatagaagggctccttggtaatgaccagtctaagggattaggaccagcatcagaacagtcagagaatgaaaaggacgatgcatcccaagtgtcctccactagcaacgatgttagttcttcagattttgaagaagggccgtcgaggaaaaggcccaggctgcaagcacaaaggaagtttgctcagtctcagccgaatagtcccagcacaactccagtaaagatagtggagccattgctaccccctccagctactcagatatcagacctctctaaaaggaagcctaagacagaagattttcttacctttctctgccttcgaggttctcctgcgctgcccaacagcatggtgtattttggaagctctcaggatgaggaggaagtcgaggaggaagatgatgagacagaagacgtcaaaacagccaccaacaatgcttcatcttcatgccagtcgacccccaggaaaggaaaaacccacaaacatgttcacaacgggcatgttttcaatggttccagcaggtcaacacgggagaaggaacctgttcaaaaacacaaaagcaaagaggccactcccgcaaaggagaagcacagcgatcaccgggctgacagccgccgggagcaggcttcagctaaccaccccgcagcggccccctccacgggttcctcggccaaggggcttgctgccacccatcaccacccccctctgcatcggtcggctcaggacttacggaaacaggtttctaaggtaaacggagtcactcgaatgtcatctctgggtgcaggtgtaaccagtgccaaaaagatgcgcgaggtcagaccttcaccatccaaaactgtgaagtacactgccacggtgacgaagggggctgtcacatacaccaaagccaagagagaactggtcaaggacaccaaacccaatcaccacaagcccagttccgctgtcaaccacacaatctcagggaaaactgaaagtagcaatgcaaaaacccgcaaacaggtgctatccctcgggggggcgtccaagtccactgggcccgccgtcaatggcctcaaggtcagtggcaggttgaacccaaagtcatgcactaaggaggtgggggggcggcagctgcgggagggcctgcagctgcgggaggggctgcggaactccaagaggagactggaagaggcacaccaggcggagaagccgcagtcgccccccaagaagatgaaaggggcggctggccccgccgaaggccctggcaagaaggccccggccgagagaggtctgctgaacggacacgtgaagaaggaagtgccggagcgcagtctggagaggaatcggccgaagcgggccacggccgggaagagcacgccaggcagacaagcacatggcaaggcggacagcgcctcctgtgaaaatcgttctacctcgcaaccggagtccgtgcacaagccgcaggactcgggcaaggccgagaagggcggcggcaaggccgggtgggcggccatggacgagatccccgtcctcaggccctccgccaaggagttccacgatccgctcatctacatcgagtcggtccgcgctcaggtggagaagttcgggatgtgcagggtgatcccccctccggactggcggcccgagtgcaagctcaacgatgagatgcggtttgtcacgcagattcagcacatccacaagctgggccggcgctggggccccaacgtgcagcggctggcctgcatcaagaagcacctcaaatctcagggcatcaccatggacgagctcccgctcatagggggctgtgagctcgacctggcctgctttttccggctgattaatgagatgggcggcatgcagcaagtgactgacctcaaaaaatggaacaaactagcagacatgctgcgcatccccagaactgcccaggaccggctggccaagctgcaggaggcctactgccagtacctactctcctacgactccctgtccccagaggagcaccggcggctggagaaggaggtgctgatggagaaggagatcctggagaagcgcaaggggccgctggaaggccacacagagaacgaccaccacaagttccaccctctgccccgcttcgagcccaagaatgggctcatccacggcgtggcccccaggaacggcttccgcagcaagctcaaggaggtgggccaggcccagttgaagactggccggcggcgactcttcgctcaggaaaaagaagtggtcaaggaagaggaggaggacaaaggcgtcctcaatgacttccacaagtgcatctataagggaaggtctgtttctctaacaactttttatcgaacagcgaggaatatcatgagcatgtgtttcagcaaggagcctgccccagccgaaatcgagcaagagtactggaggctagtggaagagaaggactgccacgtggcagtgcactgcggcaaggtggacaccaacactcacggcagtggattcccagtaggaaaatcagaacccttttcgaggcatggatggaacctcaccgtcctccccaataacacagggtccatcctgcgtcacctcggtgctgtgcctggagtgactattccctggctaaatattggcatggtcttttctacctcatgctggtctcgagaccaaaatcaccttccatacattgactacttacacactggtgctgactgcatttgcctctctgtagagccagtgtttcctcatctatcggtggctgtggggagtagagttgacttgggaatctcgttcctgccatgtggagacacgcgcgttatgtaccctgtggagtctgttgcctggcgaggtgttctgggtccccgcctgtaatctgactctcactgtagccatccctgattgaggctgggtccccgcctgtaatcctgactctcactgcacccatccctgatcgaggctggactctttggtgtctttgtttacggcggcagatgggaaatgactacaaataatcagatgtcttgtcgtctgatcgtttaccggcatgctgttcatgccatgctgactgtgtttattgccctaatggggtgattaaacattctttattaaaat

SEQ ID NO: 1065 - DNA, 1700 bp, Homo sapiens
ctgaagagggccttttgctgctcgccttcactctcagtcttggggccttccccatcatcttgcttctcgccttctggatctcctcgacttttggaagccgcgtgacctacgtcattcagattccaagagagaggtcatcctgggtgattccttagctccaagaagaggcttggtggttgattctccaagattcatggtagcaggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgagctagatgaggaagaggagcgaaggaaaaggcgccgggagaagaacaaagtcgcagcagcccgatgccggaacaagaagaaggagcgcacggagtttctgcagcgggaatccgagcggctggaactcatgaacgcagagctgaagacccagattgaggagctgaagcaggagcggcagcagctcatcctgatgctgaaccgacaccgccccacctgcatcgtccggaccgacagtgtcaagacccccgagtcagaaggcaacccactgctcgagcagctcgagaagaagtgaccatgggctgggaggaggtggaggaggaggaagaggagaaggaaaagtgacgaagagagaggaggaggggggccccagatggcccttcctttggtgcatgaaaaactgtacaatgaggttcagcacagccagcatcagccgagcttttttgtgaaactcagatcagccacccaggaggaagagcgggctgaggaaacccagagggaccaagcgctgagaccaaagttgaccctcgggtagggttgtcctgcctggggccccacttgaaggaggcaggacagaggcaccgaggccagggagacgcccaacgaggcagccctgggctcttctctggcctcttcaccagggcacccatccaaggaacctccgaacagccaggaaaagccatgagttgcaaccaaaacgcggctgaggatggaactcagaatgaaactgcaacccacctgcccccagccctgcccctcgccctgatgcgaagctggagaggggcgtgctgcggggccctgatgcccccacccacctcggtccagcgcggccctgcccaggaggcggcagccgggcgcaccctcgccagccctgctggagtttgctgtgggcactgaggcgcgggcgcccttccaaagcacatactcaccgaatgtttacagactggctgtcctggcagggctttcaactgcacatgttttttatactttcctttttttttttttttttaatattttttacaaaaaaaaagattttatacaagcaatatatatatggatttctataatcactcgatgtgatacagtataaatatgctatggtttgtttgttatgaacagatagccaccagttacggccgttgtgtgtaactcctaagtactgtagtctctgggtgtcgggggtggccagggcgggggcggggtgcatttccatccttgtaaacccttcatagtactcagtcctgtatcgctcagtaaacattgctcttacttacata

SEQ ID NO: 1066 - DNA, 972 bp, Homo sapiens
cctgctttctcgagcgctcctgcaccgtggggtggcggagccgggggactgcatggaacccgggacgcccccgcggggagaggagcgcgagcggccgcgggaggagggcgcccaaggcggcgggggaggttaaggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgagctagatgaggaagaggagcgaaggaaaaggcgccgggagaagaacaaagtcgcagcagcccgatgccggaacaagaagaaggagcgcacggagtttctgcagcgggaatccgagcggctggaactcatgaacgcagagctgaagacccagattgaggagctgaagcaggagcggcagcagctcatcctgatgctgaaccgacaccgccccacctgcatcgtccggaccgacagtgtcaagacccccgagtcagaaggcaacccactgctcgagcagctcgagaagaagtgaccatgggctgggaggaggtggaggaggaggaagaggagaaggaaaagtgacgaagagagaggaggaggggggccccagatggcccttcctttggtgcatgaaaaactgtacaatgaggttcagcacagccagcatcagccgagcttttttgtgaaactcagatcagccacccaggaggaagagcgggctgaggaaacccagagggaccaagcgctgagaccaaagttgaccctcgggtagggttgtcctgcctggggccccacttgaaggaggcaggacagaggcaccgaggccagggagacgcccaacgaggcagccctggg

SEQ ID NO: 1067 - DNA, 5401 bp, Homo sapiens
gccccagcccagccccgcggggaggctcccgcagcccagggacctcgagctttccccgcgccgggcgctgcagccgggcccctcccgcgaggcgcccggcagcctgaggcttccttttggttcccgccccgggacgggaggctccgtccgctccctggacagccggggtgctccctccttctccctcccgcgctctcctcccccgtccgtttgcagggaggtgctctcctcgggcggcggggaaggcggggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgagctagatgaggaagaggagcgaaggaaaaggcgccgggagaagaacaaagtcgcagcagcccgatgccggaacaagaagaaggagcgcacggagtttctgcagcgggaatccgagcggctggaactcatgaacgcagagctgaagacccagattgaggagctgaagcaggagcggcagcagctcatcctgatgctgaaccgacaccgccccacctgcatcgtccggaccgacagtgtcaagacccccgagtcagaaggcaacccactgctcgagcagctcgagaagaagtgaccatgggctgggaggaggtggaggaggaggaagaggagaaggaaaagtgacgaagagagaggaggaggggggccccagatggcccttcctttggtgcatgaaaaactgtacaatgaggttcagcacagccagcatcagccgagcttttttgtgaaactcagatcagccacccaggaggaagagcgggctgaggaaacccagagggaccaagcgctgagaccaaagttgaccctcgggtagggttgtcctgcctggggccccacttgaaggaggcaggacagaggcaccgaggccagggagacgcccaacgaggcagccctgggctcttctctggcctcttcaccagggcacccatccaaggaacctccgaacagccaggaaaagccatgagttgcaaccaaaacgcggctgaggatggaactcagaatgaaactgcaacccacctgcccccagccctgcccctcgccctgatgcgaagctggagaggggcgtgctgcggggccctgatgcccccacccacctcggtccagcgcggccctgcccaggaggcggcagccgggcgcaccctcgccagccctgctggagtttgctgtgggcactgaggcgcgggcgcccttccaaagcacatactcaccgaatgtttacagactggctgtcctggcagggctttcaactgcacatgttttttatactttcctttttttttttttttttaatattttttacaaaaaaaaagattttatacaagcaatatatatatggatttctataatcactcgatgtgatacagtataaatatgctatggtttgtttgttatgaacagatagccaccagttacggccgttgtgtgtaactcctaagtactgtagtctctgggtgtcgggggtggccagggcgggggcggggtgcatttccatccttgtaaacccttcatagtactcagtcctgtatcgctcagtaaacattgctcttacttacatagccgccttgcgtggtgtctgcctggggaatgggtgcaaggccctctcagggtcggagactgtttggagcctctgctataggcctgttcattttcacaacagctctcctatttcacagatgaggaagctaaggctcagagacattaagccacctgcagttactattttgagagcagtcagagtgttcgctcactctgcagatgttttctgagggcctgttgtgtgtgccaggccctgagaattcactggaggatgaaacagacctaagtcttgcccttgtggggcctccagtaaggagtgaatcctgtgcttgctccataagttgtctcatttcgtcttcatggcagccttgccagggaacagcacttgtccccaattcacagatggcgaattagaggtccagggaattaaactcgcagacaccatttgttgaagacttattttgtgacaagcagacatagtctcttcccttctcacaagagcacaaactaggcacgattcttctcattttacagatggtttaactgaggctcagagaaggtaagcgacttatccaaggtaacccagctagcaagggatagagctggtgtttgaactctccctccagaggcctgtgactctcctcctgtcaccaacccactatgattgtcctcatggttgaataggaagcttatgaggccacagttatagatttagtttctgggaaggctggatagagttccaggttgtcccatgatcacagagtgaaccaactaccctggtcaatgtgtgtctgacccagggaagggtgtggatggcttctctgccccctcacctcgacagctgaatccctgccacccagggccggagcagctcagtggcattcactcagtgcctgctgtgtacctggcactcggcagttctcaaggcatgtcacgcatgaggaaggcgggagaggtgtttttagcttccttgtatactgaagcttgcaaaggctacagtttacccaactaaacttgactcctgcattctaatcatgtgttctttctcctccatccctggacttaggataactagttgctggtgatgacttcgtgtcaagaacagcagtgaacctgggttgcttcccaaattgtggacgaggccttctgggatgggcagaagtggagaatggtgattaacacacctgtgatccctccctcgctcactcctctcagtttccctccacccaacacacttggtgtggactcccctgcaccccgccctagaaacaggacctggtcctctcactgtcagctgtggcagaaggttgtggcagcgggttgccttctgtctcgggggtcttgaggctgtcggtccggacgatgcaggtgaggcagtgtcagttctgcatcaggaacccctcgcgctgtaatcctttgatatttttcaagccatgagaaaaatgaagtggacttaccagggtccctccagtgacctagtggatgttcttacaggactgccgtgtgccactggctgtggcttccctggtcctgtgcttggccaccgggagctggcatctccaaaatagagcctccttagcctgtgcaggtgggctgtcttccaaagtcaccacaccagtgacttgtgctgtgcggagccttcctcaccaggaccactggctgctcctgtggctagaagtcacaattataggcttcattgcaagagccagcatttgagtttcttctgggcacctgccactgtgcatgtgtgacctcaactgctttgtgcaccctgactggggggtaggtgctagcgttccaacattacagatgagaaaaccgaggcacacagaagaggtaacctgcccaaggtcacaggtgttaggtggcagagccaagatgttattgtcagtctgacttcaggtgcataaaacctgaggctgagcctccccatgagaggaaaaatgtgtttgtggtgtgacctcagttgccagggaacttgtgcaggaagccgggagagatggcacagacccacctgtgctcacagtacatgttaagaattcccaagtctcaggcaaaccatctccaagggtgttcacagaagacacaccttaaaggcaaacgggttcatgatgtaatcttctattgactagctgtgaacctcatttttcttatctgtgaagtgggaacagtaataatccaagtctttttatggagttatcaagatcaaaaaaggaatggatatacaaagtgttttgtgaaataaaagctccctaaaatggtaattattttgtcctctgttagtgtcggtagttattgatatctacatagtacaggttatttaaatatgttttattctgtaaagatgggctgccaagtttgtgttctgaccctgtacgtggtccctatggtgtgatgaatgcctgggatcgcagactcctggatctgttcagctcctgactggtcacaaccagccatgctggatgcatcattccctccctgggcctcagtgtgccctcctgccaggtggtcacacataagacctgtgccacctctgcccagggttcctatgagaatcaatcgagttgatgaatgcaaccatggcctgagaaagacaagacgctttagctatcagatgggcagaaacaagtatgtgttggtaagaatatggattaaaggttgggaggccaagatgggtggatcatgaggtcagaagattgagaccaccctggataacacggtgaaaccctgtctctactaataatacaaaaaattagccgggcatggtggcacgtgcctgtagtcccagctactcgggaggctgaggcaggagaatcacttggacctgggaggtggaggttgcagtgagccaagattgcgccactgcactccagcctgggtgacagagcgagactccatctcaaaaaaaacaaaacaaaaaaaatgtggattaaaggaaacttagatatgctgccagtgagaaactgtgcaaagcaatttggaaataaccagtaaaactaaagctaaacgcatcctttgacctagcagttttcctcctagtcttgggaggaactctagcacaggggcaaaaggaaatgtacaagaatgttcactgatggctttgtttgtatttttaaaaagttgaaaacaacctaaatgatgatcagcataagaacaaataaattgtggtattttcctaaaattgaatattactcaacaggtaaaaaagaatgaaccagagctatatgtatcaatatggataaatctcagaaacctactgttgagatggagggtaggggagtgaactgcggaaggataccacttatgtcatatttctaactaaatgtatacgttgatactttattgtttatggctacacacacatctgggtaatagaggtataaaagcctgcacaagaatgctgtcaatatcacaatcagtcatagggagtgctcctgggagggccgcggagaggagggaactagggatgccactgcaagggtaagtaggacgctggacttcaacttcaactatacacataacatttcatttatttttttaaaatccccatcaaatgtagaatgacaggatttttcagaggtgggtgatgtgtgcacagatgtgggctatcttctccacactcctctgtatatttgatattctttgcaataaaagagaacaagccacaatacaaa

SEQ ID NO: 1068 - DNA, 3775 bp, Homo sapiens
cccgggggcgccgcctccccccgcaccttctgcacggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgagctagatgaggaagaggagcgaaggaaaaggcgccgggagaagaacaaagtcgcagcagcccgatgccggaacaagaagaaggagcgcacggagtttctgcagcgggaatccgagcggctggaactcatgaacgcagagctgaagacccagattgaggagctgaagcaggagcggcagcagctcatcctgatgctgaaccgacaccgccccacctgcatcgtccggaccgacagtgtcaagacccccgagtcagaaggcaacccactgctcgagcagctcgagaagaagtgaccatgggctgggaggaggtggaggaggaggaagaggagaaggaaaagtgacgaagagagaggaggaggggggccccagatggcccttcctttggtgcatgaaaaactgtacaatgaggttcagcacagccagcatcagccgagcttttttgtgaaactcagatcagccacccaggaggaagagcgggctgaggaaacccagagggaccaagcgctgagaccaaagttgaccctcgggtagggttgtcctgcctggggccccacttgaaggaggcaggacagaggcaccgaggccagggagacgcccaacgaggcagccctgggctcttctctggcctcttcaccagggcacccatccaaggaacctccgaacagccaggaaaagccatgagttgcaaccaaaacgcggctgaggatggaactcagaatgaaactgcaacccacctgcccccagccctgcccctcgccctgatgcgaagctggagaggggcgtgctgcggggccctgatgcccccacccacctcggtccagcgcggccctgcccaggaggcggcagccgggcgcaccctcgccagccctgctggagtttgctgtgggcactgaggcgcgggcgcccttccaaagcacatactcaccgaatgtttacagactggctgtcctggcagggctttcaactgcacatgttttttatactttcctttttttttttttttttaatattttttacaaaaaaaaagattttatacaagcaatatatatatggatttctataatcactcgatgtgatacagtataaatatgctatggtttgtttgttatgaacagatagccaccagttacggccgttgtgtgtaactcctaagtactgtagtctctgggtgtcgggggtggccagggcgggggcggggtgcatttccatccttgtaaacccttcatagtactcagtcctgtatcgctcagtaaacattgctcttacttacatagccgccttgcgtggtgtctgcctggggaatgggtgcaaggccctctcagggtcggagactgtttggagcctctgctataggcctgttcattttcacaacagctctcctatttcacagatgaggaagctaaggctcagagacattaagccacctgcagttactattttgagagcagtcagagtgttcgctcactctgcagatgttttctgagggcctgttgtgtgtgccaggccctgagaattcactggaggatgaaacagacctaagtcttgcccttgtggggcctccagtaaggagtgaatcctgtgcttgctccataagttgtctcatttcgtcttcatggcagccttgccagggaacagcacttgtccccaattcacagatggcgaattagaggtccagggaattaaactcgcagacaccatttgttgaagacttattttgtgacaagcagacatagtctcttcccttctcacaagagcacaaactaggcacgattcttctcattttacagatggtttaactgaggctcagagaaggtaagcgacttatccaaggtaacccagctagcaagggatagagctggtgtttgaactctccctccagaggcctgtgactctcctcctgtcaccaacccactatgattgtcctcatggttgaataggaagcttatgaggccacagttatagatttagtttctgggaaggctggatagagttccaggttgtcccatgatcacagagtgaaccaactaccctggtcaatgtgtgtctgacccagggaagggtgtggatggcttctctgccccctcacctcgacagctgaatccctgccacccagggccggagcagctcagtggcattcactcagtgcctgctgtgtacctggcactcggcagttctcaaggcatgtcacgcatgaggaaggcgggagaggtgtttttagcttccttgtatactgaagcttgcaaaggctacagtttacccaactaaacttgactcctgcattctaatcatgtgttctttctcctccatccctggacttaggataactagttgctggtgatgacttcgtgtcaagaacagcagtgaacctgggttgcttcccaaattgtggacgaggccttctgggatgggcagaagtggagaatggtgattaacacacctgtgatccctccctcgctcactcctctcagtttccctccacccaacacacttggtgtggactcccctgcaccccgccctagaaacaggacctggtcctctcactgtcagctgtggcagaaggttgtggcagcgggttgccttctgtctcgggggtcttgaggctgtcggtccggacgatgcaggtgaggcagtgtcagttctgcatcaggaacccctcgcgctgtaatcctttgatatttttcaagccatgagaaaaatgaagtggacttaccagggtccctccagtgacctagtggatgttcttacaggactgccgtgtgccactggctgtggcttccctggtcctgtgcttggccaccgggagctggcatctccaaaatagagcctccttagcctgtgcaggtgggctgtcttccaaagtcaccacaccagtgacttgtgctgtgcggagccttcctcaccaggaccactggctgctcctgtggctagaagtcacaattataggcttcattgcaagagccagcatttgagtttcttctgggcacctgccactgtgcatgtgtgacctcaactgctttgtgcaccctgactggggggtaggtgctagcgttccaacattacagatgagaaaaccgaggcacacagaagaggtaacctgcccaaggtcacaggtgttaggtggcagagccaagatgttattgtcagtctgacttcaggtgcataaaacctgaggctgagcctccccatgagaggaaaaatgtgtttgtggtgtgacctcagttgccagggaacttgtgcaggaagccgggagagatggcacagacccacctgtgctcacagtacatgttaagaattcccaagtctcaggcaaaccatctccaagggtgttcacagaagacacaccttaaaggcaaacgggttcatgatgtaatcttctattgactagctgtgaacctcatttttcttatctgtgaagtgggaacagtaataatccaagtctttttatggagttatcaagatcaaaaaaggaatggatatacaaagtgttttgtgaaataaaagctccctaaaatggt

SEQ ID NO: 1069 - DNA, 631 bp, Homo sapiens
ggacgctcggcggccgcgacggggggcgctggcggcggcggacgctgcagcggcggcggggctggcgccgcggcggctcccgggccgggacaggcctgggcaccgggcggagctccgcggccgggcggcagcggcgcggagcgggcacggcgcctgcagccgggccccggccccgggggcgccgcctccccccgcaccttctgcacggctggcctgccactcctcctgctatgatgcctgggcagatcccggacccttcggtgaccacaggctccctgccagggcttggccccctgaccgggctccccagctcggccctgactgtggaggagctgaaatacgctgacatccgcaacctcggggccatgattgcacccttgcacttcctggaggtgaaactgggcaagaggccccagcccgtgaaaagtgagctagatgaggaagaggagcgaaggaaaaggcgccgggagaagaacaaagtcgcagcagcccgatgccggaacaagaagaaggagcgcacggagtttctgcagcgggaatccgagcggctggaactcatgaacgcagagctgaagacccagattgaggagctgaagcaggagcggcagcagctcatcctgatgctgaaccg

SEQ ID NO: 1070 - DNA, 9153 bp, Homo sapiens
actgtctccaagatggcggccgtgtcagtttggggcatctccgcggtccggcccggggccccgggatctcggctgtccttcctcccggcataagatgcacatttttctgctctggagccgggaatgaaatattcttgagttcttacaactttatgacgagacccatgtgtggtgctattgagaaattcattgggaagttggaagacatttcaatcaacaggttgttttggtttctatagtacaattggggtggcattctgttttgtgaaaggaggaaggacttaggccagaaaactcatatgctatggttaactggttcccagcctccgagaatcttgttttccatggtgtaaaacttactcagcatcaggataagggataacgactctatggatatacagaatccttcaccatggtaaaactcgcaaacccgctttatactgagtggattttggaggccatcaaaaaagtgaaaaagcagaaacagcgtccttcagaagaaaggatatgcaatgctgtgtcttcatcccatggcttggatcgtaaaactgttttagaacaattggagttgagtgttaaagatggaacaattttaaaagtctcaaataaaggactcaattcctataaagatcctgataatcctgggcgaatagcacttcctaagcctcggaaccatggaaaattggataataaacaaaatgtggattggaataaactgataaagcgggcagttgagggcttggcagagtctggtggctcaactttgaaaagcattgaacgttttttgaaaggtcagaaggatgtgtctgcattattcggaggcagtgctgcctctggctttcaccagcagttacgattggctatcaaacgtgccattggccacggcagactccttaaagatggacctctttatcggctcaacactaaagcaaccaacgtggatgggaaagagagttgtgagtctctttcctgtttacctccagtgtcccttcttccacatgaaaaggataagccggttgctgaaccaatccccatctgtagtttctgtcttggtacaaaagaacaaaaccgagaaaagaagccagaggaactcatctcctgtgccgactgtggcaacagtggccatccatcctgtttaaagttttcccctgaactaacggttcgagtgaaggccttacggtggcagtgcatcgagtgtaaaacatgcagctcctgtcgagatcaaggcaaaaatgcggataacatgctcttttgtgattcatgtgaccgaggttttcacatggagtgttgtgatccgccactcacccgtatgccaaaaggcatgtggatatgtcaaatatgtcgacctaggaaaaaaggacgaaaacttctacaaaagaaggcagcacagataaaacggcgctatactaatccaataggacgtccaaaaaacaggttaaagaaacaaaacacggtatcaaaaggtcccttcagcaaagttcgaactggccctggaaggggtaggaaacgaaaaatcactctttccagccaatcagcatcatcatcatcagaagaaggatatttagagcggatagatggcttggacttctgcagagatagcaatgtctccttgaagttcaacaagaaaaccaaagggctcattgatggccttaccaaattttttaccccttcccctgatgggcggaaagctcggggggaagtggtggactactctgagcaatatcgaatcagaaagaggggcaacaggaaatcaagcacttcagattggcccacagacaatcaggatggctgggatggcaaacaagaaaatgaggagcgactttttgggagccaggaaatcatgactgagaaagatatggaattatttcgtgatatccaagaacaagcactgcagaaagttggagtgactggtccccctgatccacaagtccgctgtccctctgtcattgagtttgggaagtatgaaattcacacctggtactcctccccatatcctcaagaatactcaaggctgcccaaattgtatctttgtgaattttgtctaaaatatatgaaaagtagaactattctgcagcagcacatgaagaaatgtggttggttccatcctcctgccaatgagatttacagaaagaataatatttctgtctttgaggttgatgggaatgtgagtaccatttattgtcaaaacctgtgtcttttggcaaagttgtttcttgaccacaaaaccctctattacgatgtggagccatttcttttttatgtactaacacagaatgatgtcaagggctgccaccttgttggctacttttctaaggaaaagcactgccaacagaagtacaatgtttcctgtataatgattcttcctcaataccagcgtaagggctatggcaggtttctcatcgatttcagttatttgttatcaaagcgtgaaggccaagcagggtctccagagaaaccgttatctgatctgggtcgtctttcctacatggcatattggaaaagtgtaatattggagtgcctttatcaccaaaatgacaagcagatcagcattaagaagttaagcaagttgactggaatctgccctcaagacatcacttccacactccaccacctacgaatgctggacttccgtagtgaccaatttgtgattatccgccgggaaaaacttatccaggatcacatggcaaagcttcagctgaatttgcgacctgtagatgtagatccagaatgtttgcgctggactccagtcatagtgtccaactctgtggtctcagaggaggaagaagaggaggctgaggaaggagaaaacgaagagccacagtgccaggaaagagaattagagatcagtgtgggaaagtctgtgtctcatgagaacaaagaacaagattcttattcagtagaaagtgaaaagaaaccagaagttatggctccagtcagttctacacgtttgagcaaacaagtccttcctcatgatagtcttcctgcaaatagccagccatctcggaggggccgctgggggaggaagaacagaaaaacccaggaacgttttggtgataaagattctaaactgctcttggaagagacgtcttcagctcctcaggaacaatatggagaatgtggggagaaatcagaagccacccaggaacaatacactgaaagtgaagaacagctggtggcttctgaggagcagccaagccaggacgggaaacctgaccttcccaagagaagactcagtgagggggttgagccctggcgaggacagctcaagaaaagccctgaggctctgaagtgcagattaacagaaggaagtgagaggctgccccgtcgctacagtgagggtgacagggctgtcctcaggggcttcagtgagagcagcgaggaggaggaggagccggaaagccctcggtcaagctcgccaccaattctcacaaagcccacgctgaagcgaaagaaaccatttctccaccgaaggaggagagtccgaaagcgcaaacaccacaatagcagtgtagtcacagaaactatttctgagaccactgaagtgttagatgaaccttttgaagattctgactccgagaggccaatgccaagattagaacccacgtttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgacactcctatcttaaagccagtatctcttttgcgaaaacgtgatgtgaagaattctcctcttgagccagatacatccacacctttgaaaaagaaaaagggatggcccaaaggcaagagccgcaaaccaatccactggaagaaaagacctggtcgaaaaccaggatttaagttgagtcgggaaatcatgccagtttctactcaagcatgcgtcattgagcccatcgtttccattcctaaagctggacgtaaacccaagatccaggagagtgaagaaactgttgagccaaaagaagacatgcccctacccgaggagaggaaggaggaggaggagatgcaagcagaggcagaagaggctgaagagggtgaggaagaggatgcagccagcagtgaagtcccagcagcctctccagcagacagcagcaatagtcctgagaccgaaaccaaggagcctgaggtggaggaggaagaagagaagccccgtgtctcagaggagcagaggcagtcagaggaggagcagcaggaattagaggagccagagccagaggaggaggaagatgcagctgcagagactgcccagaatgacgaccacgacgctgatgatgaggatgatggccacctggagtccacaaagaaaaaggagctagaggaacagcccacgagggaagatgtcaaggaggagcctggtgttcaagagtcttttttagatgctaatatgcagaagagtagggaaaagataaaggataaagaggaaaccgagctggattccgaagaggagcagccttcccatgacacgtccgtggtgtcagagcagatggctgggtctgaggacgaccacgaagaagactcccacactaaggaagagttaatcgaattaaaagaggaggaagagattcctcatagtgagctggatctggaaactgtacaggcagtgcagtctttgactcaagaagaaagcagtgagcatgagggcgcctaccaggactgtgaggaaactcttgcggcgtgtcagaccctgcagagttacacccaggctgacgaggaccctcagatgtccatggttgaagactgtcatgcgtcagaacataatagccctatctcctccgttcagtctcaccccagccagtcagtccgttcggtcagcagtcccaacgtgcctgcccttgagagtggctacacccagatcagcccagaacaaggatccctgtccgcaccctctatgcagaacatggagaccagccccatgatggatgtgccttccgtatcagaccactctcagcaggtggtggacagcggcttcagtgacctgggcagcattgagagcaccactgaaaactatgagaacccaagcagttacgactccacgatgggcggcagcatctgtgggaacagctcttcccagagcagctgctcctacggtgggctgtcgtcctccagcagcctcacccagagcagctgtgtggtcactcagcagatggccagcatgggcagcagctgcagcatgatgcagcagagcagcgtccagcctgctgccaactgcagcatcaagtcacctcagagctgcgtggtggagaggcctcccagtaaccagcagcagcagccgccaccaccgcctccacagcagccacagccgccgccgccacaaccacaaccagcaccacagcctccaccaccccagcagcagccgcaacagcagccgcagcctcagccccagcagcctccacccccaccccctccccagcagcagcccccgctgtcacagtgtagtatgaataacagtttcaccccagctcctatgatcatggagataccagaatctggaagcactgggaacataagtatctatgagaggattccaggggattttggtgccggcagctactctcaaccatcagccaccttcagcctagccaagctgcagcagctgaccaacaccattatggaccctcatgccatgccttatagccattctcctgctgtgacttcctatgcaaccagtgtttctctgtccaatacaggactggctcagctggctccatctcatcccttagctgggactcctcaagcacaagccaccatgacgccacccccaaacttggcatccactaccatgaacctcacatctcctctgcttcagtgcaacatgtctgccaccaacattggcattcctcacacgcagagattgcaagggcaaatgccagtgaaggggcacatttccatccgctccaagtctgcgccactgccctctgcggctgctcaccagcagcagctgtatggccgtagcccatcggcagttgccatgcaggctggccctcgcgcactggctgttcagcgtggcatgaacatgggggttaatctgatgcctactcccgcctataatgtcaattccatgaatatgaacaccttgaatgccatgaacagctatcgaatgacacagcccatgatgaacagcagttaccatagtaaccctgcctacatgaaccagacagcacagtatcctatgcagatgcagatgggaatgatggggagccaggcctatacccagcagcctatgcagcctaaccctcatgggaacatgatgtacacaggcccctcccatcacagctacatgaacgctgctggcgtgcccaagcagtcactcaacggaccttacatgagaagatgagcaagatgaacttgcaatcaaaaacttaaatatatataaataaaggaaccttttatactgacaaaccagagaaaaatggacctttttccagttaaaatattgctgtagatttagaggaatttttctttggtttattttattttttagaaaacctgatcttctctttttttgggttcattttgttctgggttttggttttcttcacaatcttgaacattttacagtagaactcatctaaaaatggatttggggatggggaaacatgcacaaaatcttttcataattaaaaagagccttactttctttacataccacatggacagaatttgtgtaaaagtgaattatctttattttaaaatgtatgtttcccctcactgtttgcagctcccaatgttgtcatttttaaatgttatatacatctcaagggttaaccagaccctttcctccaaacccaacctttcatttcctacttcattccagcaggaggcacttaggggagactcggatggggacatggagaacaacccaagctccttaaacttattattattgttaatattattattattattattaataaagtgaggcaggaaaatgcttctccttttaaaatcccctccactcctcacacacacacacctcttgaaacccttccccaagaatgtttctttatagacggacttcattgaaatctttgttgttcttgaatcaagtgtaatataatttttttcttcttttttaaaatattcccactcagcactcagagacacaaaaatactgtaagtctcaattaacagcagaatctcagagaaaagctgtttgcaatccaaatccagcctttggaggaatagagatggtcaattaacaatcaaaaagaggagattaacctcttgtttttttaccacctggtgaatcagccataacgcacacacacgccacccagcctcttgtttctagtatgtactttgaaatgctaactgagggtcttgatgcttgagcctttgactgataaaactcaaatagcagtccccagtgatttgcctcttaggttctttcttaaattgttggtggatgactgtacattttagtgatttgaaaaataactgacaaaccattgaaacagtttattttatgttggaagagatggcgcagatgtgtgtcagaagggagatcacggtgtgagtttcgtagctatttaagtgatacatacctctagtttttgtatgtcttttgagatcctgagttcatcccctgtgaatcagagtgcacaagcacctctcctgtgagtggctaatgagaagagggacagaccgaccaccagcacagtagggcagatctggacagcagaatgttataacgcaagttcatgtgttgctcccaactccattctcttttctctcgtgcaaccagtttgcccattctcttcctattacttgctccagggataggtaaaaaaaaaaaaaaaaaaaaaaaaaatatatatatatatatatacacacacacacacacacacacacacacatatatatatatatatattccatcattagaagatggaaactattataccacttggtatgtgcagtcaaatatccaaaagggggaagtactgcttagagaaatatctgtaagcattaaattctctcctttatttgtacattttatatagataaatttttaaagtactaattaggcattaacttttttcaaatgcacaggtttgttggtttttttaatacactttaattgactttctcaagcgtgctaggtagaaacgcagaattccacatcttcccgctctcagctctgagcatgtgcaaggctgtgtaggacccagtttctctgtatatactattccagttcccagtcatctatgtagaaagtgcactgtgctgccatcgccctacatcttcagctgtgtcattgcttcctggttggggtggggacggggtgggtcgggagggaggtatattgggaggagggtgggtcaaggcagaaggagaagctgttgaaatgagggccgtgaaatcagtttctgttggtttgcggttgtgtttggttttgtttgtttctttataaaaaattcaatcgggcagctcccttttccacaagcctctttgtgactgtagaactattgtagaaaaaaaaagttcttttctatattataaaagaaattatccaacacagtaatattggtacctgtcattttttcacttctgtttaaaaaaaatgtatttttagcaagataacttgggtaatcttctaaaaaagaaatttaaaaactcactgttagtgactttgatgccttttaaaataagagctttttcatttcattccatctttaaaattttttatctttgttgtagaatattaaaaactattttaagaaagataaattctctttaaagagatctctagcgtgtgtgaatagagctccagatgcctctaaaagccgcatgtacaaaggaagccacgtctatcctgtctgtttatatttgcttttcctgttttgtaacctctttgtactttgttcatggtgacttgtaagctaaggggaaggggtgcctagatgcctttgtatctctccatgtcacgcgctcctgggccagccggcctcccttcctctccttgtatgtaatacctttttttcccctttctagcaagtactttcaaaagaactctgtacattttaacataaaaaataaattatgttgagccattttgga

SEQ ID NO: 1071 - DNA, 9285 bp, Homo sapiens
actgtctccaagatggcggccgtgtcagtttggggcatctccgcggtccggcccggggccccgggatctcggctgtccttcctcccggattctttctactaatccagatacttgttgaagtgctgactagtttcttggggaaagatgtcaaggaagagttgaaattcctagactggtgagcagagattgcggagtacagaatagccatcacccactctggcataagatgcacatttttctgctctggagccgggaatgaaatattcttgagttcttacaactttatgacgagacccatgtgtggtgctattgagaaattcattgggaagttggaagacatttcaatcaacaggttgttttggtttctatagtacaattggggtggcattctgttttgtgaaaggaggaaggacttaggccagaaaactcatatgctatggttaactggttcccagcctccgagaatcttgttttccatggtgtaaaacttactcagcatcaggataagggataacgactctatggatatacagaatccttcaccatggtaaaactcgcaaacccgctttatactgagtggattttggaggccatcaaaaaagtgaaaaagcagaaacagcgtccttcagaagaaaggatatgcaatgctgtgtcttcatcccatggcttggatcgtaaaactgttttagaacaattggagttgagtgttaaagatggaacaattttaaaagtctcaaataaaggactcaattcctataaagatcctgataatcctgggcgaatagcacttcctaagcctcggaaccatggaaaattggataataaacaaaatgtggattggaataaactgataaagcgggcagttgagggcttggcagagtctggtggctcaactttgaaaagcattgaacgttttttgaaaggtcagaaggatgtgtctgcattattcggaggcagtgctgcctctggctttcaccagcagttacgattggctatcaaacgtgccattggccacggcagactccttaaagatggacctctttatcggctcaacactaaagcaaccaacgtggatgggaaagagagttgtgagtctctttcctgtttacctccagtgtcccttcttccacatgaaaaggataagccggttgctgaaccaatccccatctgtagtttctgtcttggtacaaaagaacaaaaccgagaaaagaagccagaggaactcatctcctgtgccgactgtggcaacagtggccatccatcctgtttaaagttttcccctgaactaacggttcgagtgaaggccttacggtggcagtgcatcgagtgtaaaacatgcagctcctgtcgagatcaaggcaaaaatgcggataacatgctcttttgtgattcatgtgaccgaggttttcacatggagtgttgtgatccgccactcacccgtatgccaaaaggcatgtggatatgtcaaatatgtcgacctaggaaaaaaggacgaaaacttctacaaaagaaggcagcacagataaaacggcgctatactaatccaataggacgtccaaaaaacaggttaaagaaacaaaacacggtatcaaaaggtcccttcagcaaagttcgaactggccctggaaggggtaggaaacgaaaaatcactctttccagccaatcagcatcatcatcatcagaagaaggatatttagagcggatagatggcttggacttctgcagagatagcaatgtctccttgaagttcaacaagaaaaccaaagggctcattgatggccttaccaaattttttaccccttcccctgatgggcggaaagctcggggggaagtggtggactactctgagcaatatcgaatcagaaagaggggcaacaggaaatcaagcacttcagattggcccacagacaatcaggatggctgggatggcaaacaagaaaatgaggagcgactttttgggagccaggaaatcatgactgagaaagatatggaattatttcgtgatatccaagaacaagcactgcagaaagttggagtgactggtccccctgatccacaagtccgctgtccctctgtcattgagtttgggaagtatgaaattcacacctggtactcctccccatatcctcaagaatactcaaggctgcccaaattgtatctttgtgaattttgtctaaaatatatgaaaagtagaactattctgcagcagcacatgaagaaatgtggttggttccatcctcctgccaatgagatttacagaaagaataatatttctgtctttgaggttgatgggaatgtgagtaccatttattgtcaaaacctgtgtcttttggcaaagttgtttcttgaccacaaaaccctctattacgatgtggagccatttcttttttatgtactaacacagaatgatgtcaagggctgccaccttgttggctacttttctaaggaaaagcactgccaacagaagtacaatgtttcctgtataatgattcttcctcaataccagcgtaagggctatggcaggtttctcatcgatttcagttatttgttatcaaagcgtgaaggccaagcagggtctccagagaaaccgttatctgatctgggtcgtctttcctacatggcatattggaaaagtgtaatattggagtgcctttatcaccaaaatgacaagcagatcagcattaagaagttaagcaagttgactggaatctgccctcaagacatcacttccacactccaccacctacgaatgctggacttccgtagtgaccaatttgtgattatccgccgggaaaaacttatccaggatcacatggcaaagcttcagctgaatttgcgacctgtagatgtagatccagaatgtttgcgctggactccagtcatagtgtccaactctgtggtctcagaggaggaagaagaggaggctgaggaaggagaaaacgaagagccacagtgccaggaaagagaattagagatcagtgtgggaaagtctgtgtctcatgagaacaaagaacaagattcttattcagtagaaagtgaaaagaaaccagaagttatggctccagtcagttctacacgtttgagcaaacaagtccttcctcatgatagtcttcctgcaaatagccagccatctcggaggggccgctgggggaggaagaacagaaaaacccaggaacgttttggtgataaagattctaaactgctcttggaagagacgtcttcagctcctcaggaacaatatggagaatgtggggagaaatcagaagccacccaggaacaatacactgaaagtgaagaacagctggtggcttctgaggagcagccaagccaggacgggaaacctgaccttcccaagagaagactcagtgagggggttgagccctggcgaggacagctcaagaaaagccctgaggctctgaagtgcagattaacagaaggaagtgagaggctgccccgtcgctacagtgagggtgacagggctgtcctcaggggcttcagtgagagcagcgaggaggaggaggagccggaaagccctcggtcaagctcgccaccaattctcacaaagcccacgctgaagcgaaagaaaccatttctccaccgaaggaggagagtccgaaagcgcaaacaccacaatagcagtgtagtcacagaaactatttctgagaccactgaagtgttagatgaaccttttgaagattctgactccgagaggccaatgccaagattagaacccacgtttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgacactcctatcttaaagccagtatctcttttgcgaaaacgtgatgtgaagaattctcctcttgagccagatacatccacacctttgaaaaagaaaaagggatggcccaaaggcaagagccgcaaaccaatccactggaagaaaagacctggtcgaaaaccaggatttaagttgagtcgggaaatcatgccagtttctactcaagcatgcgtcattgagcccatcgtttccattcctaaagctggacgtaaacccaagatccaggagagtgaagaaactgttgagccaaaagaagacatgcccctacccgaggagaggaaggaggaggaggagatgcaagcagaggcagaagaggctgaagagggtgaggaagaggatgcagccagcagtgaagtcccagcagcctctccagcagacagcagcaatagtcctgagaccgaaaccaaggagcctgaggtggaggaggaagaagagaagccccgtgtctcagaggagcagaggcagtcagaggaggagcagcaggaattagaggagccagagccagaggaggaggaagatgcagctgcagagactgcccagaatgacgaccacgacgctgatgatgaggatgatggccacctggagtccacaaagaaaaaggagctagaggaacagcccacgagggaagatgtcaaggaggagcctggtgttcaagagtcttttttagatgctaatatgcagaagagtagggaaaagataaaggataaagaggaaaccgagctggattccgaagaggagcagccttcccatgacacgtccgtggtgtcagagcagatggctgggtctgaggacgaccacgaagaagactcccacactaaggaagagttaatcgaattaaaagaggaggaagagattcctcatagtgagctggatctggaaactgtacaggcagtgcagtctttgactcaagaagaaagcagtgagcatgagggcgcctaccaggactgtgaggaaactcttgcggcgtgtcagaccctgcagagttacacccaggctgacgaggaccctcagatgtccatggttgaagactgtcatgcgtcagaacataatagccctatctcctccgttcagtctcaccccagccagtcagtccgttcggtcagcagtcccaacgtgcctgcccttgagagtggctacacccagatcagcccagaacaaggatccctgtccgcaccctctatgcagaacatggagaccagccccatgatggatgtgccttccgtatcagaccactctcagcaggtggtggacagcggcttcagtgacctgggcagcattgagagcaccactgaaaactatgagaacccaagcagttacgactccacgatgggcggcagcatctgtgggaacagctcttcccagagcagctgctcctacggtgggctgtcgtcctccagcagcctcacccagagcagctgtgtggtcactcagcagatggccagcatgggcagcagctgcagcatgatgcagcagagcagcgtccagcctgctgccaactgcagcatcaagtcacctcagagctgcgtggtggagaggcctcccagtaaccagcagcagcagccgccaccaccgcctccacagcagccacagccgccgccgccacaaccacaaccagcaccacagcctccaccaccccagcagcagccgcaacagcagccgcagcctcagccccagcagcctccacccccaccccctccccagcagcagcccccgctgtcacagtgtagtatgaataacagtttcaccccagctcctatgatcatggagataccagaatctggaagcactgggaacataagtatctatgagaggattccaggggattttggtgccggcagctactctcaaccatcagccaccttcagcctagccaagctgcagcagctgaccaacaccattatggaccctcatgccatgccttatagccattctcctgctgtgacttcctatgcaaccagtgtttctctgtccaatacaggactggctcagctggctccatctcatcccttagctgggactcctcaagcacaagccaccatgacgccacccccaaacttggcatccactaccatgaacctcacatctcctctgcttcagtgcaacatgtctgccaccaacattggcattcctcacacgcagagattgcaagggcaaatgccagtgaaggggcacatttccatccgctccaagtctgcgccactgccctctgcggctgctcaccagcagcagctgtatggccgtagcccatcggcagttgccatgcaggctggccctcgcgcactggctgttcagcgtggcatgaacatgggggttaatctgatgcctactcccgcctataatgtcaattccatgaatatgaacaccttgaatgccatgaacagctatcgaatgacacagcccatgatgaacagcagttaccatagtaaccctgcctacatgaaccagacagcacagtatcctatgcagatgcagatgggaatgatggggagccaggcctatacccagcagcctatgcagcctaaccctcatgggaacatgatgtacacaggcccctcccatcacagctacatgaacgctgctggcgtgcccaagcagtcactcaacggaccttacatgagaagatgagcaagatgaacttgcaatcaaaaacttaaatatatataaataaaggaaccttttatactgacaaaccagagaaaaatggacctttttccagttaaaatattgctgtagatttagaggaatttttctttggtttattttattttttagaaaacctgatcttctctttttttgggttcattttgttctgggttttggttttcttcacaatcttgaacattttacagtagaactcatctaaaaatggatttggggatggggaaacatgcacaaaatcttttcataattaaaaagagccttactttctttacataccacatggacagaatttgtgtaaaagtgaattatctttattttaaaatgtatgtttcccctcactgtttgcagctcccaatgttgtcatttttaaatgttatatacatctcaagggttaaccagaccctttcctccaaacccaacctttcatttcctacttcattccagcaggaggcacttaggggagactcggatggggacatggagaacaacccaagctccttaaacttattattattgttaatattattattattattattaataaagtgaggcaggaaaatgcttctccttttaaaatcccctccactcctcacacacacacacctcttgaaacccttccccaagaatgtttctttatagacggacttcattgaaatctttgttgttcttgaatcaagtgtaatataatttttttcttcttttttaaaatattcccactcagcactcagagacacaaaaatactgtaagtctcaattaacagcagaatctcagagaaaagctgtttgcaatccaaatccagcctttggaggaatagagatggtcaattaacaatcaaaaagaggagattaacctcttgtttttttaccacctggtgaatcagccataacgcacacacacgccacccagcctcttgtttctagtatgtactttgaaatgctaactgagggtcttgatgcttgagcctttgactgataaaactcaaatagcagtccccagtgatttgcctcttaggttctttcttaaattgttggtggatgactgtacattttagtgatttgaaaaataactgacaaaccattgaaacagtttattttatgttggaagagatggcgcagatgtgtgtcagaagggagatcacggtgtgagtttcgtagctatttaagtgatacatacctctagtttttgtatgtcttttgagatcctgagttcatcccctgtgaatcagagtgcacaagcacctctcctgtgagtggctaatgagaagagggacagaccgaccaccagcacagtagggcagatctggacagcagaatgttataacgcaagttcatgtgttgctcccaactccattctcttttctctcgtgcaaccagtttgcccattctcttcctattacttgctccagggataggtaaaaaaaaaaaaaaaaaaaaaaaaaatatatatatatatatatacacacacacacacacacacacacacacatatatatatatatatattccatcattagaagatggaaactattataccacttggtatgtgcagtcaaatatccaaaagggggaagtactgcttagagaaatatctgtaagcattaaattctctcctttatttgtacattttatatagataaatttttaaagtactaattaggcattaacttttttcaaatgcacaggtttgttggtttttttaatacactttaattgactttctcaagcgtgctaggtagaaacgcagaattccacatcttcccgctctcagctctgagcatgtgcaaggctgtgtaggacccagtttctctgtatatactattccagttcccagtcatctatgtagaaagtgcactgtgctgccatcgccctacatcttcagctgtgtcattgcttcctggttggggtggggacggggtgggtcgggagggaggtatattgggaggagggtgggtcaaggcagaaggagaagctgttgaaatgagggccgtgaaatcagtttctgttggtttgcggttgtgtttggttttgtttgtttctttataaaaaattcaatcgggcagctcccttttccacaagcctctttgtgactgtagaactattgtagaaaaaaaaagttcttttctatattataaaagaaattatccaacacagtaatattggtacctgtcattttttcacttctgtttaaaaaaaatgtatttttagcaagataacttgggtaatcttctaaaaaagaaatttaaaaactcactgttagtgactttgatgccttttaaaataagagctttttcatttcattccatctttaaaattttttatctttgttgtagaatattaaaaactattttaagaaagataaattctctttaaagagatctctagcgtgtgtgaatagagctccagatgcctctaaaagccgcatgtacaaaggaagccacgtctatcctgtctgtttatatttgcttttcctgttttgtaacctctttgtactttgttcatggtgacttgtaagctaaggggaaggggtgcctagatgcctttgtatctctccatgtcacgcgctcctgggccagccggcctcccttcctctccttgtatgtaatacctttttttcccctttctagcaagtactttcaaaagaactctgtacattttaacataaaaaataaattatgttgagccattttgga

SEQ ID NO: 1072 - DNA, 9241 bp, Homo sapiens
actgtctccaagatggcggccgtgtcagtttggggcatctccgcggtccggcccggggccccgggatctcggctgtccttcctcccggattctttctactaatccagatacttgttgaagtgctgactagtttcttggggaaagatgtcaaggaagagttgaaattcctagactggcataagatgcacatttttctgctctggagccgggaatgaaatattcttgagttcttacaactttatgacgagacccatgtgtggtgctattgagaaattcattgggaagttggaagacatttcaatcaacaggttgttttggtttctatagtacaattggggtggcattctgttttgtgaaaggaggaaggacttaggccagaaaactcatatgctatggttaactggttcccagcctccgagaatcttgttttccatggtgtaaaacttactcagcatcaggataagggataacgactctatggatatacagaatccttcaccatggtaaaactcgcaaacccgctttatactgagtggattttggaggccatcaaaaaagtgaaaaagcagaaacagcgtccttcagaagaaaggatatgcaatgctgtgtcttcatcccatggcttggatcgtaaaactgttttagaacaattggagttgagtgttaaagatggaacaattttaaaagtctcaaataaaggactcaattcctataaagatcctgataatcctgggcgaatagcacttcctaagcctcggaaccatggaaaattggataataaacaaaatgtggattggaataaactgataaagcgggcagttgagggcttggcagagtctggtggctcaactttgaaaagcattgaacgttttttgaaaggtcagaaggatgtgtctgcattattcggaggcagtgctgcctctggctttcaccagcagttacgattggctatcaaacgtgccattggccacggcagactccttaaagatggacctctttatcggctcaacactaaagcaaccaacgtggatgggaaagagagttgtgagtctctttcctgtttacctccagtgtcccttcttccacatgaaaaggataagccggttgctgaaccaatccccatctgtagtttctgtcttggtacaaaagaacaaaaccgagaaaagaagccagaggaactcatctcctgtgccgactgtggcaacagtggccatccatcctgtttaaagttttcccctgaactaacggttcgagtgaaggccttacggtggcagtgcatcgagtgtaaaacatgcagctcctgtcgagatcaaggcaaaaatgcggataacatgctcttttgtgattcatgtgaccgaggttttcacatggagtgttgtgatccgccactcacccgtatgccaaaaggcatgtggatatgtcaaatatgtcgacctaggaaaaaaggacgaaaacttctacaaaagaaggcagcacagataaaacggcgctatactaatccaataggacgtccaaaaaacaggttaaagaaacaaaacacggtatcaaaaggtcccttcagcaaagttcgaactggccctggaaggggtaggaaacgaaaaatcactctttccagccaatcagcatcatcatcatcagaagaaggatatttagagcggatagatggcttggacttctgcagagatagcaatgtctccttgaagttcaacaagaaaaccaaagggctcattgatggccttaccaaattttttaccccttcccctgatgggcggaaagctcggggggaagtggtggactactctgagcaatatcgaatcagaaagaggggcaacaggaaatcaagcacttcagattggcccacagacaatcaggatggctgggatggcaaacaagaaaatgaggagcgactttttgggagccaggaaatcatgactgagaaagatatggaattatttcgtgatatccaagaacaagcactgcagaaagttggagtgactggtccccctgatccacaagtccgctgtccctctgtcattgagtttgggaagtatgaaattcacacctggtactcctccccatatcctcaagaatactcaaggctgcccaaattgtatctttgtgaattttgtctaaaatatatgaaaagtagaactattctgcagcagcacatgaagaaatgtggttggttccatcctcctgccaatgagatttacagaaagaataatatttctgtctttgaggttgatgggaatgtgagtaccatttattgtcaaaacctgtgtcttttggcaaagttgtttcttgaccacaaaaccctctattacgatgtggagccatttcttttttatgtactaacacagaatgatgtcaagggctgccaccttgttggctacttttctaaggaaaagcactgccaacagaagtacaatgtttcctgtataatgattcttcctcaataccagcgtaagggctatggcaggtttctcatcgatttcagttatttgttatcaaagcgtgaaggccaagcagggtctccagagaaaccgttatctgatctgggtcgtctttcctacatggcatattggaaaagtgtaatattggagtgcctttatcaccaaaatgacaagcagatcagcattaagaagttaagcaagttgactggaatctgccctcaagacatcacttccacactccaccacctacgaatgctggacttccgtagtgaccaatttgtgattatccgccgggaaaaacttatccaggatcacatggcaaagcttcagctgaatttgcgacctgtagatgtagatccagaatgtttgcgctggactccagtcatagtgtccaactctgtggtctcagaggaggaagaagaggaggctgaggaaggagaaaacgaagagccacagtgccaggaaagagaattagagatcagtgtgggaaagtctgtgtctcatgagaacaaagaacaagattcttattcagtagaaagtgaaaagaaaccagaagttatggctccagtcagttctacacgtttgagcaaacaagtccttcctcatgatagtcttcctgcaaatagccagccatctcggaggggccgctgggggaggaagaacagaaaaacccaggaacgttttggtgataaagattctaaactgctcttggaagagacgtcttcagctcctcaggaacaatatggagaatgtggggagaaatcagaagccacccaggaacaatacactgaaagtgaagaacagctggtggcttctgaggagcagccaagccaggacgggaaacctgaccttcccaagagaagactcagtgagggggttgagccctggcgaggacagctcaagaaaagccctgaggctctgaagtgcagattaacagaaggaagtgagaggctgccccgtcgctacagtgagggtgacagggctgtcctcaggggcttcagtgagagcagcgaggaggaggaggagccggaaagccctcggtcaagctcgccaccaattctcacaaagcccacgctgaagcgaaagaaaccatttctccaccgaaggaggagagtccgaaagcgcaaacaccacaatagcagtgtagtcacagaaactatttctgagaccactgaagtgttagatgaaccttttgaagattctgactccgagaggccaatgccaagattagaacccacgtttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgacactcctatcttaaagccagtatctcttttgcgaaaacgtgatgtgaagaattctcctcttgagccagatacatccacacctttgaaaaagaaaaagggatggcccaaaggcaagagccgcaaaccaatccactggaagaaaagacctggtcgaaaaccaggatttaagttgagtcgggaaatcatgccagtttctactcaagcatgcgtcattgagcccatcgtttccattcctaaagctggacgtaaacccaagatccaggagagtgaagaaactgttgagccaaaagaagacatgcccctacccgaggagaggaaggaggaggaggagatgcaagcagaggcagaagaggctgaagagggtgaggaagaggatgcagccagcagtgaagtcccagcagcctctccagcagacagcagcaatagtcctgagaccgaaaccaaggagcctgaggtggaggaggaagaagagaagccccgtgtctcagaggagcagaggcagtcagaggaggagcagcaggaattagaggagccagagccagaggaggaggaagatgcagctgcagagactgcccagaatgacgaccacgacgctgatgatgaggatgatggccacctggagtccacaaagaaaaaggagctagaggaacagcccacgagggaagatgtcaaggaggagcctggtgttcaagagtcttttttagatgctaatatgcagaagagtagggaaaagataaaggataaagaggaaaccgagctggattccgaagaggagcagccttcccatgacacgtccgtggtgtcagagcagatggctgggtctgaggacgaccacgaagaagactcccacactaaggaagagttaatcgaattaaaagaggaggaagagattcctcatagtgagctggatctggaaactgtacaggcagtgcagtctttgactcaagaagaaagcagtgagcatgagggcgcctaccaggactgtgaggaaactcttgcggcgtgtcagaccctgcagagttacacccaggctgacgaggaccctcagatgtccatggttgaagactgtcatgcgtcagaacataatagccctatctcctccgttcagtctcaccccagccagtcagtccgttcggtcagcagtcccaacgtgcctgcccttgagagtggctacacccagatcagcccagaacaaggatccctgtccgcaccctctatgcagaacatggagaccagccccatgatggatgtgccttccgtatcagaccactctcagcaggtggtggacagcggcttcagtgacctgggcagcattgagagcaccactgaaaactatgagaacccaagcagttacgactccacgatgggcggcagcatctgtgggaacagctcttcccagagcagctgctcctacggtgggctgtcgtcctccagcagcctcacccagagcagctgtgtggtcactcagcagatggccagcatgggcagcagctgcagcatgatgcagcagagcagcgtccagcctgctgccaactgcagcatcaagtcacctcagagctgcgtggtggagaggcctcccagtaaccagcagcagcagccgccaccaccgcctccacagcagccacagccgccgccgccacaaccacaaccagcaccacagcctccaccaccccagcagcagccgcaacagcagccgcagcctcagccccagcagcctccacccccaccccctccccagcagcagcccccgctgtcacagtgtagtatgaataacagtttcaccccagctcctatgatcatggagataccagaatctggaagcactgggaacataagtatctatgagaggattccaggggattttggtgccggcagctactctcaaccatcagccaccttcagcctagccaagctgcagcagctgaccaacaccattatggaccctcatgccatgccttatagccattctcctgctgtgacttcctatgcaaccagtgtttctctgtccaatacaggactggctcagctggctccatctcatcccttagctgggactcctcaagcacaagccaccatgacgccacccccaaacttggcatccactaccatgaacctcacatctcctctgcttcagtgcaacatgtctgccaccaacattggcattcctcacacgcagagattgcaagggcaaatgccagtgaaggggcacatttccatccgctccaagtctgcgccactgccctctgcggctgctcaccagcagcagctgtatggccgtagcccatcggcagttgccatgcaggctggccctcgcgcactggctgttcagcgtggcatgaacatgggggttaatctgatgcctactcccgcctataatgtcaattccatgaatatgaacaccttgaatgccatgaacagctatcgaatgacacagcccatgatgaacagcagttaccatagtaaccctgcctacatgaaccagacagcacagtatcctatgcagatgcagatgggaatgatggggagccaggcctatacccagcagcctatgcagcctaaccctcatgggaacatgatgtacacaggcccctcccatcacagctacatgaacgctgctggcgtgcccaagcagtcactcaacggaccttacatgagaagatgagcaagatgaacttgcaatcaaaaacttaaatatatataaataaaggaaccttttatactgacaaaccagagaaaaatggacctttttccagttaaaatattgctgtagatttagaggaatttttctttggtttattttattttttagaaaacctgatcttctctttttttgggttcattttgttctgggttttggttttcttcacaatcttgaacattttacagtagaactcatctaaaaatggatttggggatggggaaacatgcacaaaatcttttcataattaaaaagagccttactttctttacataccacatggacagaatttgtgtaaaagtgaattatctttattttaaaatgtatgtttcccctcactgtttgcagctcccaatgttgtcatttttaaatgttatatacatctcaagggttaaccagaccctttcctccaaacccaacctttcatttcctacttcattccagcaggaggcacttaggggagactcggatggggacatggagaacaacccaagctccttaaacttattattattgttaatattattattattattattaataaagtgaggcaggaaaatgcttctccttttaaaatcccctccactcctcacacacacacacctcttgaaacccttccccaagaatgtttctttatagacggacttcattgaaatctttgttgttcttgaatcaagtgtaatataatttttttcttcttttttaaaatattcccactcagcactcagagacacaaaaatactgtaagtctcaattaacagcagaatctcagagaaaagctgtttgcaatccaaatccagcctttggaggaatagagatggtcaattaacaatcaaaaagaggagattaacctcttgtttttttaccacctggtgaatcagccataacgcacacacacgccacccagcctcttgtttctagtatgtactttgaaatgctaactgagggtcttgatgcttgagcctttgactgataaaactcaaatagcagtccccagtgatttgcctcttaggttctttcttaaattgttggtggatgactgtacattttagtgatttgaaaaataactgacaaaccattgaaacagtttattttatgttggaagagatggcgcagatgtgtgtcagaagggagatcacggtgtgagtttcgtagctatttaagtgatacatacctctagtttttgtatgtcttttgagatcctgagttcatcccctgtgaatcagagtgcacaagcacctctcctgtgagtggctaatgagaagagggacagaccgaccaccagcacagtagggcagatctggacagcagaatgttataacgcaagttcatgtgttgctcccaactccattctcttttctctcgtgcaaccagtttgcccattctcttcctattacttgctccagggataggtaaaaaaaaaaaaaaaaaaaaaaaaaatatatatatatatatatacacacacacacacacacacacacacacatatatatatatatatattccatcattagaagatggaaactattataccacttggtatgtgcagtcaaatatccaaaagggggaagtactgcttagagaaatatctgtaagcattaaattctctcctttatttgtacattttatatagataaatttttaaagtactaattaggcattaacttttttcaaatgcacaggtttgttggtttttttaatacactttaattgactttctcaagcgtgctaggtagaaacgcagaattccacatcttcccgctctcagctctgagcatgtgcaaggctgtgtaggacccagtttctctgtatatactattccagttcccagtcatctatgtagaaagtgcactgtgctgccatcgccctacatcttcagctgtgtcattgcttcctggttggggtggggacggggtgggtcgggagggaggtatattgggaggagggtgggtcaaggcagaaggagaagctgttgaaatgagggccgtgaaatcagtttctgttggtttgcggttgtgtttggttttgtttgtttctttataaaaaattcaatcgggcagctcccttttccacaagcctctttgtgactgtagaactattgtagaaaaaaaaagttcttttctatattataaaagaaattatccaacacagtaatattggtacctgtcattttttcacttctgtttaaaaaaaatgtatttttagcaagataacttgggtaatcttctaaaaaagaaatttaaaaactcactgttagtgactttgatgccttttaaaataagagctttttcatttcattccatctttaaaattttttatctttgttgtagaatattaaaaactattttaagaaagataaattctctttaaagagatctctagcgtgtgtgaatagagctccagatgcctctaaaagccgcatgtacaaaggaagccacgtctatcctgtctgtttatatttgcttttcctgttttgtaacctctttgtactttgttcatggtgacttgtaagctaaggggaaggggtgcctagatgcctttgtatctctccatgtcacgcgctcctgggccagccggcctcccttcctctccttgtatgtaatacctttttttcccctttctagcaagtactttcaaaagaactctgtacattttaacataaaaaataaattatgttgagccattttgga

SEQ ID NO: 1073 - DNA, 588 bp, Homo sapiens
ctcactgtctccaagatggcggccgtgtcagtttggggcatctccgcggtccggcccggggccccgggatctcggctgtccttcctcccggattctttctactaatccagatacttgttgaagtgctgactagtttcttggggaaagatgtcaaggaagagttgaaattcctagactggtgagcagagattgcggagtacagaatagccatcacccactctggcataagatgcacatttttctgctctggagccgggaatgaaatattcttgagttcttacaactttatgacgagacccatgtgtggtgctattgagaaattcattgggaagttggaagacatttcaatcaacaggttgttttggtttctatagtacaattggggtggcattctgttttgtgaaaggaggaaggacttaggccagaaaactcatatgctatggttaactggttcccagcctccgagaatcttgttttccatggtgtaaaacttactcagcatcaggataagggataacgactctatggatatacagaatccttcaccatggtaaaactcgcaaacccgctttatactgagtggatttt

SEQ ID NO: 1074 - DNA, 3592 bp, Homo sapiens
actgtctccaagatggcggccgtgtcagtttggggcatctccgcggtccggcccggggccccgggatctcggctgtccttcctcccggcataagatgcacatttttctgctctggagccgggaatgaaatattcttgagttcttacaactttatgacgagacccatgtgtggtgctattgagaaattcattgggaagttggaagacatttcaatcaacaggttgttttggtttctatagtacaattggggtggcattctgttttgtgaaaggaggaaggacttaggccagaaaactcatatgctatggttaactggttcccagcctccgagaatcttgttttccatggtgtaaaacttactcagcatcaggataagggataacgactctatggatatacagaatccttcaccatggtaaaactcgcaaacccgctttatactgagtggattttggaggccatcaaaaaagtgaaaaagcagaaacagcgtccttcagaagaaaggatatgcaatgctgtgtcttcatcccatggcttggatcgtaaaactgttttagaacaattggagttgagtgttaaagatggaacaattttaaaagtctcaaataaaggactcaattcctataaagatcctgataatcctgggcgaatagcacttcctaagcctcggaaccatggaaaattggataataaacaaaatgtggattggaataaactgataaagcgggcagttgagggcttggcagagtctggtggctcaactttgaaaagcattgaacgttttttgaaaggtcagaaggatgtgtctgcattattcggaggcagtgctgcctctggctttcaccagcagttacgattggctatcaaacgtgccattggccacggcagactccttaaagatggacctctttatcggctcaacactaaagcaaccaacgtggatgggaaagagagttgtgagtctctttcctgtttacctccagtgtcccttcttccacatgaaaaggataagccggttgctgaaccaatccccatctgtagtttctgtcttggtacaaaagaacaaaaccgagaaaagaagccagaggaactcatctcctgtgccgactgtggcaacagtggccatccatcctgtttaaagttttcccctgaactaacggttcgagtgaaggccttacggtggcagtgcatcgagtgtaaaacatgcagctcctgtcgagatcaaggcaaaaatgcggataacatgctcttttgtgattcatgtgaccgaggttttcacatggagtgttgtgatccgccactcacccgtatgccaaaaggcatgtggatatgtcaaatatgtcgacctaggaaaaaaggacgaaaacttctacaaaagaaggcagcacagataaaacggcgctatactaatccaataggacgtccaaaaaacaggttaaagaaacaaaacacggtatcaaaaggtcccttcagcaaagttcgaactggccctggaaggggtaggaaacgaaaaatcactctttccagccaatcagcatcatcatcatcagaagaaggatatttagagcggatagatggcttggacttctgcagagatagcaatgtctccttgaagttcaacaagaaaaccaaagggctcattgatggccttaccaaattttttaccccttcccctgatgggcggaaagctcggggggaagtggtggactactctgagcaatatcgaatcagaaagaggggcaacaggaaatcaagcacttcagattggcccacagacaatcaggatggctgggatggcaaacaagaaaatgaggagcgactttttgggagccaggaaatcatgactgagaaagatatggaattatttcgtgatatccaagaacaagcactgcagaaagttggagtgactggtccccctgatccacaagtccgctgtccctctgtcattgagtttgggaagtatgaaattcacacctggtactcctccccatatcctcaagaatactcaaggctgcccaaattgtatctttgtgaattttgtctaaaatatatgaaaagtagaactattctgcagcagcacatgaagaaatgtggttggttccatcctcctgccaatgagatttacagaaagaataatatttctgtctttgaggttgatgggaatgtgagtaccatttattgtcaaaacctgtgtcttttggcaaagttgtttcttgaccacaaaaccctctattacgatgtggagccatttcttttttatgtactaacacagaatgatgtcaagggctgccaccttgttggctacttttctaaggaaaagcactgccaacagaagtacaatgtttcctgtataatgattcttcctcaataccagcgtaagggctatggcaggtttctcatcgatttcagttatttgttatcaaagcgtgaaggccaagcagggtctccagagaaaccgttatctgatctgggtcgtctttcctacatggcatattggaaaagtgtaatattggagtgcctttatcaccaaaatgacaagcagatcagcattaagaagttaagcaagttgactggaatctgccctcaagacatcacttccacactccaccacctacgaatgctggacttccgtagtgaccaatttgtgattatccgccgggaaaaacttatccaggatcacatggcaaagcttcagctgaatttgcgacctgtagatgtagatccagaatgtttgcgctggactccagtcatagtgtccaactctgtggtctcagaggaggaagaagaggaggctgaggaaggagaaaacgaagagccacagtgccaggaaagagaattagagatcagtgtaagggcatgaatagtctctatttttgatgacagaagatatatttttgatttcatgagtatttataataatgtattatgatcatctttcacagaaaagtaaattcacattagaatgtcaagagttttatttcagtggtagagatttcaagaagactggacctggtttacttaagtatttttaagccttggacaattaggaggagaccatcaaatttcttataatgtgttacttgtgagaaaaatatttgttaccagggtgccaagaagcagctcagttttaagctggatagtagttgagaaatctgaattgaatccaaatctgacagtttttaaaaatgaaatggaggttgggtgtggtgtttcatgcctgtaatctcagcgctttaggaggcccaggcgggaggattgcttgagattaggagttcaggacaaccagggaaatatagtgagaccccatctctacaaaaaaaacccaacaacaaaatgaaatggagatacattttccttaaatagaatattaagtaactattgtaaacttgtgtatgttttctgatggggcaccaaaacatcctgtggacacacagatctctttagccgttaaagggttgctggtgaactgtagtgcatgtgtcattgtcagtatttttcttcatgtgatgcatacttttatagctcttttttttaagcagtgcttcatcctttcaacaccggtatcctcctttaataaacataaaaaatccca

SEQ ID NO: 1075 - DNA, 3710 bp, Homo sapiens
aaaatggcgcccactagcttcaccaaaaggatcgaacttcccagcaccctctctggcccgtaacgtcaggtgacgcgagacccagccggaagtgaaggaaaaagcgcttcagcccgcggcgcctgcgcagaacgctccagacgctgagaggcaggaggcactagggatcgtccgcaggattgggactgatacagaggccgccacggagcccgccggagccaccgttcctgctgctgccgccgctgcccgaatcggaaccgtcgggccgcagccgccggcaatgccgcgaaggaagaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaagattccagtcctgttcgaaatctgcagtcttttggcactgaggagcctgcttactctaccagaagagtgacccgtagtcagcagcagcctaccccagtgacaccgaaaaaataccctcttcggcagactcgttcatctggttcagaaactgagcaagtggttgatttttcagatagagaaactaaaaatacagctgatcatgatgagtcaccgcctcgaactccaactggaaatgcgccttcttctgagtctgacatagacatctccagccccaatgtatctcacgatgagagcattgccaaggacatgtccctgaaggactcaggcagtgatctctctcatcgccccaagcgccgtcgcttccatgaaagctacaacttcaatatgaagtgtcctacaccaggctgtaactctctaggacaccttacaggaaaacatgagagacatttctccatctcaggatgcccactgtatcataacctctcagctgacgaatgcaaggtgagagcacagagccgggataagcagatagaagaaaggatgctgtctcacaggcaagatgacaacaacaggcatgcaaccaggcaccaggcaccaacggagagacagcttcgatataaggaaaaagtggctgaactcaggaagaaaagaaattctggactgagcaaagaacagaaagagaaatatatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcgccccatgaggttgtgttgtgtcttctaagcgtggtactagtgcttgccacctggtcaccagacctccaaatatggctgccaccaccaggacctttccagttactccttatatgtgtgttctatggaggggcagggaaaaggtggcacttgtgagtgtgtgtggattggcagggggtccattcactttgggttccatcttgctttaaatttcttcattttgattaagagacctctttttgatctgtattgggctaaccagagccaaatacttttgaagagtttcccagggactagtcatggtaatagcatataattgatctgaatgagatggagagaagaatgaaggggtggtggttctgggtttgatttgagttcacctgtgggcagtgggcagtgggcagtgtcttggtgaaagggaacggatactactttttgcctcaccgtaaagtactcactagtaaatatttccttctctctttactcccactttttacgtttgcaggtgccaaagtaatgtccacttttccctttcatgctgcatattaactggttaattatactgcagaaaccttttcacctccactagtctgatacagtacatctgtacttccatataccttgcactgattttgtctgagtgccctgggagaagtagaaaatgattgaaagtgacttccgtatctcagcccatgactcagcaaggcagaatggccacccctgccaaagtttgcttctcttttcaacagtgcctcaccctccctctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaacttttgatgtatgacatgtcacccttcccaacttggtctcctccaacatgctgtcttcatgtggagccctcaccacaatccctgactccggtcatttgtgcctttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctcaa

SEQ ID NO: 1076 - DNA, 3469 bp, Homo sapiens
caggaggcactagggatcgtccgcaggattgggactgatacagaggccgccacggagcccgccggagccaccgttcctgctgctgccgccgctgcccgaatcggaaccgtcgggccgcagccgccggcaatgccgcgaaggaagaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaagattccagtcctgttcgaaatctgcagtcttttggcactgaggagcctgcttactctaccagaagagtgacccgtagtcagcagcagcctaccccagtgacaccgaaaaaataccctcttcggcagactcgttcatctggttcagaaactgagcaagtggttgatttttcagatagagaaactaaaaatacagctgatcatgatgagtcaccgcctcgaactccaactggaaatgcgccttcttctgagtctgacatagacatctccagccccaatgtatctcacgatgagagcattgccaaggacatgtccctgaaggactcaggcagtgatctctctcatcgccccaagcgccgtcgcttccatgaaagctacaacttcaatatgaagtgtcctacaccaggctgtaactctctaggacaccttacaggaaaacatgagagacatttctccatctcaggatgcccactgtatcataacctctcagctgacgaatgcaaggcaccaacggagagacagcttcgatataaggaaaaagtggctgaactcaggaagaaaagaaattctggactgagcaaagaacagaaagagaaatatatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcgccccatgaggttgtgttgtgtcttctaagcgtggtactagtgcttgccacctggtcaccagacctccaaatatggctgccaccaccaggacctttccagttactccttatatgtgtgttctatggaggggcagggaaaaggtggcacttgtgagtgtgtgtggattggcagggggtccattcactttgggttccatcttgctttaaatttcttcattttgattaagagacctctttttgatctgtattgggctaaccagagccaaatacttttgaagagtttcccagggactagtcatggtaatagcatataattgatctgaatgagatggagagaagaatgaaggggtggtggttctgggtttgatttgagttcacctgtgggcagtgggcagtgggcagtgtcttggtgaaagggaacggatactactttttgcctcaccgtaaagtactcactagtaaatatttccttctctctttactcccactttttacgtttgcaggtgccaaagtaatgtccacttttccctttcatgctgcatattaactggttaattatactgcagaaaccttttcacctccactagtctgatacagtacatctgtacttccatataccttgcactgattttgtctgagtgccctgggagaagtagaaaatgattgaaagtgacttccgtatctcagcccatgactcagcaaggcagaatggccacccctgccaaagtttgcttctcttttcaacagtgcctcaccctccctctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaacttttgatgtatgacatgtcacccttcccaacttggtctcctccaacatgctgtcttcatgtggagccctcaccacaatccctgactccggtcatttgtgcctttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctcaa

SEQ ID NO: 1077 - DNA, 3638 bp, Homo sapiens
tcaattcaacaaatgtctattgactactttctgcgcggtggttgctgtggattcagaaattaattagatgtgatccctggcttaagggtgtcacagcccgataggagaaaacagacatgaataatcttagaaggatctagtaagttctcagcttggaggtgtatacaaggtgttgctggaaggaagtgaaggagcagttaagtctgccctggagtacaatgggagatatattggtaaaagccacagagaagagctgagttccaggatcaagccaggaaggaataagtctcacgtcaaggctttaaatatctcgaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaagattccagtcctgttcgaaatctgcagtcttttggcactgaggagcctgcttactctaccagaagagtgacccgtagtcagcagcagcctaccccagtgacaccgaaaaaataccctcttcggcagactcgttcatctggttcagaaactgagcaagtggttgatttttcagatagagaaactaaaaatacagctgatcatgatgagtcaccgcctcgaactccaactggaaatgcgccttcttctgagtctgacatagacatctccagccccaatgtatctcacgatgagagcattgccaaggacatgtccctgaaggactcaggcagtgatctctctcatcgccccaagcgccgtcgcttccatgaaagctacaacttcaatatgaagtgtcctacaccaggctgtaactctctaggacaccttacaggaaaacatgagagacatttctccatctcaggatgcccactgtatcataacctctcagctgacgaatgcaaggcaccaacggagagacagcttcgatataaggaaaaagtggctgaactcaggaagaaaagaaattctggactgagcaaagaacagaaagagaaatatatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcgccccatgaggttgtgttgtgtcttctaagcgtggtactagtgcttgccacctggtcaccagacctccaaatatggctgccaccaccaggacctttccagttactccttatatgtgtgttctatggaggggcagggaaaaggtggcacttgtgagtgtgtgtggattggcagggggtccattcactttgggttccatcttgctttaaatttcttcattttgattaagagacctctttttgatctgtattgggctaaccagagccaaatacttttgaagagtttcccagggactagtcatggtaatagcatataattgatctgaatgagatggagagaagaatgaaggggtggtggttctgggtttgatttgagttcacctgtgggcagtgggcagtgggcagtgtcttggtgaaagggaacggatactactttttgcctcaccgtaaagtactcactagtaaatatttccttctctctttactcccactttttacgtttgcaggtgccaaagtaatgtccacttttccctttcatgctgcatattaactggttaattatactgcagaaaccttttcacctccactagtctgatacagtacatctgtacttccatataccttgcactgattttgtctgagtgccctgggagaagtagaaaatgattgaaagtgacttccgtatctcagcccatgactcagcaaggcagaatggccacccctgccaaagtttgcttctcttttcaacagtgcctcaccctccctctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaacttttgatgtatgacatgtcacccttcccaacttggtctcctccaacatgctgtcttcatgtggagccctcaccacaatccctgactccggtcatttgtgcctttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctcaa

SEQ ID NO: 1078 - DNA, 1774 bp, Homo sapiens
gcagaacgctccagacgctgagaggcaggaggcactagggatcgtccgcaggattgggactgatacagaggccgccacggagcccgccggagccaccgttcctgctgctgccgccgctgcccgaatcggaaccgtcgggccgcagccgccggcaatgccgcgaaggaagaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaaggacaccttacaggaaaacatgagagacatttctccatctcaggatgcccactgtatcataacctctcagctgacgaatgcaaggtgagagcacagagccgggataagcagatagaagaaaggatgctgtctcacaggcaagatgacaacaacaggcatgcaaccaggcaccaggcaccaacggagagacagcttcgatataaggaaaaagtggctgaactcaggaagaaaagaaattctggactgagcaaagaacagaaagagaaatatatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtg

SEQ ID NO: 1079 - DNA, 3996 bp, Homo sapiens
acaacaaagcagaagactgggtggtgggaagccagcgcccactcgcaggggatccctctcaggccagttgcctctttccttatttgctagttcgacagcgcctagaaaatgcagttggtaaaaactaaaaacttctagaattagaaggcacttagaagatcacccaggaatggccccgtcgtttcttcttacagctgaactaacggaggcccatggagtgccgcaagccactcaggcagtggcagatccagaatatagaacaaatctaactcaattcaacaaatgtctattgactactttctgcgcggtggttgctgtggattcagaaattaattagatgtgatccctggcttaagggtgtcacagcccgataggagaaaacagacatgaataatcttagaaggatctagtaagttctcagcttggaggtgtatacaaggtgttgctggaaggaagtgaaggagcagttaagtctgccctggagtacaatgggagatatattggtaaaagccacagagaagagctgagttccaggatcaagccaggaaggaataagtctcacgtcaaggctttaaatatctcgaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaagattccagtcctgttcgaaatctgcagtcttttggcactgaggagcctgcttactctaccagaagagtgacccgtagtcagcagcagcctaccccagtgacaccgaaaaaataccctcttcggcagactcgttcatctggttcagaaactgagcaagtggttgatttttcagatagagaaactaaaaatacagctgatcatgatgagtcaccgcctcgaactccaactggaaatgcgccttcttctgagtctgacatagacatctccagccccaatgtatctcacgatgagagcattgccaaggacatgtccctgaaggactcaggcagtgatctctctcatcgccccaagcgccgtcgcttccatgaaagctacaacttcaatatgaagtgtcctacaccaggctgtaactctctaggacaccttacaggaaaacatgagagacatttctccatctcaggatgcccactgtatcataacctctcagctgacgaatgcaaggtgagagcacagagccgggataagcagatagaagaaaggatgctgtctcacaggcaagatgacaacaacaggcatgcaaccaggcaccaggcaccaacggagagacagcttcgatataaggaaaaagtggctgaactcaggaagaaaagaaattctggactgagcaaagaacagaaagagaaatatatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcgccccatgaggttgtgttgtgtcttctaagcgtggtactagtgcttgccacctggtcaccagacctccaaatatggctgccaccaccaggacctttccagttactccttatatgtgtgttctatggaggggcagggaaaaggtggcacttgtgagtgtgtgtggattggcagggggtccattcactttgggttccatcttgctttaaatttcttcattttgattaagagacctctttttgatctgtattgggctaaccagagccaaatacttttgaagagtttcccagggactagtcatggtaatagcatataattgatctgaatgagatggagagaagaatgaaggggtggtggttctgggtttgatttgagttcacctgtgggcagtgggcagtgggcagtgtcttggtgaaagggaacggatactactttttgcctcaccgtaaagtactcactagtaaatatttccttctctctttactcccactttttacgtttgcaggtgccaaagtaatgtccacttttccctttcatgctgcatattaactggttaattatactgcagaaaccttttcacctccactagtctgatacagtacatctgtacttccatataccttgcactgattttgtctgagtgccctgggagaagtagaaaatgattgaaagtgacttccgtatctcagcccatgactcagcaaggcagaatggccacccctgccaaagtttgcttctcttttcaacagtgcctcaccctccctctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaacttttgatgtatgacatgtcacccttcccaacttggtctcctccaacatgctgtcttcatgtggagccctcaccacaatccctgactccggtcatttgtgcctttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctc

SEQ ID NO: 1080 - DNA, 1774 bp, Homo sapiens
cagaacgctccagacgctgagaggcaggaggcactagggatcgtccgcaggattgggactgatacagaggccgccacggagcccgccggagccaccgttcctgctgctgccgccgctgcccgaatcggaaccgtcgggccgcagccgccggcaatgccgcgaaggaagaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaagattccagtcctgttcgaaatctgcagtcttttggcactgaggagcctgcttactctaccagaagagtgacccgtagtcagcagcagcctaccccagtgacaccgaaaaaataccctcttcggcagactcgttcatctggttcagaaactgagcaagtggttgatttttcagatagaggacaccttacaggaaaacatgagagacatttctccatctcaggatgcccactgtatcataacctctcagctgacgaatgcaaggcaccaacggagagacagcttcgatataaggaaaaagtggctgaactcaggaagaaaagaaattctggactgagcaaagaacagaaagagaaatatatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaag

SEQ ID NO: 1081 - DNA, 1769 bp, Homo sapiens
agacgctgagaggcaggaggcactagggatcgtccgcaggattgggactgatacagaggccgccacggagcccgccggagccaccgttcctgctgctgccgccgctgcccgaatcggaaccgtcgggccgcagccgccggcaatgccgcgaaggaagaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaaggacaccttacaggaaaacatgagagacatttctccatctcaggatgcccactgtatcataacctctcagctgacgaatgcaaggcaccaacggagagacagcttcgatataaggaaaaagtggctgaactcaggaagaaaagaaattctggactgagcaaagaacagaaagagaaatatatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactgg

SEQ ID NO: 1082 - DNA, 1531 bp, Homo sapiens
gcgtcacttcccttcccgcgatggcggcacagggagctgctgcggcggttgcggcggggacttcaggggtcgcgggggagggcgagcccgggcccggggagaatgcggccgctgaggggaccgccccatccccgggccgcgtctctccgccgaccccggcgcgcggcgagccggaagtcacggtggagatcggagaaacgtacctgtgccggcgaccggatagcacctggcattctgctgaagtgatccagtctcgagtgaacgaccaggagggccgagaggaattctatgtacactacgtgggctttaaccggcggctggacgagtgggtagacaagaaccggctggcgctgaccaagacagtgaaggatgctgtacagaagaactcagagaagtacctgagcgagctcgcagagcagcctgagcgcaagatcactcgcaaccaaaagcgcaagcatgatgagatcaaccatgtgcagaagacttatgcagagatggaccccaccacagcagccttggagaaggagcatgaggcgatcaccaaggtgaagtatgtggacaagatccacatcgggaactacgaaattgatgcctggtatttctcaccattccccgaagactatgggaaacagcccaagctctggctctgcgagtactgcctcaagtacatgaaatatgagaagagctaccgcttccacttgggtcagtgccagtggcggcagccccccgggaaagagatctaccgcaagagcaacatctccgtgtacgaagttgatggcaaagaccataagatttactgtcagaacctgtgtctgctggccaagcttttcctggaccataagacactgtactttgacgtggagccgttcgtcttttacatcctgactgaggtggaccggcagggggcccacattgttggctacttctccaaggagaaggagtccccggatggaaacaatgtggcctgcatcctgaccttgcccccctaccaacgccgcggctacgggaagttcctcatcgctttcagttatgagctctccaagctggagagcacagtcggctccccggagaagccactgtctgacctgggcaagctcagctaccgcagctactggtcctgggtgctgctagagatcctgcgggacttccggggcacactgtccatcaaggacctcagccagatgaccagtatcacccaaaatgacatcatcagtaccctgcaatccctcaatatggtcaagtactggaagggccagcacgtgatctgtgtcacacccaagctggtggaggagcacctcaaaagtgcccagtataagaaaccacccatcacagtggactccgtctgcctcaagtgggcaccccccaagcacaagcaagtcaagctctccaagaagtgagcagcctggcccctgctgtcggacctgagcctcctggctcccagcctgtaaatatgtatagacctgttttgtcatttttttaataaagtcagttctggtggccctggactttggaggggaaggggaggccaaga

SEQ ID NO: 1083 - DNA, 1789 bp, Homo sapiens
gtcacttcccttcccgcgatggcggcacagggagctgctgcggcggttgcggcggggacttcaggggtcgcgggggagggcgagcccgggcccggggagaatgcggccgctgaggggaccgccccatccccgggccgcgtctctccgccgaccccggcgcgcggcgagccggaagtcacggtggagatcggagaaacgtacctgtgccggcgaccggatagcacctggcattctgctgaagtgatccagtctcgagtgaacgaccaggagggccgagaggaattctatgtacactacgtgggctttaaccggcggctggacgagtgggtagacaagaaccggctggcgctgaccaagacagtgaaggatgctgtacagaagaactcagagaagtacctgagcgagctcgcagagcagcctgagcgcaagatcactcgcaaccaaaagcgcaagcatgatgagatcaaccatgtgcagaagacttatgcagagatggaccccaccacagcagccttggagaaggagcatgaggcgatcaccaaggtgaagtatgtggacaagatccacatcgggaactacgaaattgatgcctggtatttctcaccattccccgaagactatgggaaacagcccaagctctggctctgcgagtactgcctcaagtacatgaaatatgagaagagctaccgcttccacttgggtcagtgccagtggcggcagccccccgggaaagagatctaccgcaagagcaacatctccgtgtacgaagttgatggcaaagaccataagatttactgtcagaacctgtgtctgctggccaagcttttcctggaccataagacactgtactttgacgtggagccgttcgtcttttacatcctgactgaggtggaccggcagggggcccacattgttggctacttctccaaggagaaggagtccccggatggaaacaatgtggcctgcatcctgaccttgcccccctaccaacgccgcggctacgggaagttcctcatcgctttcagttatgagctctccaagctggagagcacagtcggctccccggagaagccactgtctgacctgggcaagctcagctaccgcagctactggtcctgggtgctgctagagatcctgcgggacttccggggcacactgtccatcaaggacctcagccagatgaccagtatcacccaaaatgacatcatcagtaccctgcaatccctcaatatggtcaagtactggaagggccagcacgtgatctgtgtcacacccaagctggtggaggagcacctcaaaagtgcccagtataagaaaccacccatcacaggtgggtggggggctgctgtgtgtcgggggcggtgggggagtgtcagtatatggactggtaggagtcaaggcctccttattgctgtcacatgatcccaaaccagtcagaccagctcccaggatggagcccggggcaggcctctcattcctgggcttccctacccctccccagcacagcctgcccttttgttctcacctggaggaggtgaaactggcctgagcccagaggagggcagccaggtgtgagctggcctggcccaggcccagccctgcctcccgccccttctccccacagtggactccgtctgcctcaagtgggcaccccccaagcacaagcaagtcaagctctccaagaagtgagcagcctggcccctgctgtcggacctgagcctcctggctcccagcctgtaaatatgtatagacctgttttgtcatttttttaataaagtcagttctggtg

SEQ ID NO: 1084 - DNA, 2320 bp, Homo sapiens
agaggcggcgcccggcaggggcggcaggagctcaggagaggcccccggggatcgggctgggccccacgtgagagctaagcgactgccctcgcgcccgcagaacagcagggcctgcatcgactctaaggcgagaccagaaacttgctagtggagcaattctggtgcccctgcccgggctgtgaaccctctgagatcatccctcaatcaaacgaatagaaatcctcgggaagaaaaaaaaaattgcggcaatccggctaaaattcagcagctttcagggaccgattcaggacattatccctgtggttccctcagtgaaaggagactcgaagcgcgactagaagtcgccgggccccatagatctgcggtgcccaggccgtaggcggaggcgcgggcagaggcggcggcggcggcggcggcggctggaggacccggcgctgggggcgctgagcggcagcctcgcttccggagctcggcgggcggcgtcagcggaacgggcggcttccggccgcggcgtaaacaaggccgtggactgcaggaggcggggcagacgggctgcaatagggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacaccagtagctgtcctctattaaagtaaagtaatggttgggctttttaccctgaagaa

SEQ ID NO: 1085 - DNA, 763 bp, Homo sapiens
ccaccttcctggaaatccacccagaacctccaccctctgacaccatggtcaactcctgttgtggctctgtgtgctctgaccagggctgtggcctagagaactgctgccgtcccagctgctgccagaccacctgctgcaggaccacctgctgccgccccagctgctgtgtgtccagctgctgcagaccgcagtgctgccagtctgtgtgctgccagcccacctgctgcagccccagctgctgccagaccacttgctgcaggaccacctgctgccgtcccagctgctgtgtgtccagctgcttcagaccccagtgctgccagtctgtgtactgccagcccacctgctgccgccccagctgtggccagaccacctgctgcaggaccacctgctaccgccccagctgctgtgtgtccacctgctgccgcccaacctgctctagtggctcttgctgctgatgccctcacctatactcacctgcctttattaaccagcattcttgatatgatccacctgtgaactgaatcatgcaaggccaattggacaacctcagttccaaccaattcttggattgagtttggcctccaaatatgctcaccaaacactatgttgctaccctctaccaaatgaatacaagtttgaattttctctgaaatatgtcaaccccatgttccctgaattgaaatatttgctctctaccataatttatcacatggagctattcctctatcttaaataaattttaatttttgaggcatacaaataa

SEQ ID NO: 1086 - DNA, 762 bp, Homo sapiens
tgctgccatcccagctgctgccagaccacctgctgcaagaccgcttgctgctgccgcagcttcttgacaacagctcctcagaccacctgttgctgccccagctgtgttgtatccagctgctgccgcccatcctgctctcagactacctgctgccagaccacttgctgtcgccccagctgctgccacccagtctgttgtcagaccacctgccgccccagctgtggtgtgtccagctgctgccgcccactctgctgtcagaccacctgccaccccagctgtggtatgtccagctgctgccgtccactctgttgtcagaccacctgccgccccagctgtggtgtgtccagctgctgccgtccactctgctgtcagaccacctgctgccgtgcaacttgctgccgccccaactgctgccgtcccagctgctgccagaccacctgctgcaggaccacctgctgccgccccagctgctgtgtgtccagctgctgcagaccgcagtgctgccagtctgtgtgctgccagcccacctgctgcagccccagctgctgccagaccacttgctgcaggaccacctgctgccgtcccagctgctgtgtgtccagctgcttcagaccccagtgctgccagtctgtgtactgccagcccacctgctgccgccccagctgtggccagaccacctgctgcaggaccacctgctaccgccccagctgctgtgtgtccacctgctgccgcccaacctgctctagtggctcttgctgctga

SEQ ID NO: 1087 - DNA, 2757 bp, Homo sapiens
gctggctgcgcacgcgcgccgcctcatttccggtgctctctctcgctgggtcgctcgggtcggcttcggtcgctaccgctcccgctctgccacccccgccaaccgccgctcgggcctccgtcgctgccgcgtcgctttctcgctccttggatcgcacatcctcccagatgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaagttcaattttgtggggaagattcttggaccacaagggaatacaatcaaaagactgcaggaagagactggtgcaaagatctctgtattgggaaagggctcaatgagagacaaagccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaacagacaagtaattgtctaagtgtttttcttcgtggtccccttcttctccccaccttattccattcttaactctgcattctggcttctgtatgtagtattttaaaatgagttaaaatagatttaggaatattgaattaattttttaagtgtgtagatgcttttttctttgttgtttaaatataaacagaagtgtaccttttataataaaaaaaagaagttgagtaaaaaaaaaaaacacacaaacctgttagtttcaaaaatgacattgcttgcttaaaggttctgaagtaaaggcttgttaagtttctcttagttttgatttgaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatcctcatgaattaaatagttgatgcaatttttaacgttaattgatataaaaaaaaaaacaacaaaattaggcttgtaaaactgactttttcattacgtgggttttgaaatctagccccagacatactgtgttgagagatacttagagggagggagtaggttttgaagaggttgatggtggtggggagggaaggcctcctgaattgagtttgatgcagagctttttagccatgaagaatctttcagtcatagtactaataattaaattttcagtatttaaaaagacaaagtattttgtccatttgagattctgcactccatgaaaagttcacttggacgctggggccaaaagctgttgattttcttaagttgacggttgtcaatatatcgaactgttcccaagttagtcaagtatgtctcaacactagcatgatataaaaagggacactgcagctgaatgaaaaaggaatcaaaatccactttgtacataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttagtccttttttaatcaaagtaaa

SEQ ID NO: 1088 - DNA, 2507 bp, Homo sapiens
atgcagcgccgggacgaccccgccgcgcgcatgagccggtcttcgggccgtagcggctccatggacccctccggtgcccacccctcggtgcgtcagacgccgtctcggcagccgccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaagttcaattttgtggggaagattcttggaccacaagggaatacaatcaaaagactgcaggaagagactggtgcaaagatctctgtattgggaaagggctcaatgagagacaaagccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaacagacaagtaattgtctaagtgtttttcttcgtggtccccttcttctccccaccttattccattcttaactctgcattctggcttctgtatgtagtattttaaaatgagttaaaatagatttaggaatattgaattaattttttaagtgtgtagatgcttttttctttgttgtttaaatataaacagaagtgtaccttttataataaaaaaaagaagttgagtaaaaaaaaaaaacacacaaacctgttagtttcaaaaatgacattgcttgcttaaaggttctgaagtaaaggcttgttaagtttctcttagttttgatttgaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatcctcatgaattaaatagttgatgcaatttttaacgttaattgatataaaaaaaaaaacaacaaaattaggcttgtaaaactgactttttcattacgtgggttttgaaatctagccccagacatactgtgttgagagatacttagagggagggagtaggttttgaagaggttgatggtggtggggagggaaggcctcctgaattgagtttgatgcagagctttttagccatgaagaatctttcagtcatagtactaataattaaattttcagtatttaaaaagacaaagtattttgtccatttgagattctgcactccatgaaaagttcacttggacgctggggccaaaagctgttgattttcttaagttgacggttgtcaatatatcgaactgttcccaagttagtcaagtatgtctcaacactagcatgatataaaaagggacactgcagctgaatgaaaaaggaatcaaaatccactttgtacataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttagtcctttttta

SEQ ID NO: 1089 - DNA, 1215 bp, Homo sapiens
atgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaa

SEQ ID NO: 1090 - DNA, 2058 bp, Homo sapiens
gcgtcctgttcccgcctctccagttaaggccgctggtgtgagccggggctctgcgcgagcgagggacgacggaagggacgggcaggtgtgggcgcggggccacgcagcccgacggcgggagtcgcaggtgctgggtgcatgggccagtgaggacgcacagagatccctcgccgcgcggaggaggagcagcgcgggagccaggcgctgccccaagaccctgcctgcgtccgagcgagcggaacctcgcgcttcgcccggggacaatccgaagtccgcgctatggaagaggagaaatatttgcctgagctgatggcagagaaagatagcctggatccatcttttgtgcatgcgtcgcgccttttggcagaagaaattgaaaagtttcaaggttctgatggaaaaaaggaagacgaagaaaagaagtatcttgatgtcatcagcaacaaaaacataaagctctcagaaagagtactgattcctgtcaagcagtatccaaagttcaattttgtggggaaattgcttggaccaagaggaaactccttgaagaggctacaggaagaaacaggtgctaaaatgtctatcctgggcaaaggatcaatgagagataaagctaaggaagaagaactaaggaagagtggggaagccaaatatgcccacttgagtgatgagcttcatgtattaattgaagtgtttgctccacctggggaagcttattcacgtatgagtcatgcattggaagagattaaaaaattcctggttcctgactacaatgatgaaattcgtcaggaacaactacgtgaattatcttacttaaatggctcagaggactctggtcgtggcagaggtattagaggcagagggatcagaatagctcccacagctccttcaaggggccgtgggggtgccattcctcctcccccaccacctggacgaggtgttctcacccctcggggaagcactgtaacccgtggagcgcttccagtgccacctgtagcaagaggtgtccctacccctcgagcccggggggcaccaacagtgccaggatacagggcacctcctcctccagcccatgaagcttatgaagaatatggttatgatgatggctacgggggtgaatatgatgaccagacctatgagacttatgataacagctatgcgacccaaacacaaagtgtgcctgaatactatgactacggtcatggagtaagtgaggatgcctatgacagctacgcaccagaagaatgggccacaacccgctctagcttgaaggcaccaccgcaaaggtcagccagagggggatacagggaacacccctatggtagatattgaaggtccttcccacctgtgacctcacctcaaagacaattcatagcctgtggtctccacataaacagcaacaagacaagtaatagtcctttttttgtttgtttgtttctattctagggataactgctcatgattactcccatatatttctagtatttccctctgtactgttggcgtgacattgacactagtattattttacaaaacagactgaaaaagacattagcaagcatagtctataaacctttcagtaggatgatattctcttggttgtttttcattgttgtgtgtaatcttttttttttctttttcttttttttttttttgaggaaaagcatgaatttgttaacagattttgagtctcaaccaactagcagaaactttgtttagggttgctaaaagactgtaatatgatttttgaactagctgataataaagttgtagataagatgttttaacctgtcttttaatatctgttagttagacaaagatgtttgatattaagtttgtaaatttaattttaatgctgttttaatggggttgaaaacaagcagctactgtatgtatgtagctaactgaatttgttcagtgttttaacctgtatttgttaaaaaagaaaaaaaaacacacataaagttccatgtgtaagcttctctaaataggaaaccacaatttgtcaaatatgtttgccataatttgtcaataaagctgaaaacttttgtaaaaattaaa

SEQ ID NO: 1091 - DNA, 1230 bp, Homo sapiens
gcgtcctgttcccgcctctccagttaaggccgctggtgtgagccggggctctgcgcgagcgagggacgacggaagggacgggcaggtgtgggcgcggggccacgcagcccgacggcgggagtcgcaggtgctgggtgcatgggccagtgaggacgcacagagatccctcgccgcgcggaggaggagcagcgcgggagccaggcgctgccccaagaccctgcctgcgtccgagcgagcggaacctcgcgcttcgcccggggacaatccgaagtccgcgctatggaagaggagaaatatttgcctgagctgatggcagagaaagatagcctggatccatcttttgtgcatgcgtcgcgccttttggcagaagaaattgaaaagtttcaaggttctgatggaaaaaaggaagacgaagaaaagaagtatcttgatgtcatcagcaacaaaaacataaagctctcagaaagagtactgattcctgtcaagcagtatccaaagttcaattttgtggggaaattgcttggaccaagaggaaactccttgaagaggctacaggaagaaacaggtgctaaaatgtctatcctgggcaaaggatcaatgagagataaagctaaggaagaagaactaaggaagagtggggaagccaaatatgcccacttgagtgatgagcttcatgtattaattgaagtgtttgctccacctggggaagcttattcacgtatgagtcatgcattggaagagattaaaaaattcctggttcctgactacaatgatgaaattcgtcaggaacaactacgtgaattatcttacttaaatggctcagaggactctggtcgtggcagaggtattagaggcagagggatcagaatagctcccacagctccttcaaggggccgtgggggtgccattcctcctcccccaccacctggacgaggtgttctcacccctcggggaagcactgtaacccgtggagcgcttccagtgccacctgtagcaagaggtgtccctacccctcgagcccggggggcaccaacagtgccaggatacagggcacctcctcctccagcccatgaagcttatgaagaatatccatcattaccactttccttgttttttgatacggtggcaaaatctcaccagcattgtgataacgaagtaccacaaactggttcaaccagacttaacccaggacgaagcttttttctggcatggaggtgggagtgggactga

SEQ ID NO: 1092 - DNA, 1969 bp, Homo sapiens
atggcgagcgcccggattggggatgagtatgcggaggacagctctgatgaggaggacatccggaacacggtgggcaacgtgcccttggagtggtacgatgacttcccccacgtgggctacgacctggatggcaggcgcatctacaagcccctgcggacccgggatgagctggaccagttcctggacaagatggacgatcctgactactggcgcaccgtgcaggacccgatgacagggcgggacctgagactgacggatgagcaggtggccctggtgcggcggctgcagagtggccagtttggggatgtgggcttcaacccctatgagccggctgtcgacttcttcagcggggacgtcatgatccacccggtgaccaaccgcccggccgacaagcgcagcttcatcccctccctggtggagaaggagaaggtctctcgcatggtgcacgccatcaagatgggctggatccagcctcgccggccccgagaccccacccccagcttctatgacctgtgggcccaggaggaccccaacgccgtgctcgggcgccacaagatgcacgtacctgctcccaagctggccctgccaggccacgccgagtcgtacaacccaccccctgaatacctgctcagcgaggaggagcgcttggcgtgggaacagcaggagccaggcgagaggaagctgagctttttgccacgcaagttcccgagcctgcgggccgtgcctgcctacggacgcttcatccaggaacgcttcgagcgctgccttgacctgtacctgtgcccacggcagcgcaagatgagggtgaatgtagaccctgaggacctcatccccaagctgcctcggccgagggacctgcagcccttccccacgtgccaggccctggtctacaggggccacagtgaccttgtccggtgcctcagtgtctctcctgggggccagtggctggtttcaggctctgacgacggctccctgcggctctgggaggtggccactgcccgctgtgtgaggactgttcccgtggggggcgtggtgaagagtgtggcctggaaccccagccccgctgtctgcctggtggctgcagccgtggaggactcggtgctgctgctgaacccagctctgggggaccggctggtggcgggcagcacagatcagctgttgagcgccttcgtcccgcctgaggagccccccttgcagccggcccgctggctggaggcctcagaggaggagcgccaagtgggcctgcggctgcgcatctgccacgggaagccagtgacgcaggtgacctggcacgggcgtggggactacctggccgtggtgctggccacccaaggccacacccaggtgctgattcaccagctgagccgtcgccgcagccagagtccgttccgccgcagccacggacaggtgcagcgagtggccttccaccctgcccggcccttcctgttggtggcgtcccagcgcagcgtccgcctctaccacctgctgcgccaggagctcaccaagaagctgatgcccaactgcaagtgggtgtccagcctggcggtgcaccctgcaggtgacaacgtcatctgtgggagctacgatagcaagctggtgtggtttgacctggatctttccaccaagccatacaggatgctgagacaccacaagaaggctctgcgggctgtggccttccacccgcggtacccactctttgcgtcaggctcggacgacggcagtgtcatcgtctgccatggcatggtgtacaatgaccttctgcagaaccccttgctggtgcccgtcaaggtgctgaagggacacgtgctgacccgagatctgggagtgctggacgtcatcttccaccccacccagccgtgggtcttctcctcgggggcagacgggactgtccgcctcttcacctagctgttctgcctgcctggggctggggtggtcgtgctgaagtcaacagagcctttaccctgtgctg

SEQ ID NO: 1093 - DNA, 3097 bp, Homo sapiens
acacgctccactgacaccagcttcacgctgccgggcagtcgccgatcacgcgtggccccgcgagcccattggccggcgcctcacacacctttgccgttgattggccggcctcaggctccgcccccacccccgcccgcggcgcggggcaggctgagcggctacctgaatggggagggggcagacggcgctgagcgcggcggcggcgggagcggcgtcgagtgtctccgtgcgcccgtctgtggccaagcagccagcagcctagcagccagtcagcttgccgccggcggccaagcagccaaccatgctcaacttcggtgcctctctccagcagactgcggaggaaagaatggaaatgatttctgaaaggccaaaagagagtatgtattcctggaacaaaactgcagagaaaagtgattttgaagctgtagaagcacttatgtcaatgagctgcagttggaagtctgattttaagaaatacgttgaaaacagacctgttacaccagtatctgatttgtcagaggaagagaatctgcttccgggaacacctgattttcatacaatcccagcattttgtttgactccaccttacagtccttctgactttgaaccctctcaagtgtcaaatctgatggcaccagcgccatctactgtacacttcaagtcactctcagatactgccaaacctcacattgccgcacctttcaaagaggaagaaaagagcccagtatctgcccccaaactccccaaagctcaggcaacaagtgtgattcgtcatacagctgatgcccagctatgtaaccaccagacctgcccaatgaaagcagccagcatcctcaactatcagaacaattcttttagaagaagaacccacctaaatgttgaggctgcaagaaagaacataccatgtgccgctgtgtcaccaaacagatccaaatgtgagagaaacacagtggcagatgttgatgagaaagcaagtgctgcactttatgacttttctgtgccttcctcagagacggtcatctgcaggtctcagccagcccctgtgtccccacaacagaagtcagtgttggtctctccacctgcagtatctgcagggggagtgccacctatgccggtcatctgccagatggttccccttcctgccaacaaccctgttgtgacaacagtcgttcccagcactcctcccagccagccaccagccgtttgcccccctgttgtgttcatgggcacacaagtccccaaaggcgctgtcatgtttgtggtaccccagcccgttgtgcagagttcaaagcctccggtggtgagcccgaatggcaccagactctctcccattgcccctgctcctgggttttccccttcagcagcaaaagtcactcctcagattgattcatcaaggataaggagtcacatctgtagccacccaggatgtggcaagacatactttaaaagttcccatctgaaggcccacacgaggacgcacacaggagaaaagcctttcagctgtagctggaaaggttgtgaaaggaggtttgcccgttctgatgaactgtccagacacaggcgaacccacacgggtgagaagaaatttgcgtgccccatgtgtgaccggcggttcatgaggagtgaccatttgaccaagcatgcccggcgccatctatcagccaagaagctaccaaactggcagatggaagtgagcaagctaaatgacattgctctacctccaacccctgctcccacacagtgacagaccggaaagtgaagagtcagaactaactttggtctcagcgggagccagtggtgatgtaaaaatgcttccactgcaagtctgtggccccacaacgtgggcttaaagcagaagccccacagcctggcacgaaggccccgcctgggttaggtgactaaaagggcttcggccacaggcaggtcacagaaaggcaggtttcatttcttatcacataagagagatgagaaagcttttattcctttgaatattttttgaaggtttcagatgaggtcaacacaggtagcacagattttgaatctgtgtgcatatttgttactttacttttgctgtttatacttgagaccaacttttcaatgtgattcttctaaagcactggtttcaagaatatggaggctggaaggaaataaacattacggtacagacatggagatgtaaaatgagtttgtattattacaaatattgtcatctttttctagagttatcttctttattattcctagtctttccagtcaacatcgtggatgtagtgattaaatatatctagaactatcatttttacactattgtgaatatttggaattgaacgactgtatattgctaagagggcccaaagaattggaatcctccttaatttaattgctttgaagcatagctacaatttgtttttgcatttttgttttgaaagtttaacaaatgactgtatctaggcatttcattatgctttgaactttagtttgcctgcagtttcttgtgtagatttgaaaattgtataccaatgtgttttctgtagactctaagatacactgcactttgtttagaaaaaaaactgaagatgaaatatatattgtaaagaagggatattaagaatcttagataacttcttgaaaaagatggcttatgtcatcagtaaagtacctttatgttatgaggatataatgtgtgctttattgaattagaaaattagtgaccattattcacaggtggacaaatgttgatgttgtcctgttaatttataggcgttttttggggatgtggaggtagttgggtagaaaaattattagaacattcacttttgttaacagtatttctcttttattctgttatatagtggatgatatacacagtggcaaaacaaaagtacattgcttaaaatatatagtgaaaaatgtcactatatcttcccatttaacattgtttttgtatattgggtgtagatttctgacatcaaaacttggacccttggaaaacaaaagttttaattaaaaaaaatccttgtgacttacaatttgcacaatatttcttttgttgtactttatatcttgtttacaataaagaattccctttggtatatgg

SEQ ID NO: 1094 - DNA, 3659 bp, Homo sapiens
ggttcctaagggaacggcggctcgcggggagctggaaggggcgggcgcctcccggagcctggcgcccgcagccccgcccctccccgcgggcccggcgcgcacggccgggcggttggcggcggcgcccgcggcccctcccccgggtcgggcgcgggcgggggcccgcaagctcaggaagtaggggaaaggtgacggcgcggcaattcccagttcacgtttcctgcgcctcccggagcagccgctgatcacgctttgttcacatgcctcgccccctcctcgcccacgcccccgccccgggccgcacagccaatccgggctcgggccgccgagccggccggccaatggcgggggcaggggcgcggggacgtgcgagcggcgaggaatgttcccagtgactcacccgtgagcctcattgaggttagggcggccccatccgtcggtctccgccagctaggatctcccccgccgtccgcccccgcccctcgtctgcctcccccgcccgcgcctccgcccgcgcttccctttcctgcctcgcgccccactccctttcctcccctccctgtttcccttcctgtccttcccagctcacgctctctttccctgccgcctgcctttcttttttcctttttttgcattggcgtcttggggctgttacacacacgcgcgctgtccattgcagcttacataaaggcgggcgcgattatgcaattatattgttagcgatatttcaagagcaatggctcgttttcttaggatttcaacacgaaggcatcatgcatttttgaaaaactagtattgagaataataccttgcaacgtaaagaatgttttttggtatttttacacaatctctactttgaccaaacgagtctggacagttttcttttaatggaaaataggagaaatggaggaaagaatggaaatgatttctgaaaggccaaaagagagtatgtattcctggaacaaaactgcagagaaaagtgattttgaagctgtagaagcacttatgtcaatgagctgcagttggaagtctgattttaagaaatacgttgaaaacagacctgttacaccagtatctgatttgtcagaggaagagaatctgcttccgggaacacctgattttcatacaatcccagcattttgtttgactccaccttacagtccttctgactttgaaccctctcaagtgtcaaatctgatggcaccagcgccatctactgtacacttcaagtcactctcagatactgccaaacctcacattgccgcacctttcaaagaggaagaaaagagcccagtatctgcccccaaactccccaaagctcaggcaacaagtgtgattcgtcatacagctgatgcccagctatgtaaccaccagacctgcccaatgaaagcagccagcatcctcaactatcagaacaattcttttagaagaagaacccacctaaatgttgaggctgcaagaaagaacataccatgtgccgctgtgtcaccaaacagatccaaatgtgagagaaacacagtggcagatgttgatgagaaagcaagtgctgcactttatgacttttctgtgccttcctcagagacggtcatctgcaggtctcagccagcccctgtgtccccacaacagaagtcagtgttggtctctccacctgcagtatctgcagggggagtgccacctatgccggtcatctgccagatggttccccttcctgccaacaaccctgttgtgacaacagtcgttcccagcactcctcccagccagccaccagccgtttgcccccctgttgtgttcatgggcacacaagtccccaaaggcgctgtcatgtttgtggtaccccagcccgttgtgcagagttcaaagcctccggtggtgagcccgaatggcaccagactctctcccattgcccctgctcctgggttttccccttcagcagcaaaagtcactcctcagattgattcatcaaggataaggagtcacatctgtagccacccaggatgtggcaagacatactttaaaagttcccatctgaaggcccacacgaggacgcacacaggagaaaagcctttcagctgtagctggaaaggttgtgaaaggaggtttgcccgttctgatgaactgtccagacacaggcgaacccacacgggtgagaagaaatttgcgtgccccatgtgtgaccggcggttcatgaggagtgaccatttgaccaagcatgcccggcgccatctatcagccaagaagctaccaaactggcagatggaagtgagcaagctaaatgacattgctctacctccaacccctgctcccacacagtgacagaccggaaagtgaagagtcagaactaactttggtctcagcgggagccagtggtgatgtaaaaatgcttccactgcaagtctgtggccccacaacgtgggcttaaagcagaagccccacagcctggcacgaaggccccgcctgggttaggtgactaaaagggcttcggccacaggcaggtcacagaaaggcaggtttcatttcttatcacataagagagatgagaaagcttttattcctttgaatattttttgaaggtttcagatgaggtcaacacaggtagcacagattttgaatctgtgtgcatatttgttactttacttttgctgtttatacttgagaccaacttttcaatgtgattcttctaaagcactggtttcaagaatatggaggctggaaggaaataaacattacggtacagacatggagatgtaaaatgagtttgtattattacaaatattgtcatctttttctagagttatcttctttattattcctagtctttccagtcaacatcgtggatgtagtgattaaatatatctagaactatcatttttacactattgtgaatatttggaattgaacgactgtatattgctaagagggcccaaagaattggaatcctccttaatttaattgctttgaagcatagctacaatttgtttttgcatttttgttttgaaagtttaacaaatgactgtatctaggcatttcattatgctttgaactttagtttgcctgcagtttcttgtgtagatttgaaaattgtataccaatgtgttttctgtagactctaagatacactgcactttgtttagaaaaaaaactgaagatgaaatatatattgtaaagaagggatattaagaatcttagataacttcttgaaaaagatggcttatgtcatcagtaaagtacctttatgttatgaggatataatgtgtgctttattgaattagaaaattagtgaccattattcacaggtggacaaatgttgatgttgtcctgttaatttataggcgttttttggggatgtggaggtagttgggtagaaaaattattagaacattcacttttgttaacagtatttctcttttattctgttatatagtggatgatatacacagtggcaaaacaaaagtacattgcttaaaatatatagtgaaaaatgtcactatatcttcccatttaacattgtttttgtatattgggtgtagatttctgacatcaaaacttggacccttggaaaacaaaagttttaattaaaaaaaatccttgtgacttacaatttgcacaatatttcttttgttgtactttatatcttgtttacaataaagaattccctttgg

SEQ ID NO: 1095 - DNA, 1488 bp, Homo sapiens
cgctcgccggcggccgggcggtcccagcatgtcggccgccgtggcgtgcctggactacttcgccgccgagtgcctggtgtccatgtccgcgggcgccgtggttcaccgccgcccgccggaccccgagggcgcgggtggagccgcaggctcggaggtgggtgcggcgcatccggagtccgctctgccgggtccggggccatcggggcccgcgtcggtcccccagctcccgcaggtccccgcccccagccccggcgcgggcggcgccgcgccccacctgctggctgcaagcgtctgggcggacttgcgcggcagctctggcgagggctcctgggagaactcgggggaagctccacgcgcctcgtccggcttctccgacccgatcccgtgctccgtccagaccccgtgctccgagctggctcccgcctccggcgccgcggcggtctgcgctcccgagagctcctccgatgcgcccgccgtcccaagcgcgcctgctgccccgggcgcaccagcagcctctggtgggttctctggaggggccctaggggcaggccccgcccccgccgcggatcaggcgccccggaggaggtctgtcacacctgctgccaagcgccaccaatgccccttcccgggctgcaccaaagcctattacaagtcgtcgcacctcaagtcccaccagcgcacccacacgggtgagcgccctttctcctgcgactggctcgactgcgacaagaagtttacgcgttccgacgagctggcccgccactacaggacgcacacgggcgagaagcgcttctcctgccccctctgccccaagcagttctcccggagcgaccacctgaccaagcatgctcgccgccacccaacctatcatccagatatgatcgagtaccggggacgtcgtcgaactccccgcatcgacccgccactcaccagcgaggtggaaagctccgcctccggctccggtcccggcccggcgcccagcttcaccacctgcctgtaggacagtcattgctgtcagtcttaccctcaaggatgatcccccaggccgttgtccctgctttctctctgcccatccttctttcccagagtcattacaccaaggcacagactggttcctctgctctgagggtgggtccaggcagacatgtggactctggggaggtactgggggccggaaaatagcgggaattcttgcaacgtgtatatcatcctaaaagtgggggttgcctcaagacagcccccaggaactgataagaagggatgaactcccgtactctccagagtactgaagattctcccctccctggaaccagggatgtgaaactggaattctcagatgcctgaggagctcccagtctcaaaggactctggtgtctcacccatccaccaggcggaccttggagagggtgtcaggggtggcagtcttggaaatgtccaggactgggatggtgagaggcctttggaaacagaaatgatttctatttctgt

SEQ ID NO: 1096 - DNA, 2886 bp, Homo sapiens
cgccggccggacggacgccgctcccgccgcctccgctccgcccgccgcgccgcgcgcccttgctcggcatgtcggcggccgtggcgtgcgtggattacttcgccgccgacgtgctcatggccatctcttcgggcgccgtggtgcaccgcgggcggcccggccccgagggcgcgggccccgccgccggcctggatgtgcgcgcggcgcgccgcgaggccgcctcacccgggaccccggggccacccccgccgccccccgccgcttctggcccgggccccggcgccgccgcggcgccccacctgctggccgccagcatcctggccgacctgcgcggcggacccggagccgccccggggggcgcctcgcccgcctcctcctcctcagccgcctcgtccccgtcctcgggccgcgcccccggcgccgcgccctccgccgccgccaagagccaccgctgtcccttcccggactgcgccaaagcctactacaagtcctcgcacctaaagtcgcacctgcggacgcacacaggggaacgcccttttgcttgtgactggcagggctgcgacaagaagttcgcccgctccgacgagctggcccgccaccaccggacgcacacgggcgagaagcgcttctcctgccctctgtgctccaagcgcttcacccgcagtgaccacctggccaagcacgcccgccgccaccccggcttccacccggacctgctccggcgccctggtgcccgcagtacctcccccagcgactcgctgccctgcagcctggccgggagccctgcgcccagccccgcgcccagcccagcccccgcaggcctgtagggccctcgtgcagcccaccctgaccgccaggatgcttctgccatccaggggtgtagtgaggacccacggggagcctgggccccttccagccgtgggcaaaccctgaagacacccctgcccccctccagagagtgaggagggggcctgagactggacctgggtctgcctgacctcagaggtggctctcaggatgggtgacgggggcttgtgtctgtaaatagccatgatactaactttcttcccatctgtgcaacggggcccccccagggcagctaggaggtcctcccctctcctctccaccaccccctgctgcccccctcccggggtggggtttgggggggtggagtggacttctgggagccggcccggggaaagcaccccctgccccatccctgcagattgggatgaagtgttcagacagccatagaggagtcgggggttgacacggcccctgcctctccccaccccacccccaccccaccgaaagccatgggagtagttcagggaaatgggggtgcagcccagccaccccccattcgggtactcaatctcaggtgtccacaagttctgcccacggtaggggctgcctggccccccagacctcgggggtagagccaggagtggggcagcgttaggatgcccggaggggctccaggtgttgcttctgagacctgggatggggagggaggggacctctgggttcttccaaagaacatttgactcagtggggtcgggagggaatcctggcttatttattttcctctgtcctcgggtgtgggggccctagctcgccctctctgggtgggtgggtgagagaggctgcaggggaggctggcaccgggcttgggcctccagtccctgccttgctgactttggccgttgcggtatcacgtgacaatcaactctcccttaacgacgactgcggctgttgggctgcgctgccctccctggcctgcaggtggggccgtggagcccatgcccgccggggttgcaggctcttccgggcctgggctgcagcctggcccggccctgcttccctggcctcccctccttctcctgggtgcttggaagaggtgggtcctggcccgtggttgaggtcttgcctcgtggactggaagcagagggctggctgtgcagcctcctggggtagctcgttttttttgcaccgggtagaatattttttcaggcacggattcctttttttctgggcccccatgggtggtccggcatcctcagggggtgtgagtgtgtgtggggggtctctgagctgaacttgggtggggtggggacttgttcctcgggggccacctttgtgtccttgtcagcggtcgtcctgctgtggcctgggttgcatttcctcttggggggggtattgaggacccccagcctggaatgagaagggtccccggttccatgtcagacccagaaaggtggatccccccactgttggctgcaggaggtttttggtacccccttttgttccagaaccgtcctgcctctcgcttggggacaggggggctttggatggcactggtgtgcacctggacccagccccggcctggcaggatccagggatgggtgcctgggatcctggggggagggaggcaggggacgcccttctggagctgggctcggagggtcctgccccatccagccctcggctctctgtgttctctgtccctagcctcaaaccctcttctggcagcgctagtgagatgccttagtctgtgggggtgggtgggggactggggccccgttttcctttgtgagtcttggttggccccagccctggcaggggcctgtctggagcaggggtaggtagggctgtgggttccagaactctataactgggcccctctccagtgtccaggggcttggagagacctgcgcccacccctccactctcccaggagtcgctgatcactgggacctggttccagccgtttgcaggggaggcggctccgagaggcgtgtgctttccgtgggtggcgcccctcccccgccctgcctggcctcatccttgtatttaattaattaaacaagcccctttttaaaccct

SEQ ID NO: 1097 - DNA, 1133 bp, Homo sapiens
atgtcggcggccgtggcgtgcgtggattacttcgccgccgacgtgctcatggccatctcttcgggcgccgtggtgcaccgcgggcggcccggccccgagggcgcgggccccgccgccggcctggatgtgcgcgcggcgcgccgcgaggccgcctcacccgggaccccggggccacccccgccgccccccgccgcttctggcccgggccccggcgccgccgcggcgccccacctgctggccgccagcatcctggccgacctgcgcggcggacccggagccgccccggggggcgcctcgcccgcctcctcctcctcagccgcctcgtccccgtcctcgggccgcgcccccggcgccgcgccctccgccgccgccaagagccaccgctgtcccttcccggactgcgccaaagcctactacaagtcctcgcacctaaagtcgcacctgcggacgcacacaggggaacgcccttttgcttgtgactggcagggctgcgacaagaagttcgcccgctccgacgagctggcccgccaccaccggacgcacacgggcgagaagcgcttctcctgccctctgtgctccaagcgcttcacccgcagtgaccacctggccaagcacgcccgccgccaccccggcttccacccggacctgctccggcgccctggtgcccgcagtacctcccccagcgactcgctgccctgcagcctggccgggagccctgcgcccagccccgcgcccagcccagcccccgcaggcctgtagggccctcgtgcagcccaccctgaccgccaggatgcttctgccatccaggggtgtagtgaggacccacggggagcctgggccccttccagccgtgggcaaaccctgaagacacccctgcccccctccagagagtgaggagggggcctgagactggacctgggtctgcctgacctcagagtgtccaggggcttggagagacctgcgcccacccctccactctcccaggagtcgctgatcactgggacctggttccagccgtttgcaggggaggcggctccgagaggcgtgtgctttccgtgggtggcgcccctcccccgccctgcctggcctcatccttgtatttaattaattaaacaagcccctttttaaaccct

SEQ ID NO: 1098 - DNA, 3131 bp, Homo sapiens
gccgtggtggctggttccctgtctcttcagtagagagtctagaccccacccagtcttcatgtacggccgaccgcaggctgagatggaacaggaggctggggagctgagccggtggcaggcggcgcaccaggctgcccaggataacgagaactcagcgcccatcttgaacatgtcttcatcttctggaagctctggagtgcacacctcttggaaccaaggcctaccaagcattcagcactttcctcacagcgcagagatgctggggtcccctttggtgtctgttgaggcgccggggcagaatgtgaatgaaggggggccacagttcagtatgccactgcctgagcgtggtatgagctactgcccccaagcgactctcactccttcccggatgatttactgtcagagaatgtctccccctcagcaagagatgacgattttcagtgggccccaactaatgcccgtaggagagcccaatattccaagggtagccaggcccttcggtgggaatctaaggatgccccccaatgggctgccagtctcggcttccactggaatcccaataatgtcccacactgggaaccctccagtgccttaccctggcctctcgacagtaccttctgacgaaacattgttgggcccgactgtgccttccactgaggcccaggcagtgctcccctccatggctcagatgttgcccccgcaagatgcccatgaccttgggatgcccccagctgagtcccagtcattgctggttttaggatctcaggactctcttgtcagtcagccagactctcaagaaggcccatttctaccagagcagcccggacctgctccacagacagtagagaagaactccaggcctcaggaagggactggtagaaggggctcctcagaggcaaggccttactgctgcaactacgagaactgcggaaaagcttataccaaacgctcccacctcgtgagccaccagcgcaagcacacaggtgagaggccatattcttgcaactgggaaagttgttcatggtctttcttccgttctgatgagcttagacgacatatgcgggtacacaccagatatcgaccatataaatgtgatcagtgcagccgggagttcatgaggtctgaccatctcaagcaacaccagaagactcatcggccgggaccctcagacccacaggccaacaacaacaatggagagcaggacagtcctcctgctgctggtccttaggtgaatgaagaaggaagaggattccaggctgagagcactggacgtggcaactgttcagaggagaggcagtcttcaagttctacattcattcagaaaaatgttttttgagcctacaatactgagcgcaacaaggctgtggagacccatggtgaggagcatggagttaactaaaggatgtgtcagggaagaaagacttctcaaggaggtgcctccatcagacccaaaggactcatgggggctagctgcacctcacatttcttggacatataccgttggacatgtctatcttctggaaactatggcatggacagtaaggattcagaagtgcatgaaggcaccctgcctctgcagagcagaaagatcatagacaacatttatgaatgtgcccagtgctgccaagaagagaagccggtcctctgcaggctcaagcctatctgggcctctggggaagccccacagccttggctgtgcctgcccctgccctctcacccctaccctgaccttgtcctacttcactgcctttgtctgtgttactagtggccccagtatacctgggatggacatccaggtgcccttcatccaagctcctatgtgaggggaatggacattattaaaagaacaggggcagaagtggctcatttatgacccattcactagccccagggattgaagtcttgggtactcaaagtgtctttctaccagggcaccagatcccttccatggagcaggtcatctcgggttcactgggccagggatggtctctgttccccagcccacctggctcacacacagcctcatgggtagggtcagcaaaccagatggcttgttgttggaatgtaggatgagaggcctgcttggtgacctagcattttcaccaagaagtggacgtggagaggaccagagtgatcaagggtgtatgatgtgcactacaatggtgggcaaaacaggctcctgctcttgtggaggtcacaatctagcggagaaaggatgttactagaagtacacaaattgggcccggcgcgatggctcacgcctgtaatcccagcacttttggaggccgaggcaggcggatcatttgaggttagagattcgagaccagccgggccaacatggtgaaaccccatctctacaaaaaatacaaaaattagcctggcatatggcgggtaccgtaatcctagctactcgggagactgacgggagaatcgcttgaacccaggaggcggaggttgcagtgagctcagatctcaccattgcactccagcctgggcgactgagcgagactctatctcaaaacaatcaaaacaaaaaagacctgtggactctagtagattttgaatcctgcctctgccatttcctggctatgaggtgtcttgagaaatttacttgtcactcttgcttctgatagtaaaggggatggtgcgatagattcaagatggagagataaggttaagtgttttctttggctgcaacatggagattagattagagcaaggatgtaagggagaggaagggacatagcagtatttcaggtgagagtcaaggtggctttggctagggtgtgagagtggaggtagggagaagtaggaaagtgatagttaactggatttgttaggtgagggtgaggccaagggtgacttccaggttcctgacttgtgttataagtaacacagaagaagaatggatgaacttgattcgttttccattgattgtgatatctatcatacctgcaaaaaatattttgtatatatccaatttaataataaatgcactcatgttaggaaggtcaaaaaaaaggaaaaaagaaaaataataaaaaataataaaaatccttaggataacttgaggccaggagtttgagaccagtgtgaccttgtctctgtaaaaaataaaattaaaagaaaaa

SEQ ID NO: 1099 - DNA, 5122 bp, Homo sapiens
cgcagagcgagcggcgccggcgtcatgtgactgcccggagttggtgccaggagccagaggggagccaggagcggagccgcgcggagccggggcccgagccggagcgcagcgagagcgcccgccgcacgcgcgcccgtccccgtcccctgcggccgccaacgccgcccggactggagccctgacattgctgcgctcggggggctccaggcagcccgtatcggggcctttatttctcgtcggcggcgccctgcaccgcgcctcgcaaagccaaacaccagagcaccctagaaggtttaactaaaagaatgctcatgtttgacccagttcctgtcaagcaagaggccatggaccctgtctcagtgtcatacccatctaattacatggaatccatgaagcctaacaagtatggggtcatctactccacaccattgcctgagaagttctttcagaccccagaaggtctgtcgcacggaatacagatggagccagtggacctcacggtgaacaagcggagttcacccccttcggctgggaattcgccctcctctctgaagttcccgtcctcacaccggagagcctcgcctgggttgagcatgccttcttccagcccaccgataaaaaaatactcacccccttctccaggcgtgcagcccttcggcgtgccgctgtccatgccaccagtgatggcagctgccctctcgcggcatggaatacggagcccggggatcctgcccgtcatccagccggtggtggtgcagcccgtcccctttatgtacacaagtcacctccagcagcctctcatggtctccttatcggaggagatggaaaattccagtagtagcatgcaagtacctgtaattgaatcatatgagaagcctatatcacagaaaaaaattaaaatagaacctgggatcgaaccacagaggacagattattatcctgaagaaatgtcaccccccttaatgaactcagtgtcccccccgcaagcattgttgcaagagaatcacccttcggtcatcgtgcagcctgggaagagacctttacctgtggaatccccggatactcaaaggaagcggaggatacacagatgtgattatgatggatgcaacaaagtgtacactaaaagctcccacttgaaagcacacagaagaacacacacaggagaaaaaccctacaaatgtacatgggaagggtgcacatggaagtttgctcggtctgatgaactaacaagacatttccgaaaacatactggaatcaaacctttccagtgcccggactgtgaccgcagcttctcccgttctgaccatcttgccctccataggaaacgccacatgctagtctgattgcctctgtgtcctgcctcagcgtgactccccactcacctggctctctctctgtcctgcctcccattatctaacacattttttacatgtacattttaatttgattcagctggtctgaatctctgaatttatatcatccaaaacttccatatggtcagtagtagatgttctctaatcctccctctccttaccacgggtcagacctaaagaatgtgaacacttttttttttttttctggggatgctaagcaaacccttcttacagatacgtttaatgtaataagaacaagggaacatgtaaactaacataaccaattgtcagttctccatgtattcctcaaaagaatgtcagagtaaatgtattagaaatacagtatccagactgctagtccttgccagagacattcttacctctgccctgtgataatattttatgcttgacagtgaaaacaagtgtggccccttgcaccggttagctagaagtacagccagatttcaagctagtgcagtcacctcttccgtcattcttcacaaatcttgtcaacctggatcttagacttcatctgaatcgagttctttgccctcctttgtgcctgcagctcatatggaggtctttgccaccaatgggagatgagcccaaactttcgatctaggtgggtgatgtgtagcagttcaagggaagggtgctgtgttttcatagcatggagtcggaggagagggccatttagcagggggagcagaagaggcaattcctcctgggctaggggttgtcagtgaggtttcaacattttgttagctgtgtgcagcattcccagagcttcagtctctgtgcatactcagctttgtagaaccatgctgcaaagccatataccgatggggttatccatgcaactatctccattcctacaatgtccttaatatgagatcatcaaacattgatagtagggactccatggaatatttgcccagtaatggtaagaaatctttcgggtaagagtatggatggttcttcttttacccaatctgcttatagctttttttgtaaacagggaaatgttgagtggtacttgtattcccttatcaaattaatcacatagcttttatacagaaactcttcctgtgtgagctgttaaggtgccaaattggctgtcatttgtattcatgacacataccataaagcatctgctaatgctttaatggattgattcaattaagacctgagtgacactatttgtaaatataactagttgtgaagcacacatacctttattttgggaatttatgagaaaatatagaaaaccacagatcagggattcatatatgtagctcaaaaattcccaaaagtttactgttagagttggcaatttcctatcactatttcagtgtcagaacaaactgaaaataatggctcgtgtttatgttgaagataaatagcaccattattgggggaagttattcaaaagcaggcttttgagcaccatagtctaaatgccaataaaaataattcatacatagaaatgtcattggtcctgaatttgaagaaagtgagcaacagtagttaaatgtgggtgcatataaccaaattccccttcatcaagaatggaggagaagagagaagaatgaaatcctgaagattcatcccagccgcaactcaggatccaacacaactttaactgggaggaatacattgtttgatcatttttaaaacatctgtgaatgagtgattccggaggcctgtgaattgtgtggggagcttgctttgatggcactgtgttaataaaagttgtagggactgtgcacctaagaggctaagaggtcccactcatccgccctgtgaaccagctgtaaagaaatgtagttaagaaatgcaaagaaatgtgttatcttggcacttgggtttgattttcctttttttaaagcactgcaaaacttctttaggatactaaaacatcctaattgggctgtttttttgttttgttttgtttttcagctaaaggcaaagataatttttttttcagctgaagtttttcttttttgcaactatgacatgaattgagtgataaaatggctctttgaaaagtagatattgtctgtattgtaaatgcttagtcatattcatggcaaagtgttcatttcttgagatggttctttcacaacacacaagaatcaagatggaacgcaaggaaaatctttttgttttgaccgaggtaaccagtttatgtgtgttccaatccatagagaagtgggggaaagggcgagaaaggatcagattgatctgggatcagctttgagcctgagttcagtgaatagcctcatgggcatctcatggaattgatgcatttgctgtggcatatttaaattttgttcaaaagatttgaagcaagaccttgcaaagactcttaacattactgttcagcttgcttagattgtgttaacagttcatttaacaaagatccgttttaactctgaacaaaagcaacccagagcggccattctctattcccatgctggtcaatacgctttcattaccaattggcccttaccaaacttttcttatatatatatttgtattttactatgatagttgagaaatttagcctcttagtcatttttagctgttattgtggaagacctcaaatacaagattagatgcccttgaacatgttttaatgatgtgtgtcatgttactatcaatggtgatttcaatcgcaatattttaaattgatgagaatgatttgtaaacatgaagttactattacgtaaattctgtttgttatagagtttcttcagttgttacccaagtgtcatcctagagaagtcagaagaatcagaatccatcgtattttagagttatgtgaatctacatcataaatgggcattaacattctaaattgcttggtttggagaatgtgttagcagcatagctatattcaactagggagatgctaaatacacagaagtttcaagagccttggaacagaattacaggggaactatatatgtatatgtatattttattaaacacccatctgcactatcagtattgcactaatgtggaatttgaaagactattttgctgatactgtatatatgcgcatcattcctgattagattgttgtaaagacaatctgaaagatctaaggttttaaaataatttggtttgaaaatatacagttgtcttgaaggaattgctgtcatacatgaagttgctccgagctgtctttattctcttcttggtcaaggttaacaattgctaaatgatcgcaaattcacctaaacaatacatttacaaagccatctttacatgcattaaacgagggctacaacaatattgttttacaaatactagcacttttttttctgttatgtacttagtgttagagggtcaaaataatctttctgcttagcatctcttaaaccatacctgcaaatatagcaggattattacatttacagtactttaatacttgtataaactatgcagaaatttttaataaagtgtaatatattttataagctaataagactgaatgggtaaaggtttttagcatgcattagtatacttgcagatactgaaacattttggtaatctttcttactaaagatgtgaatgtttaatgtaccttctctgtttctactctgtagtccaatgggaattcagtaatgacattttgtcatgtcaaactgtgaacataaatttgtactgtacagtcctcatatactatatacagtatgcaatatatattatatacttgttaataaaaccatcagaatattaaa

SEQ ID NO: 1100 - DNA, 3562 bp, Homo sapiens
gcggccgccctgcgcgcgaagctcgtggcccgagaggggtgcggtcgggccgacggaggcggggccctggctgcctctctccctgctcataggctggccgctcaggcctggccggcctcggggcctcgggattcgcggcggcgctgccaatcaggcgatcgggccccgcccccccggagttgggtgaaatagaggcgggcgtcaagtgtcagtagtcgcggggcaggtacgtgcgctcgcggttctctcgcggaggtcggcggtggcgggagcgggctccggagagcctgagagcacggtggggcggggcgggagaaagtggccgcccggaggacgttggcgtttacgtgtggaagagcggaagagttttgcttttcgtgcgcgccttcgaaaactgcctgccgctgtctgaggagtccacccgaaacctcccctcctccgccggcagccccgcgctgagctcgccgacccaagccagcgtgggcgaggtgggaagtgcgcccgacccgcgcctggagctgcgcccccgagtgcccatggctacaagggtgctgagcatgagcgcccgcctgggacccgtgccccagccgccggcgccgcaggacgagccggtgttcgcgcagctcaagccggtgctgggcgccgcgaatccggcccgcgacgcggcgctcttccccggcgaggagctgaagcacgcgcaccaccgcccgcaggcgcagcccgcgcccgcgcaggccccgcagccggcccagccgcccgccaccggcccgcggctgcctccagaggacctggtccagacaagatgtgaaatggagaagtatctgacacctcagcttcctccagttcctataattccagagcataaaaagtatagacgagacagtgcctcagtcgtagaccagttcttcactgacactgaagggttaccttacagtatcaacatgaacgtcttcctccctgacatcactcacctgagaactggcctctacaaatcccagagaccgtgcgtaacacacatcaagacagaacctgttgccattttcagccaccagagtgaaacgactgcccctcctccggccccgacccaggccctccctgagttcaccagtatattcagctcacaccagaccgcagctccagaggtgaacaatattttcatcaaacaagaacttcctacaccagatcttcatctttctgtccctacccagcagggccacctgtaccagctactgaatacaccggatctagatatgcccagttctacaaatcagacagcagcaatggacactcttaatgtttctatgtcagctgccatggcaggccttaacacacacacctctgctgttccgcagactgcagtgaaacaattccagggcatgcccccttgcacatacacaatgccaagtcagtttcttccacaacaggccacttactttcccccgtcaccaccaagctcagagcctggaagtccagatagacaagcagagatgctccagaatttaaccccacctccatcctatgctgctacaattgcttctaaactggcaattcacaatccaaatttacccaccaccctgccagttaactcacaaaacatccaacctgtcagatacaatagaaggagtaaccccgatttggagaaacgacgcatccactactgcgattaccctggttgcacaaaagtttataccaagtcttctcatttaaaagctcacctgaggactcacactggtgaaaagccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatgacagacctaactattcctgtgtaaaaacaacaaaaacaaacaaaagcaagaaaaccacaactaaaactggaaatgtatattttgtatatttgagaaaacagggaatacattgtattaataccaaagtgtttggtcattttaagaatctggaatgcttgctgtaatgtatatggctttactcaagcagatctcatctcatgacaggcagccacgtctcaacatgggtaaggggtgggggtggaggggagtgtgtgcagcgtttttacctaggcaccatcatttaatgtgacagtgttcagtaaacaaatcagttggcaggcaccagaagaagaatggattgtatgtcaagattttacttggcattgagtagtttttttcaatagtaggtaattccttagagatacagtatacctggcaattcacaaatagccattgaacaaatgtgtgggtttttaaaaattatatacatatatgagttgcctatatttgctattcaaaattttgtaaatatgcaaatcagctttataggtttattacaagttttttaggattcttttggggaagagtcataattcttttgaaaataaccatgaatacacttacagttaggatttgtggtaaggtacctctcaacattaccaaaatcatttctttagagggaaggaataatcattcaaatgaactttaaaaaagcaaatttcatgcactgattaaaataggattattttaaatacaaaaggcattttatatgaattataaactgaagagcttaaagatagttacaaaatacaaaagttcaacctcttacaataagctaaacgcaatgtcatttttaaaaagaaggacttagggtgtcgttttcacatatgacaatgttgcatttatgatgcagtttcaagtaccaaaacgttgaattgatgatgcagttttcatatatcgagatgttcgctcgtgcagtactgttggttaaatgacaatttatgtggattttgcatgtaatacacagtgagacacagtaattttatctaaattacagtgcagtttagttaatctattaatactgactcagtgtctgcctttaaatataaatgatatgttgaaaacttaaggaagcaaatgctacatatatgcaatataaaatagtaatgtgatgctgatgctgttaaccaaagggcagaataaataagcaaaatgccaaaaggggtcttaattgaaatgaaaatttaattttgtttttaaaatattgtttatctttatttattttgtggtaatatagtaagtttttttagaagacaattttcataacttgataaattatagttttgtttgttagaaaagttgctcttaaaagatgtaaatagatgacaaacgatgtaaataattttgtaagaggcttcaaaatgtttatacgtggaaacacacctacatgaaaagcagaaatcggttgctgttttgcttctttttccctcttatttttgtattgtggtcatttcctatgcaaataatggagcaaacagctgtatagttgtagaattttttgagagaatgagatgtttatatattaacgacaattttttttttggaaaataaaaagtgcctaaaaga

SEQ ID NO: 1101 - DNA, 1401 bp, Homo sapiens
actttagctcagacctttcttttaaccttgcctatcatgtttcgagtcagaatttaaatactgtgcagtttaagctacaatacgcttggcctataacttggttccaggcatttatatttatgtcacttttgtctacttattatactaacaaggtggaaaaagcaatcccagtctctccaaaagacaagatgtgaaatggagaagtatctgacacctcagcttcctccagttcctataattccagagcataaaaagtatagacgagacagtgcctcagtcgtagaccagttcttcactgacactgaagggttaccttacagtatcaacatgaacgtcttcctccctgacatcactcacctgagaactggcctctacaaatcccagagaccgtgcgtaacacacatcaagacagaacctgttgccattttcagccaccagagtgaaacgactgcccctcctccggccccgacccaggccctccctgagttcaccagtatattcagctcacaccagaccgcagctccagaggtgaacaatattttcatcaaacaagaacttcctacaccagatcttcatctttctgtccctacccagcagggccacctgtaccagctactgaatacaccggatctagatatgcccagttctacaaatcagacagcagcaatggacactcttaatgtttctatgtcagctgccatggcaggccttaacacacacacctctgctgttccgcagactgcagtgaaacaattccagggcatgcccccttgcacatacacaatgccaagtcagtttcttccacaacaggccacttactttcccccgtcaccaccaagctcagagcctggaagtccagatagacaagcagagatgctccagaatttaaccccacctccatcctatgctgctacaattgcttctaaactggcaattcacaatccaaatttacccaccaccctgccagttaactcacaaaacatccaacctgtcagatacaatagaaggagtaaccccgatttggagaaacgacgcatccactactgcgattaccctggttgcacaaaagtttataccaagtcttctcatttaaaagctcacctgaggactcacactggtgaaaagccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatgacagacctaactattcctgtgtaaaaacaacaaaaacaaacaaaagcaagaaaaccac

SEQ ID NO: 1102 - DNA, 2057 bp, Homo sapiens
agtagtcgcggggcaggtacgtgcgctcgcggttctctcgcggaggtcggcggtggcgggagcgggctccggagagcctgagagcacggtggggcggggcgggagaaagtggccgcccggaggacgttggcgtttacgtgtggaagagcggaagagttttgcttttcgtgcgcgccttcgaaaactgcctgccgctgtctgaggagtccacccgaaacctcccctcctccgccggcagccccgcgctgagctcgccgacccaagccagcgtgggcgaggtgggaagtgcgcccgacccgcgcctggagctgcgcccccgagtgcccatggctacaagggtgctgagcatgagcgcccgcctgggacccgtgccccagccgccggcgccgcaggacgagccggtgttcgcgcagctcaagccggtgctgggcgccgcgaatccggcccgcgacgcggcgctcttccccggcgaggagctgaagcacgcgcaccaccgcccgcggctgcctccagaggacctggtccagacaagatgtgaaatggagaagtatctgacacctcagcttcctccagttcctataattccagagcataaaaagtatagacgagacagtgcctcagtcgtagaccagttcttcactgacactgaagggttaccttacagtatcaacatgaacgtcttcctccctgacatcactcacctgagaactggcctctacaaatcccagagaccgtgcgtaacacacatcaagacagaacctgttgccattttcagccaccagagtgaaacgactgcccctcctccggccccgacccaggccctccctgagttcaccagtatattcagctcacaccagaccgcagctccagaggtgaacaatattttcatcaaacaagaacttcctacaccagatcttcatctttctgtccctacccagcagggccacctgtaccagctactgaatacaccggatctagatatgcccagttctacaaatcagacagcagcaatggacactcttaatgtttctatgtcagctgccatggcaggccttaacacacacacctctgctgttccgcagactgcagtgaaacaattccagggcatgcccccttgcacatacacaatgccaagtcagtttcttccacaacaggccacttactttcccccgtcaccaccaagctcagagcctggaagtccagatagacaagcagagatgctccagaatttaaccccacctccatcctatgctgctacaattgcttctaaactggcaattcacaatccaaatttacccaccaccctgccagttaactcacaaaacatccaacctgtcagatacaatagaaggagtaaccccgatttggagaaacgacgcatccactactgcgattaccctggttgcacaaaagtttataccaagtcttctcatttaaaagctcacctgaggactcacactggtgaaaagccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatgacagacctaactattcctgtgtaaaaacaacaaaaacaaacaaaagcaagaaaaccacaactaaaactggaaatgtatattttgtatatttgagaaaacagggaatacattgtattaataccaaagtgtttggtcattttaagaatctggaatgcttgctgtaatgtatatggctttactcaagcagatctcatctcatgacaggcagccacgtctcaacatgggtaaggggtgggggtggaggggagtgtgtgcagcgtttttacctaggcaccatcatttaatgtgacagtgttcagtaaacaaatcagttggcaggcaccagaagaagaatggattgtatgtcaagattttacttggcattgagtag

SEQ ID NO: 1103 - DNA, 5185 bp, Homo sapiens
tgacataatggggtttttttaattatagattcacactgcatttattcatcacccctgtcctctcatccataactcaaatttactaccagcaacacaaaatacaaagatgtgtccagtttcactacagctcttcgcgtttacaagtgtcgagcgcttgctttcggaacgcccttgtgattggccgagccaatgccagtgacatcaaccaacttacttttgattggaaggctggttgctgggactgtagcgtttgcaggaagtcacttaactgtttgggagctggaaaaccgaagctgaagttctcttttgccataggaacgagcgcaactgactaggaaagatgtgtcccaaagctccgcaagctggaacgtgagccaggaggcccggaccggccacgggaccgcgaggcactccgaaagtgtgcggctgccccttccctgcctcccagctgttacccttttaaatgtcagtgttcgaggctgtaggggtagcacgaggcagcgaaacggaacagtcggattggccgcacgcctcagttctagacgcacctctccaccgaaggccgttctgactggcagggggagaaagtaaacagagttgaatcaccctccccactggccaattggagggggtttggtttgtgacgtgatgggattctgcgaaattgttactgagcaagagaatgccggaacggtgcggaccggccggagcaggggttcagaagccgtcagtggactcgggaaaaagtgtctcttagacctggcgctcggcgggaccctcgccacccgcgtcggggtgatcgggtgaatgtcctggggctttggctcgacggcgaggcggccgagggcgtgcacctctcttgcagtttcctctcccagcgcctcgggggcgttttcagtcgaataaacttgcgaccgccacgtgtggcatctttccaagggagccggctcagaggggccggcgcgcccgtcgggggatcgcggccggcgcggggcaggggcggcggctagaggcggcggcgcggcggagcccggggccgtggatgctgcgtgcggaggcgctgccggttacgtaaagatgaggggctgaggtcgcctcggcgctcctgcgagtcggaagcgccccgcgcccccgcccccttggccgccgcgccgtgccgcgccgcgccgcgctcgtcgtccgaggccagggcagggcgagccgaacctccgcagccaccgccaagtttgtccgcgccgcctgggctgccgtcgcccgcaccatgtccgcggccgcctacatggacttcgtggctgcccagtgtctggtttccatttcgaaccgcgctgcggtgccggagcatggggtcgctccggacgccgagcggctgcgactacctgagcgcgaggtgaccaaggagcacggtgacccgggggacacctggaaggattactgcacactggtcaccatcgccaagagcttgttggacctgaacaagtaccgacccatccagaccccctccgtgtgcagcgacagtctggaaagtccagatgaggatatgggatccgacagcgacgtgaccaccgaatctgggtcgagtccttcccacagcccggaggagagacaggatcctggcagcgcgcccagcccgctctccctcctccatcctggagtggctgcgaaggggaaacacgcctccgaaaagaggcacaagtgcccctacagtggctgtgggaaagtctatggaaaatcctcccatctcaaagcccattacagagtgcatacaggtgaacggccctttccctgcacgtggccagactgccttaaaaagttctcccgctcagacgagctgacccgccactaccggacccacactggggaaaagcagttccgctgtccgctgtgtgagaagcgcttcatgaggagtgaccacctcacaaagcacgcccggcggcacaccgagttccaccccagcatgatcaagcgatcgaaaaaggcgctggccaacgctttgtgaggtgctgcccgtggaagccagggagggatggaccccgaaaggagaaaagtactcccaggaaacagacgcgtgaaaactgagccccagaagaggcacacttgacggcacaggaagtcactgctctttggtcaatattctgattttcctctccctgcattgtttttaaaaagcacattgtagcctaagatcaaagtcaacaacactcggtccccttgaagaggcaactctctgaacccgtctctgactgttggagggaaggcaaatgcttttgggttttttggtttttgtttttgtttttttttctccttttatttttttgcgggggagggtagggagtgggtgggggggaggggggtaaggccaagactggggtagaattttaaagattcaacactggtgtacatatgtccgctgggtgagttgacctgtggcctcgcacagtgattctgggccctttatgcttgctgtctctcagaattgttttcttaccttttaatgtaatgacgagtgtgcttcagtttgtttagcaaaaccactctcttgaatcacgttaacttttgagattaaaaaaaaaaacgccatagcacagctgtctttatgcaagcaagagcacatctactccagcatgatctgtcatctaaagacttgaaaacaaaaaacagttacttatagtcaatgggtaagcagagtctgaatttatactaatcaagacaaacctttgaaaggttacactaagtacagaacttttaaaccttgctttgtatgagttgtactttttgaacataagctgcacttttattttctaatgcagaggatgaataagttaaatacatgctttgaggatagaagcagatgttctgtttggcaccacgttataatctgcttattttacaatatacacgtttccctaagaaatcatggcagagatgtgagggcagaatatacacaacagatgctgaaggagaaggagggtagtgttttgcaaaagaaaaagaaaagaaccaacagaattttaactctattaacttttccaaattttcctatgcttttagttaacatcattattgtatcctaatgccactaggggagagagcttttgactctgttgggttttatttgaatgtgtgcataacagtaatgagatctggaaacacctattttttggggaaaaaggtttgttggtctccttcctgtgttcctacaaaactcccactctcaggtgcaagagttatgtagaaggaaagggagctgaaataggaacagaaaaatcaacccctataactagtgaacaccaagggaaaataccacaatgatttcagaggagactctgcaaaatcgtcccttgtggagaatgcaggcaacatggaatactaggaatgaaatcacatcactgtatcttttacatcaatagcctcaccactaatatatcttgtatctaggtgtctataatggctgaaaccactacatccatctatgccatttacctgaaaacttaactgtggcctttatgaggccagaaaagtgaactgagttttcgtagttaagacctcaaatgaggggagtcagcagtgatcatgggggaaatgtttacattttttttttcttcagaagtaacgctttctgatgattttatctgatatttaaaacagggagctatggtgcactctagtttatacttgcgctctgaaatgtgtaaacatagggtgcctacctatttcacctgacccatactcgtttctgattcagaatcagtgtgggctcctgcagtgggcgcgggtcacggctgactccaacttccaatacaacagccatcactagcacagtgtttttttgtttaaccaacgtagttgtattagtagttctataaagagaactgcttttaacattagggactgggagcagtccatgggataaaaaggaaagtgttttctcacgagaaaacatgtcaggaaaaataaagaacactttctacctctgtttcagatttttgaaacacttattttaaaccaaattttaatttctgtgtccaaaataagttttaaggacatctgttcttccatacgaaataggttaggctgcctatttctcactgagctcatggaatggttctgcttatgatactctgcacgctgccttttagtgagtgaggagtttggggttgcctagcaacttgctaacttgtaaaaagtcatctttccctcacagaaagaaacgaaagaaagcaaagcaaagtcagtgaaagacaatctttatagtttcaggagtaaatctaaatgtggcttttgtcaagcacttagatggatataaatgcagcaacttgttttaaaaaaatgcacaatttacttcccaaaaaagttgttacttgccttttcaagttgttgacaaacacacatttgatattctcttatatgttatagtaatgtaacgtataaactcaagcctttttattctttgtgattaaatcctgttttaaaatgtcacaaaacaggaaccagcattctaattagatttactatatcaagatatggttcaaataggactactagagttcattgaacactaaaactatgaaacaattactttttatattaaaaagaccatggatttaacttatgaaaatccaaatgcaggatagtaatttttgtttacttttttaaccaaactgaatttttgaaagactattgcaggtgtttaaaaagaaagaaaagttgttttatctaatactgtaagtagttgtcatattctggaaaatttaatagttttagagttaagatatctcctctctttggttagggaagaagaaagcccttcaccattgtggaatgatgccctggctttaaggtttagctccacatcatgcttctcttgagaattctatttggtagttacaattacagaaactgattagtttgtcagtttgcagatagatttagcacagtactcatcactcggatagattgagatgttctttcacatcagatgatctgtaacactgtaagatactgatctttacaactgtttaatcagttttatttttgtacagtattagtgacctaagttattttgctgtcccgtttttgtaaatcaaatgaaattataaaagaggattctgacagtaggtattttgtacatatgtatatatgttgtccaaataaaaataataaatgataaagactgaattgttctagc

SEQ ID NO: 1104 - DNA, 4197 bp, Homo sapiens
gcattgcgcccgcagccctggaccatttgtcaggactactcgtgagacggagaaaaaaaaaagagaaaatttggggaacccttaggagaaatcttgagagtggacagcaattgtgaagatcgccagagagttctgtgtttcatcaccgccgaaaggttaaaaaataaatcatgactgaatctgcctctagcacaagtggtcaagagtttgatgtgttcagtgttatggactggaaagatggagtgggcacgttaccaggaagtgacttaaagtttcgggtaaatgagtttggagccctggaagttattacagatgagaatgagatggaaaatgttaaaaaagcaactgctaccaccacttggatggtaccaactgctcaagaagccccgacctctcccccgagctccaggcccgtatttccacctgcctactggacatctccacctggatgtcccacagtcttttcagagaagactgggatgcctttcaggttgaaggatccagtgaaagtagaagggcttcagttctgtgagaactgttgtcagtatggcaacgtagatgagtgtctttctggaggaaactattgcagccagaattgtgctcggcacatcaaagataaagatcagaaggaagaaagggacgtagaagaagacaatgaggaagaagatcctaagtgtagtcggaagaaaaaaccaaaattatctctgaaagctgacaccaaggaggatggagaagagagagatgatgaaatggagaacaaacaagatgtaagaatcctgaggggttcgcagagagcacggaggaaaagacgaggggattcggctgtactaaagcagggtttgcctcctaaaggaaagaaagcgtggtgctgggcatcctacctggaagaggagaaagcggtggcagtgccggcgaagctgttcaaggagcatcaatcctttccatataacaaaaatggattcaaagttggcatgaaattagaaggcgtggatcctgagcatcagtctgtgtactgtgtcctcaccgtcgcggaggtttgtggataccggataaagcttcactttgatgggtattctgattgctatgacttctgggtgaatgcagacgctctggatatccacccagttgggtggtgtgagaaaaccggccacaaactccatcctccaaaagggtataaagaagaagaattcaattggcagacctatcttaagacatgtaaagctcaagctgctcctaagtcattatttgaaaatcagaatataacagtgatcccatcgggctttcgagttggtatgaagcttgaggcagtagacaaaaagaatccctcattcatctgtgttgctacggtaacagatatggtggacaatcgtttcctggtacattttgacaactgggatgagagctatgactattggtgtgaagcatcaagtccacatattcatccagttggttggtgtaaggaacatagaagaacccttattactccaccaggttatccaaatgtgaaacatttttcttgggataaatacttagaagaaaccaattctttacctgctcctgcaagagctttcaaagtgaaacctcctcatggattccagaaaaaaatgaagcttgaggttgtagacaaaaggaaccctatgtttattagagtagcaactgtggcagacacagatgatcaccgggtaaaagttcactttgatggctggaacaattgctatgattactggatagatgcagattctcctgatattcaccctgtaggctggtgttcaaaaacaggacatccccttcagcctcctttgagccccttagaattaatggaagcttcagaacatggtggatgctcaaccccgggatgtaaagggattggccatttcaagagagcgagacatctgggccctcacagtgctgccaactgtccctattcagaaatcaatttgaataaagaccgtatttttccagaccgcttaagtggtgagatgcctccggctagtccgtcatttccaagaaataaaaggacagatgcaaatgaaagctcttcttcccctgaaatcagagaccagcatgctgatgatgtcaaagaagactttgaagagagaacagaaagtgaaatgagaacatcacatgaagccagaggtgcccgggaagaacccaccgtccagcaggcacagcgtcggtcagctgtctttctgtcctttaagtccccaattccatgtctgcccttgcgctgggagcagcaaagcaaacttcttccaactgtcgcaggaatccctgccagtaaagtttccaaatggagcacagacgaggtgtcagaatttatacagagcttacctgggtgtgaagaacatggaaaggtatttaaagatgaacaaattgatggagaagcatttctacttatgactcaaacagacattgttaaaattatgagcattaaactgggccctgctctcaaaattttcaattccatcctgatgttcaaagctgcagagaagaattctcacaatgaactttgaagatggtgaattctgaataccatcagcattctgctttaaagctcatgttttattcaaagcacaaggacggttataactcctaagtgagaagtctccaaaactcaaaagagcaacactatcggattatttatattactcaagagacaatatatatgaattcttatgaaagtgcttgagcttttaaccaggtactgtctaacaacagtcatcttttggttctgttcactgagctaaatttatctttgtaaatctttttgagtctggggggtggggggaaggggggcttcattaattatttatggtaatggggggcagagtaagaacttttggcattttgtaaacattgttgaattctctttcatgtacactgtttctttttcaatactttcagaaacctttttatataatcaaatttcaatttaaaccaaattagtcgaaacctggctaagtttagccagtaggactgttatctgtattgttaattttgtgccatattttgaattgcaacattatgctaagtataactttgcaagtcatgatattgcctaactgcttgtcataattgtcagggctgaatagttgtaagaatgacttttctttgaatcagtatttttccttttgcacgcattatgaaatgttaaacaaattacttttcaccagcatctttactataattaccaaaaacatgtatataaaagaatgaaattgaaaaataaaatatataaacataaataaattaggtagtgtattttgagtggcatcagtctcactcatcttggtgccccggtgtttacaagagccagatggtgtcagaggagtacgcagttgtatgcagttatggttggggggaatgtttgtgagggtcttgaactatttatgagatgatcttgagcttctaattttcattgatgaaattgtggtggtttacagagactaagagctcattctgtcaacagaaacactaatctgtacagagcgctgtctcaggtcatgcattgtcctccaaacccaaaggtttttttcagggttggctagagagcgagtattgtgattttgctgaaaagacaaggtgtgaaggagcaacttcagttgacacaaaatttgaaatgctcacagatcagggaggtgatttcccaaagtaattgcccaagaacctccgttttggaaggattcctttttctgtagaatactttgcctcgatatataagcatacagatgcactttaaatgaaaacccttgattataaattgatagctggtagtgtttcttttgcaagaatgcatttctaaggcaaaaggtaaattattttgtccgtcttttgatgtactttctgattccaggattggatatttattcaaggactattttaaaaatagaaagtaagtttgtagcatgctgtctgaattctggggtaagttccacctcttctttagttgctttcgttttttatgatgtaggacttcctttgatatccctgttggaagtccattagcagtcctttgcatttgccaattcaaggtaaaacagggtcagtgacatctgcagtgtcccagtcatttatttgcatgaatctgcttaaataagttttttgttgctgttttttcttttttatgttttgttcagaatttgtacattcaagttgtacttgttatatctgacatgaatgaaataaaatcttaattac

SEQ ID NO: 1105 - DNA, 4235 bp, Homo sapiens
agggctgggggcgtcggtctgtccgtcgcgctcagagggaggtgggggtaactagccgctttccagggcgcggggaccgcggctctaccccacccttccacgggagacggagaacccttaggagaaatcttgagagtggacagcaattgtgaagatcgccagagagttctgtgtttcatcaccgccgaaaggttaaaaaataaatcatgactgaatctgcctctagcacaagtggtcaagagtttgatgtgttcagtgttatggactggaaagatggagtgggcacgttaccaggaagtgacttaaagtttcgggtaaatgagtttggagccctggaagttattacagatgagaatgagatggaaaatgttaaaaaagcaactgctaccaccacttggatggtaccaactgctcaagaagccccgacctctcccccgagctccaggcccgtatttccacctgcctactggacatctccacctggatgtcccacagtcttttcagagaagactgggatgcctttcaggttgaaggatccagtgaaagtagaagggcttcagttctgtgagaactgttgtcagtatggcaacgtagatgagtgtctttctggaggaaactattgcagccagaattgtgctcggcacatcaaagataaagatcagaaggaagaaagggacgtagaagaagacaatgaggaagaagatcctaagtgtagtcggaagaaaaaaccaaaattatctctgaaagctgacaccaaggaggatggagaagagagagatgatgaaatggagaacaaacaagatgtaagaatcctgaggggttcgcagagagcacggaggaaaagacgaggggattcggctgtactaaagcagggtttgcctcctaaaggaaagaaagcgtggtgctgggcatcctacctggaagaggagaaagcggtggcagtgccggcgaagctgttcaaggagcatcaatcctttccatataacaaaaatggattcaaagttggcatgaaattagaaggcgtggatcctgagcatcagtctgtgtactgtgtcctcaccgtcgcggaggtttgtggataccggataaagcttcactttgatgggtattctgattgctatgacttctgggtgaatgcagacgctctggatatccacccagttgggtggtgtgagaaaaccggccacaaactccatcctccaaaagggtataaagaagaagaattcaattggcagacctatcttaagacatgtaaagctcaagctgctcctaagtcattatttgaaaatcagaatataacagtgatcccatcgggctttcgagttggtatgaagcttgaggcagtagacaaaaagaatccctcattcatctgtgttgctacggtaacagatatggtggacaatcgtttcctggtacattttgacaactgggatgagagctatgactattggtgtgaagcatcaagtccacatattcatccagttggttggtgtaaggaacatagaagaacccttattactccaccaggttatccaaatgtgaaacatttttcttgggataaatacttagaagaaaccaattctttacctgctcctgcaagagctttcaaagtgaaacctcctcatggattccagaaaaaaatgaagcttgaggttgtagacaaaaggaaccctatgtttattagagtagcaactgtggcagacacagatgatcaccgggtaaaagttcactttgatggctggaacaattgctatgattactggatagatgcagattctcctgatattcaccctgtaggctggtgttcaaaaacaggacatccccttcagcctcctttgagccccttagaattaatggaagcttcagaacatggtggatgctcaaccccgggatgtaaagggattggccatttcaagagagcgagacatctgggccctcacagtgctgccaactgtccctattcagaaatcaatttgaataaagaccgtatttttccagaccgcttaagtggtgagatgcctccggctagtccgtcatttccaagaaataaaaggacagatgcaaatgaaagctcttcttcccctgaaatcagagaccagcatgctgatgatgtcaaagaagactttgaagagagaacagaaagtgaaatgagaacatcacatgaagccagaggtgcccgggaagaacccaccgtccagcaggcacagcgtcggtcagctgtctttctgtcctttaagtccccaattccatgtctgcccttgcgctgggagcagcaaagcaaacttcttccaactgtcgcaggaatccctgccagtaaagtttccaaatggagcacagacgaggtgtcagaatttatacagagcttacctgggtgtgaagaacatggaaaggtatttaaagatgaacaaattgatggagaagcatttctacttatgactcaaacagacattgttaaaattatgagcattaaactgggccctgctctcaaaattttcaattccatcctgatgttcaaagctgcagagaagaattctcacaatgaactttgaagatggtgaattctgaataccatcagcattctgctttaaagctcatgttttattcaaagcacaaggacggttataactcctaagtgagaagtctccaaaactcaaaagagcaacactatcggattatttatattactcaagagacaatatatatgaattcttatgaaagtgcttgagcttttaaccaggtactgtctaacaacagtcatcttttggttctgttcactgagctaaatttatctttgtaaatctttttgagtctggggggtggggggaaggggggcttcattaattatttatggtaatggggggcagagtaagaacttttggcattttgtaaacattgttgaattctctttcatgtacactgtttctttttcaatactttcagaaacctttttatataatcaaatttcaatttaaaccaaattagtcgaaacctggctaagtttagccagtaggactgttatctgtattgttaattttgtgccatattttgaattgcaacattatgctaagtataactttgcaagtcatgatattgcctaactgcttgtcataattgtcagggctgaatagttgtaagaatgacttttctttgaatcagtatttttccttttgcacgcattatgaaatgttaaacaaattacttttcaccagcatctttactataattaccaaaaacatgtatataaaagaatgaaattgaaaaataaaatatataaacataaataaattaggtagtgtattttgagtggcatcagtctcactcatcttggtgccccggtgtttacaagagccagatggtgtcagaggagtacgcagttgtatgcagttatggttggggggaatgtttgtgagggtcttgaactatttatgagatgatcttgagcttctaattttcattgatgaaattgtggtggtttacagagactaagagctcattctgtcaacagaaacactaatctgtacagagcgctgtctcaggtcatgcattgtcctccaaacccaaaggtttttttcagggttggctagagagcgagtattgtgattttgctgaaaagacaaggtgtgaaggagcaacttcagttgacacaaaatttgaaatgctcacagatcagggaggtgatttcccaaagtaattgcccaagaacctccgttttggaaggattcctttttctgtagaatactttgcctcgatatataagcatacagatgcactttaaatgaaaacccttgattataaattgatagctggtagtgtttcttttgcaagaatgcatttctaaggcaaaaggtaaattattttgtccgtcttttgatgtactttctgattccaggattggatatttattcaaggactattttaaaaatagaaagtaagtttgtagcatgctgtctgaattctggggtaagttccacctcttctttagttgctttcgttttttatgatgtaggacttcctttgatatccctgttggaagtccattagcagtcctttgcatttgccaattcaaggtaaaacagggtcagtgacatctgcagtgtcccagtcatttatttgcatgaatctgcttaaataagttttttgttgctgttttttcttttttatgttttgttcagaatttgtacattcaagttgtacttgttatatctgacatgaatgaaataaaatcttaattacag

SEQ ID NO: 1106 - DNA, 4148 bp, Homo sapiens
cacagcccgcagcgcgaccgtgagagaaagtttaaaagcgggcgtgttcctcccgggtccccgcggagggctgggggcgtcggtctgtccgtcgcgctcagagggaggtgggggtaactagccgctttccagggcgcggggaccgcggctctaccccacccttccacgggagacggaggttaaaaaataaatcatgactgaatctgcctctagcacaagtggtcaagagtttgatgtgttcagtgttatggactggaaagatggagtgggcacgttaccaggaagtgacttaaagtttcgggtaaatgagtttggagccctggaagttattacagatgagaatgagatggaaaatgttaaaaaagcaactgctaccaccacttggatggtaccaactgctcaagaagtcttttcagagaagactgggatgcctttcaggttgaaggatccagtgaaagtagaagggcttcagttctgtgagaactgttgtcagtatggcaacgtagatgagtgtctttctggaggaaactattgcagccagaattgtgctcggcacatcaaagataaagatcagaaggaagaaagggacgtagaagaagacaatgaggaagaagatcctaagtgtagtcggaagaaaaaaccaaaattatctctgaaagctgacaccaaggaggatggagaagagagagatgatgaaatggagaacaaacaagatgtaagaatcctgaggggttcgcagagagcacggaggaaaagacgaggggattcggctgtactaaagcagggtttgcctcctaaaggaaagaaagcgtggtgctgggcatcctacctggaagaggagaaagcggtggcagtgccggcgaagctgttcaaggagcatcaatcctttccatataacaaaaatggattcaaagttggcatgaaattagaaggcgtggatcctgagcatcagtctgtgtactgtgtcctcaccgtcgcggaggtttgtggataccggataaagcttcactttgatgggtattctgattgctatgacttctgggtgaatgcagacgctctggatatccacccagttgggtggtgtgagaaaaccggccacaaactccatcctccaaaagggtataaagaagaagaattcaattggcagacctatcttaagacatgtaaagctcaagctgctcctaagtcattatttgaaaatcagaatataacagtgatcccatcgggctttcgagttggtatgaagcttgaggcagtagacaaaaagaatccctcattcatctgtgttgctacggtaacagatatggtggacaatcgtttcctggtacattttgacaactgggatgagagctatgactattggtgtgaagcatcaagtccacatattcatccagttggttggtgtaaggaacatagaagaacccttattactccaccaggttatccaaatgtgaaacatttttcttgggataaatacttagaagaaaccaattctttacctgctcctgcaagagctttcaaagtgaaacctcctcatggattccagaaaaaaatgaagcttgaggttgtagacaaaaggaaccctatgtttattagagtagcaactgtggcagacacagatgatcaccgggtaaaagttcactttgatggctggaacaattgctatgattactggatagatgcagattctcctgatattcaccctgtaggctggtgttcaaaaacaggacatccccttcagcctcctttgagccccttagaattaatggaagcttcagaacatggtggatgctcaaccccgggatgtaaagggattggccatttcaagagagcgagacatctgggccctcacagtgctgccaactgtccctattcagaaatcaatttgaataaagaccgtatttttccagaccgcttaagtggtgagatgcctccggctagtccgtcatttccaagaaataaaaggacagatgcaaatgaaagctcttcttcccctgaaatcagagaccagcatgctgatgatgtcaaagaagactttgaagagagaacagaaagtgaaatgagaacatcacatgaagccagaggtgcccgggaagaacccaccgtccagcaggcacagcgtcggtcagctgtctttctgtcctttaagtccccaattccatgtctgcccttgcgctgggagcagcaaagcaaacttcttccaactgtcgcaggaatccctgccagtaaagtttccaaatggagcacagacgaggtgtcagaatttatacagagcttacctgggtgtgaagaacatggaaaggtatttaaagatgaacaaattgatggagaagcatttctacttatgactcaaacagacattgttaaaattatgagcattaaactgggccctgctctcaaaattttcaattccatcctgatgttcaaagctgcagagaagaattctcacaatgaactttgaagatggtgaattctgaataccatcagcattctgctttaaagctcatgttttattcaaagcacaaggacggttataactcctaagtgagaagtctccaaaactcaaaagagcaacactatcggattatttatattactcaagagacaatatatatgaattcttatgaaagtgcttgagcttttaaccaggtactgtctaacaacagtcatcttttggttctgttcactgagctaaatttatctttgtaaatctttttgagtctggggggtggggggaaggggggcttcattaattatttatggtaatggggggcagagtaagaacttttggcattttgtaaacattgttgaattctctttcatgtacactgtttctttttcaatactttcagaaacctttttatataatcaaatttcaatttaaaccaaattagtcgaaacctggctaagtttagccagtaggactgttatctgtattgttaattttgtgccatattttgaattgcaacattatgctaagtataactttgcaagtcatgatattgcctaactgcttgtcataattgtcagggctgaatagttgtaagaatgacttttctttgaatcagtatttttccttttgcacgcattatgaaatgttaaacaaattacttttcaccagcatctttactataattaccaaaaacatgtatataaaagaatgaaattgaaaaataaaatatataaacataaataaattaggtagtgtattttgagtggcatcagtctcactcatcttggtgccccggtgtttacaagagccagatggtgtcagaggagtacgcagttgtatgcagttatggttggggggaatgtttgtgagggtcttgaactatttatgagatgatcttgagcttctaattttcattgatgaaattgtggtggtttacagagactaagagctcattctgtcaacagaaacactaatctgtacagagcgctgtctcaggtcatgcattgtcctccaaacccaaaggtttttttcagggttggctagagagcgagtattgtgattttgctgaaaagacaaggtgtgaaggagcaacttcagttgacacaaaatttgaaatgctcacagatcagggaggtgatttcccaaagtaattgcccaagaacctccgttttggaaggattcctttttctgtagaatactttgcctcgatatataagcatacagatgcactttaaatgaaaacccttgattataaattgatagctggtagtgtttcttttgcaagaatgcatttctaaggcaaaaggtaaattattttgtccgtcttttgatgtactttctgattccaggattggatatttattcaaggactattttaaaaatagaaagtaagtttgtagcatgctgtctgaattctggggtaagttccacctcttctttagttgctttcgttttttatgatgtaggacttcctttgatatccctgttggaagtccattagcagtcctttgcatttgccaattcaaggtaaaacagggtcagtgacatctgcagtgtcccagtcatttatttgcatgaatctgcttaaataagttttttgttgctgttttttcttttttatgttttgttcagaatttgtacattcaagttgtacttgttatatctgacatgaatgaaataaaatcttaattacaga

SEQ ID NO: 1107 - DNA, 3243 bp, Homo sapiens
gtttaaaagcgggcgtgttcctcccgggtccccgcggagggctgggggcgtcggtctgtccgtcgcgctcagagggaggtgggggtaactagccgctttccagggcgcggggaccgcggctctaccccacccttccacgggagacggagaacccttaggagaaatcttgagagtggacagcaattgtgaagatcgccagagagttctgtgtttcatcaccgccgaaaggttaaaaaataaatcatgactgaatctgcctctagcacaagtggtcaagagtttgatgtgttcagtgttatggactggaaagatggagtgggcacgttaccaggaagtgacttaaagtttcgggtaaatgagtttggagccctggaagttattacagatgagaatgagatggaaaatgttaaaaaagcaactgctaccaccacttggatggtaccaactgctcaagaagtcttttcagagaagactgggatgcctttcaggttgaaggatccagtgaaagtagaagggcttcagttctgtgagaactgttgtcagtatggcaacgtagatgagtgtctttctggaggaaactattgcagccagaattgtgctcggcacatcaaagataaagatcagaaggaagaaagggacgtagaagaagacaatgaggaagaagatcctaagtgtagtcggaagaaaaaaccaaaattatctctgaaagctgacaccaaggaggatggagaagagagagatgatgaaatggagaacaaacaagatgtaagaatcctgaggggttcgcagagagcacggaggaaaagacgaggggattcggctgtactaaagcagggtttgcctcctaaaggaaagaaagcgtggtgctgggcatcctacctggaagaggagaaagcggtggcagtgccggcgaagctgttcaaggagcatcaatcctttccatataacaaaaatggattcaaagttggcatgaaattagaaggcgtggatcctgagcatcagtctgtgtactgtgtcctcaccgtcgcggaggtttgtggataccggataaagcttcactttgatgggtattctgattgctatgacttctgggtgaatgcagacgctctggatatccacccagttgggtggtgtgagaaaaccggccacaaactccatcctccaaaagggtataaagaagaagaattcaattggcagacctatcttaagacatgtaaagctcaagctgctcctaagtcattatttgaaaatcagaatataacagtgatcccatcgggctttcgagttggtatgaagcttgaggcagtagacaaaaagaatccctcattcatctgtgttgctacggtaacagatatggtggacaatcgtttcctggtacattttgacaactgggatgagagctatgactattggtgtgaagcatcaagtccacatattcatccagttggttggtgtaaggaacatagaagaacccttattactccaccaggttatccaaatgtgaaacatttttcttgggataaatacttagaagaaaccaattctttacctgctcctgcaagagctttcaaagtgaaacctcctcatggattccagaaaaaaatgaagcttgaggttgtagacaaaaggaaccctatgtttattagagtagcaactgtggcagacacagatgatcaccgggtaaaagttcactttgatggctggaacaattgctatgattactggatagatgcagattctcctgatattcaccctgtaggctggtgttcaaaaacaggacatccccttcagcctcctttgagccccttagaattaatggaagcttcagaacatggtggatgctcaaccccgggatgtaaagggattggccatttcaagagagcgagacatctgggccctcacagtgctgccaactgtccctattcagaaatcaatttgaataaagaccgtatttttccagaccgcttaagtggtgagatgcctccggctagtccgtcatttccaagaaataaaaggacagatgcaaatgaaagctcttcttcccctgaaatcagagaccagcatgctgatgatgtcaaagaagactttgaagagagaacagaaagtgaaatgagaacatcacatgaagccagaggtgcccgggaagaacccaccgtccagcaggcacagcgtcggtcagctgtctttctgtcctttaagtccccaattccatgtctgcccttgcgctgggagcagcaaagcaaacttcttccaactgtcgcaggaatccctgccagtaaagtttccaaatggagcacagacgaggtgtcagaatttatacagagcttacctgggtgtgaagaacatggaaaggtatttaaagatgaacaaattgatggagaagcatttctacttatgactcaaacagacattgttaaaattatgagcattaaactgggccctgctctcaaaattttcaattccatcctgatgttcaaagctgcagagaagaattctcacaatgaactttgaagatggtgaattctgaataccatcagcattctgctttaaagctcatgttttattcaaagcacaaggacggttataactcctaagtgagaagtctccaaaactcaaaagagcaacactatcggattatttatattactcaagagacaatatatatgaattcttatgaaagtgcttgagcttttaaccaggtactgtctaacaacagtcatcttttggttctgttcactgagctaaatttatctttgtaaatctttttgagtctggggggtggggggaaggggggcttcattaattatttatggtaatggggggcagagtaagaacttttggcattttgtaaacattgttgaattctctttcatgtacactgtttctttttcaatactttcagaaacctttttatataatcaaatttcaatttaaaccaaattagtcgaaacctggctaagtttagccagtaggactgttatctgtattgttaattttgtgccatattttgaattgcaacattatgctaagtataactttgcaagtcatgatattgcctaactgcttgtcataattgtcagggctgaatagttgtaagaatgacttttctttgaatcagtatttttccttttgcacgcattatgaaatgttaaacaaattacttttcaccagcatctttactataattaccaaaaacatgtatataaaagaatgaaattgaaaaataaaatatataaacataaa

SEQ ID NO: 1108 - DNA, 762 bp, Homo sapiens
cgcgcgccgcccctgcggccccctccgcccgtgtggcctttgtgccgggcgcgcaccggagagcgagcgagcgggcgggcgagcgcgagaagtacaaaacccttaggagaaatcttgagagtggacagcaattgtgaagatcgccagagagttctgtgtttcatcaccgccgaaaggttaaaaaataaatcatgactgaatctgcctctagcacaagtggtcaagagtttgatgtgttcagtgttatggactggaaagatggagtgggcacgttaccaggaagtgacttaaagtttcgggtaaatgagtttggagccctggaagttattacagatgagaatgagatggaaaatgttaaaaaagcaactgctaccaccacttggatggtaccaactgctcaagaagccccgacctctcccccgagctccaggcccgtatttccacctgcctactggacatctccacctggatgtcccacagtcttttcagagaagactgggatgcctttcaggttgaaggatccagtgaaagtagaagggcttcagttctgtgagaactgttgtcagtatggcaacgtagatgagtgtctttctggaggaaactattgcagccagaattgtgctcggcacatcaaagataaagatcagaaggaagaaagggacgtagaagaagacaatgaggaagaagatcctaagtgtagtcggaagaaaaaaccaaaattatctctgaaagctgacaccaaggaggatggagaagagagag

SEQ ID NO: 1109 - DNA, 4518 bp, Homo sapiens
gtactggcggctgttgtcacagatagtggcaccaaaggattctttgtagaaaactttgacagcagcctttaaagtcattattcctacaactctgaggcggtgaccgggctattgaaaagatgcacctgaaacaggatctgcgggcagctgcatttgccacccggctttattgctgctttccagcggcgaaggcgcagcagcagtaacagggaagccagagcgagcctccccggcagcggcggcggcggcggcggcaccggcaccagcgcagtttcccctctccccagccctgactctacgcgcacatgcgcattgcgcccgcagccctggaccatttgtcaggactactcgtgagacggagaaaaaaaaaagagaaaatttggggaacccttaggagaaatcttgagagtggacagcaattgtgaagatcgccagagagttctgtgtttcatcaccgccgaaaggttaaaaaataaatcatgactgaatctgcctctagcacaagtggtcaagagtttgatgtgttcagtgttatggactggaaagatggagtgggcacgttaccaggaagtgacttaaagtttcgggtaaatgagtttggagccctggaagttattacagatgagaatgagatggaaaatgttaaaaaagcaactgctaccaccacttggatggtaccaactgctcaagaagccccgacctctcccccgagctccaggcccgtatttccacctgcctactggacatctccacctggatgtcccacagtcttttcagagaagactgggatgcctttcaggttgaaggatccagtgaaagtagaagggcttcagttctgtgagaactgttgtcagtatggcaacgtagatgagtgtctttctggaggaaactattgcagccagaattgtgctcggcacatcaaagataaagatcagaaggaagaaagggacgtagaagaagacaatgaggaagaagatcctaagtgtagtcggaagaaaaaaccaaaattatctctgaaagctgacaccaaggaggatggagaagagagagatgatgaaatggagaacaaacaagatgtaagaatcctgaggggttcgcagagagcacggaggaaaagacgaggggattcggctgtactaaagcagggtttgcctcctaaaggaaagaaagcgtggtgctgggcatcctacctggaagaggagaaagcggtggcagtgccggcgaagctgttcaaggagcatcaatcctttccatataacaaaaatggattcaaagttggcatgaaattagaaggcgtggatcctgagcatcagtctgtgtactgtgtcctcaccgtcgcggaggtttgtggataccggataaagcttcactttgatgggtattctgattgctatgacttctgggtgaatgcagacgctctggatatccacccagttgggtggtgtgagaaaaccggccacaaactccatcctccaaaagggtataaagaagaagaattcaattggcagacctatcttaagacatgtaaagctcaagctgctcctaagtcattatttgaaaatcagaatataacagtgatcccatcgggctttcgagttggtatgaagcttgaggcagtagacaaaaagaatccctcattcatctgtgttgctacggtaacagatatggtggacaatcgtttcctggtacattttgacaactgggatgagagctatgactattggtgtgaagcatcaagtccacatattcatccagttggttggtgtaaggaacatagaagaacccttattactccaccaggttatccaaatgtgaaacatttttcttgggataaatacttagaagaaaccaattctttacctgctcctgcaagagctttcaaagtgaaacctcctcatggattccagaaaaaaatgaagcttgaggttgtagacaaaaggaaccctatgtttattagagtagcaactgtggcagacacagatgatcaccgggtaaaagttcactttgatggctggaacaattgctatgattactggatagatgcagattctcctgatattcaccctgtaggctggtgttcaaaaacaggacatccccttcagcctcctttgagccccttagaattaatggaagcttcagaacatggtggatgctcaaccccgggatgtaaagggattggccatttcaagagagcgagacatctgggccctcacagtgctgccaactgtccctattcagaaatcaatttgaataaagaccgtatttttccagaccgcttaagtggtgagatgcctccggctagtccgtcatttccaagaaataaaaggacagatgcaaatgaaagctcttcttcccctgaaatcagagaccagcatgctgatgatgtcaaagaagactttgaagagagaacagaaagtgaaatgagaacatcacatgaagccagaggtgcccgggaagaacccaccgtccagcaggcacagcgtcggtcagctgtctttctgtcctttaagtccccaattccatgtctgcccttgcgctgggagcagcaaagcaaacttcttccaactgtcgcaggaatccctgccagtaaagtttccaaatggagcacagacgaggtgtcagaatttatacagagcttacctgggtgtgaagaacatggaaaggtatttaaagatgaacaaattgatggagaagcatttctacttatgactcaaacagacattgttaaaattatgagcattaaactgggccctgctctcaaaattttcaattccatcctgatgttcaaagctgcagagaagaattctcacaatgaactttgaagatggtgaattctgaataccatcagcattctgctttaaagctcatgttttattcaaagcacaaggacggttataactcctaagtgagaagtctccaaaactcaaaagagcaacactatcggattatttatattactcaagagacaatatatatgaattcttatgaaagtgcttgagcttttaaccaggtactgtctaacaacagtcatcttttggttctgttcactgagctaaatttatctttgtaaatctttttgagtctggggggtggggggaaggggggcttcattaattatttatggtaatggggggcagagtaagaacttttggcattttgtaaacattgttgaattctctttcatgtacactgtttctttttcaatactttcagaaacctttttatataatcaaatttcaatttaaaccaaattagtcgaaacctggctaagtttagccagtaggactgttatctgtattgttaattttgtgccatattttgaattgcaacattatgctaagtataactttgcaagtcatgatattgcctaactgcttgtcataattgtcagggctgaatagttgtaagaatgacttttctttgaatcagtatttttccttttgcacgcattatgaaatgttaaacaaattacttttcaccagcatctttactataattaccaaaaacatgtatataaaagaatgaaattgaaaaataaaatatataaacataaataaattaggtagtgtattttgagtggcatcagtctcactcatcttggtgccccggtgtttacaagagccagatggtgtcagaggagtacgcagttgtatgcagttatggttggggggaatgtttgtgagggtcttgaactatttatgagatgatcttgagcttctaattttcattgatgaaattgtggtggtttacagagactaagagctcattctgtcaacagaaacactaatctgtacagagcgctgtctcaggtcatgcattgtcctccaaacccaaaggtttttttcagggttggctagagagcgagtattgtgattttgctgaaaagacaaggtgtgaaggagcaacttcagttgacacaaaatttgaaatgctcacagatcagggaggtgatttcccaaagtaattgcccaagaacctccgttttggaaggattcctttttctgtagaatactttgcctcgatatataagcatacagatgcactttaaatgaaaacccttgattataaattgatagctggtagtgtttcttttgcaagaatgcatttctaaggcaaaaggtaaattattttgtccgtcttttgatgtactttctgattccaggattggatatttattcaaggactattttaaaaatagaaagtaagtttgtagcatgctgtctgaattctggggtaagttccacctcttctttagttgctttcgttttttatgatgtaggacttcctttgatatccctgttggaagtccattagcagtcctttgcatttgccaattcaaggtaaaacagggtcagtgacatctgcagtgtcccagtcatttatttgcatgaatctgcttaaataagttttttgttgctgttttttcttttttatgttttgttcagaatttgtacattcaagttgtacttgttatatctgacatgaatgaaataaaatcttaattacagatgcttttta

SEQ ID NO: 1110 - DNA, 3165 bp, Homo sapiens
gcattgcgcccgcagccctggaccatttgtcaggactactcgtgagacggagaaaaaaaaaagagaaaatttggggaacccttaggagaaatcttgagagtggacagcaattgtgaagatcgccagagagttctgtgtttcatcaccgccgaaaggttaaaaaataaatcatgactgaatctgcctctagcacaagtggtcaagagtttgatgtgttcagtgttatggactggaaagatggagtgggcacgttaccaggaagtgacttaaagtttcgggtaaatgagtttggagccctggaagttattacagatgagaatgagatggaaaatgttaaaaaagcaactgctaccaccacttggatggtaccaactgctcaagaagtcttttcagagaagactgggatgcctttcaggttgaaggatccagtgaaagtagaagggcttcagttctgtgagaactgttgtcagtatggcaacgtagatgagtgtctttctggaggaaactattgcagccagaattgtgctcggcacatcaaagataaagatcagaaggaagaaagggacgtagaagaagacaatgaggaagaagatcctaagtgtagtcggaagaaaaaaccaaaattatctctgaaagctgacaccaaggaggatggagaagagagagatgatgaaatggagaacaaacaagatgtaagaatcctgaggggttcgcagagagcacggaggaaaagacgaggggattcggctgtactaaagcagggtttgcctcctaaaggaaagaaagcgtggtgctgggcatcctacctggaagaggagaaagcggtggcagtgccggcgaagctgttcaaggagcatcaatcctttccatataacaaaaatggattcaaagttggcatgaaattagaaggcgtggatcctgagcatcagtctgtgtactgtgtcctcaccgtcgcggaggtttgtggataccggataaagcttcactttgatgggtattctgattgctatgacttctgggtgaatgcagacgctctggatatccacccagttgggtggtgtgagaaaaccggccacaaactccatcctccaaaagggtataaagaagaagaattcaattggcagacctatcttaagacatgtaaagctcaagctgctcctaagtcattatttgaaaatcagaatataacagtgatcccatcgggctttcgagttggtatgaagcttgaggcagtagacaaaaagaatccctcattcatctgtgttgctacggtaacagatatggtggacaatcgtttcctggtacattttgacaactgggatgagagctatgactattggtgtgaagcatcaagtccacatattcatccagttggttggtgtaaggaacatagaagaacccttattactccaccaggttatccaaatgtgaaacatttttcttgggataaatacttagaagaaaccaattctttacctgctcctgcaagagctttcaaagtgaaacctcctcatggattccagaaaaaaatgaagcttgaggttgtagacaaaaggaaccctatgtttattagagtagcaactgtggcagacacagatgatcaccgggtaaaagttcactttgatggctggaacaattgctatgattactggatagatgcagattctcctgatattcaccctgtaggctggtgttcaaaaacaggacatccccttcagcctcctttgagccccttagaattaatggaagcttcagaacatggtggatgctcaaccccgggatgtaaagggattggccatttcaagagagcgagacatctgggccctcacagtgctgccaactgtccctattcagaaatcaatttgaataaagaccgtatttttccagaccgcttaagtggtgagatgcctccggctagtccgtcatttccaagaaataaaaggacagatgcaaatgaaagctcttcttcccctgaaatcagagaccagcatgctgatgatgtcaaagaagactttgaagagagaacagaaagtgaaatgagaacatcacatgaagccagaggtgcccgggaagaacccaccgtccagcaggcacagcgtcggtcagctgtctttctgtcctttaagtccccaattccatgtctgcccttgcgctgggagcagcaaagcaaacttcttccaactgtcgcaggaatccctgccagtaaagtttccaaatggagcacagacgaggtgtcagaatttatacagagcttacctgggtgtgaagaacatggaaaggtatttaaagatgaacaaattgatggagaagcatttctacttatgactcaaacagacattgttaaaattatgagcattaaactgggccctgctctcaaaattttcaattccatcctgatgttcaaagctgcagagaagaattctcacaatgaactttgaagatggtgaattctgaataccatcagcattctgctttaaagctcatgttttattcaaagcacaaggacggttataactcctaagtgagaagtctccaaaactcaaaagagcaacactatcggattatttatattactcaagagacaatatatatgaattcttatgaaagtgcttgagcttttaaccaggtactgtctaacaacagtcatcttttggttctgttcactgagctaaatttatctttgtaaatctttttgagtctggggggtggggggaaggggggcttcattaattatttatggtaatggggggcagagtaagaacttttggcattttgtaaacattgttgaattctctttcatgtacactgtttctttttcaatactttcagaaacctttttatataatcaaatttcaatttaaaccaaattagtcgaaacctggctaagtttagccagtaggactgttatctgtattgttaattttgtgccatattttgaattgcaacattatgctaagtataactttgcaagtcatgatattgcctaactgcttgtcataattgtcagggctgaatagttgtaagaatgacttttctttgaatcagtatttttccttttgcacgcattatgaaatgttaaacaaattacttttcaccagcatctttactataattaccaaaaacatgtatataaaagaatgaaattgaaaaataaaatatataaac

SEQ ID NO: 1111 - DNA, 3586 bp, Homo sapiens
gggcaccgcggggcagcggcgccgcagcctgggctggcggaacctcgcgctccgactcgccccccgcctgtagctcggtcggcgttgcgggcaggcgccgctccgctggggattgctatgctatgccttgtatgactaagacctcttaccaagaatacgtgtcagaccataaaaccactgccaaggagtgcgggggtggcaatgaaacagcccaacaggaaaaggaagcttaatatggattccaaagagcgtttggatcaggacggacgcttggagcaagctgaagaggaaaagaagcccaaggatagcacaacccctttgagtcacgtcccttcagcggctgcacagggagcatggtcttgggagtggtacttgaaagaacagaaggctgtcgcagcacctgttgagctgttttccaaggatcagtcctttccagagcatgaaaatggttttcagattggaatgagattagaaggcattgatccccgacatccatcggtattctgtgtgctttctgtagcggaggtttgtggttaccgtctaagacttcattttgatggttatttaagttgctatgatttttggaccaatgctggttcccctgacattcatccagtaggatggtgtgaaaagaccaaacatgaactgcacatccctaagggttatagaaaagataaatttgtttggatggattacttgaaggcctgcaaattgcaaaatgctccaaagaaattattcagaaacagaagtcctaatgggccaatgtctaaagaatttcaggttggaatgaagctggaggccgtggacaggaagaacccttccttggtgtgtgtggcgaccatagcagatattgttgaagatcgcttactagtgcattttgacaactgggatgatagttacgattactggtgcgatgttaatagcccttatgtccagccagttggttggtgtcaggagaatggaagaactctgatagcaccccaaggttatcccaatccagaaaatttttcctggacagaatacctggaagctactcaaaccaatgcagttcctgccaaagtttttaaaatgaggttgcctcatggttttctgccaaatatgaaacttgaagttgtggataaacggaaccccaggttaattcgtgttgctacgattgtagatgttgatgaccaaagagtaaaggttcattttgatggttgggaccataagtatgactactgggtggaggcagacagccctgatatccacccgatcggatggtgtgatgtcacagggcatccactggaagtgccacagcgaacgaatgacctgaagatccttccaggtcaagctgtctgtcctactcccgggtgccgaggaataggccatatccgtggtccacgttattcgggacatcacagtgcttttggctgcccgtattcagacatgaacttgaaaaaggaggcaacacttcacgatcgtttgagagaacaaacacaggcaaatttggaatcagactcttcacattcaaaatcaaaaagcctctgtagtttgaacttcaatggaaaacatgaaaaggtgaacagtcagcccagacttgtacagcaggcaaagtgtttgaaaatcaaaggaaaagaagatattgacttggataatctcttcagagtgcttgtgctgcatcccagaggtttggaatactcggtggagcaggcgcagcaggtgcttcaccagtcagtgtccatgtccacggtgtcagcccacccttttcgggaccttcccctcggcagggagcaacactgcaagttgcttccaggcgtggctgacatccgggccagccaagtggcacgttggactgtggatgaggtggctgagtttgtacagtctcttctgggctgtgaagagcatgccaagtgctttaagaaagagcagatcgatggcaaagccttcctgcttctgacacagacggacattgtcaaagtgatgaagatcaaactgggcccagcactgaagatttacaactctatcctgatgttcaggcattcccaggaactccctgaagaagatattgcctcaggccaagaagtcaggggatgaatgggctccctgaacttcctctggcaccaagacctgcgctctttcagcaataaaagtggagcacattaatttgatgtgaatgtccccatggccgtatccacactgaatctggactttttaaagtgtctgtgatttgtttacatgtttagaggattttgatgactggtccagtgccaatgactcagaggcttaggcccatctgtgggtttggtttacgaacattgttatctttggtgggatccgctcagctctgatttgtttgcaagacagaccaaagaagcccacacatccacctttattcttctccgtcaccagaaaagaaaccattttccatcttacaagcataacactctcaagtggtgaaatattagaaaagcagtgttcatgaatacatcgttaatgtttttaccagagcaacatcgagcttggctcagatctgccatggagcacagctagtctaagagctagaggcctggtgctttcaaaagacttcatgtgagatttttgtgtactttactcaggaaagtgtgaatctctaaaaaataataataataagcacatgttttcatgattcattaattctcctttttgttccattaaccatttcttggttgtgctcccaagctttcctggagcctccacaaaggagagtagccaggagtaatgagaggacggtcaggtgggcacttccaaaagctggagagacccttctgaggaccctccaccatcagcggggcctcaggggaccctgtcctaacactggtgtggctgctgggccagacgctcacctgcacagaactcctccctgctcccactctgaagggcgtttcagaattgactcatttccactgcagtctgccagaacccctgtaataaggagctgtgttatattacatctggggctgtgtgcatctttacaaatggagacacactattcaaagggaagatctctaaagtagggagcgtggtacttattctttgtttgaaacattccgatttgttgtcaggccttatttgttttttgtaagtgattgtatcggaggcttaagttgtgtggaatcagtcccacagtgttgaaagacaagtacctcttttctgacacttcttactacttttacaggtagtaacagctacaaatactctcccagaagtggagggacaccatttgtgggtggggagaaagagggagaggttctatgtccacttgcttcattaagaatgttaaggtttaagaaagttgattctgcttggagaatttctcaagctttacatttttttttcactgaagaaaataaacaaactctaagaggtgtgcatatataacatttctttagatctttacctaaaaggaattttaatatattattggttgatgtaaattttgtttctgtggagttttgtttgttttgctttttgtagactgccatgtgcaagtaaaattcctgcttctgccatgttaaaattttaatatattttaaatgataataaacagagaaaacaaaatttatacctc

SEQ ID NO: 1112 - DNA, 3546 bp, Homo sapiens
gtgctctgactttaggtcgggtggcttctggggccttctgaggaacatgcacaagctgctacagctactgattgctatgctatgccttgtatgactaagacctcttaccaagaatacgtgtcagaccataaaaccactgccaaggagtgcgggggtggcaatgaaacagcccaacaggaaaaggaagcttaatatggattccaaagagcgtttggatcaggacggacgcttggagcaagctgaagaggaaaagaagcccaaggatagcacaacccctttgagtcacgtcccttcagcggctgcacagggagcatggtcttgggagtggtacttgaaagaacagaaggctgtcgcagcacctgttgagctgttttccaaggatcagtcctttccagagcatgaaaatggttttcagattggaatgagattagaaggcattgatccccgacatccatcggtattctgtgtgctttctgtagcggaggtttgtggttaccgtctaagacttcattttgatggttatttaagttgctatgatttttggaccaatgctggttcccctgacattcatccagtaggatggtgtgaaaagaccaaacatgaactgcacatccctaagggttatagaaaagataaatttgtttggatggattacttgaaggcctgcaaattgcaaaatgctccaaagaaattattcagaaacagaagtcctaatgggccaatgtctaaagaatttcaggttggaatgaagctggaggccgtggacaggaagaacccttccttggtgtgtgtggcgaccatagcagatattgttgaagatcgcttactagtgcattttgacaactgggatgatagttacgattactggtgcgatgttaatagcccttatgtccagccagttggttggtgtcaggagaatggaagaactctgatagcaccccaaggttatcccaatccagaaaatttttcctggacagaatacctggaagctactcaaaccaatgcagttcctgccaaagtttttaaaatgaggttgcctcatggttttctgccaaatatgaaacttgaagttgtggataaacggaaccccaggttaattcgtgttgctacgattgtagatgttgatgaccaaagagtaaaggttcattttgatggttgggaccataagtatgactactgggtggaggcagacagccctgatatccacccgatcggatggtgtgatgtcacagggcatccactggaagtgccacagcgaacgaatgacctgaagatccttccaggtcaagctgtctgtcctactcccgggtgccgaggaataggccatatccgtggtccacgttattcgggacatcacagtgcttttggctgcccgtattcagacatgaacttgaaaaaggaggcaacacttcacgatcgtttgagagaacaaacacaggcaaatttggaatcagactcttcacattcaaaatcaaaaagcctctgtagtttgaacttcaatggaaaacatgaaaaggtgaacagtcagcccagacttgtacagcaggcaaagtgtttgaaaatcaaaggaaaagaagatattgacttggataatctcttcagagtgcttgtgctgcatcccagaggtttggaatactcggtggagcaggcgcagcaggtgcttcaccagtcagtgtccatgtccacggtgtcagcccacccttttcgggaccttcccctcggcagggagcaacactgcaagttgcttccaggcgtggctgacatccgggccagccaagtggcacgttggactgtggatgaggtggctgagtttgtacagtctcttctgggctgtgaagagcatgccaagtgctttaagaaagagcagatcgatggcaaagccttcctgcttctgacacagacggacattgtcaaagtgatgaagatcaaactgggcccagcactgaagatttacaactctatcctgatgttcaggcattcccaggaactccctgaagaagatattgcctcaggccaagaagtcaggggatgaatgggctccctgaacttcctctggcaccaagacctgcgctctttcagcaataaaagtggagcacattaatttgatgtgaatgtccccatggccgtatccacactgaatctggactttttaaagtgtctgtgatttgtttacatgtttagaggattttgatgactggtccagtgccaatgactcagaggcttaggcccatctgtgggtttggtttacgaacattgttatctttggtgggatccgctcagctctgatttgtttgcaagacagaccaaagaagcccacacatccacctttattcttctccgtcaccagaaaagaaaccattttccatcttacaagcataacactctcaagtggtgaaatattagaaaagcagtgttcatgaatacatcgttaatgtttttaccagagcaacatcgagcttggctcagatctgccatggagcacagctagtctaagagctagaggcctggtgctttcaaaagacttcatgtgagatttttgtgtactttactcaggaaagtgtgaatctctaaaaaataataataataagcacatgttttcatgattcattaattctcctttttgttccattaaccatttcttggttgtgctcccaagctttcctggagcctccacaaaggagagtagccaggagtaatgagaggacggtcaggtgggcacttccaaaagctggagagacccttctgaggaccctccaccatcagcggggcctcaggggaccctgtcctaacactggtgtggctgctgggccagacgctcacctgcacagaactcctccctgctcccactctgaagggcgtttcagaattgactcatttccactgcagtctgccagaacccctgtaataaggagctgtgttatattacatctggggctgtgtgcatctttacaaatggagacacactattcaaagggaagatctctaaagtagggagcgtggtacttattctttgtttgaaacattccgatttgttgtcaggccttatttgttttttgtaagtgattgtatcggaggcttaagttgtgtggaatcagtcccacagtgttgaaagacaagtacctcttttctgacacttcttactacttttacaggtagtaacagctacaaatactctcccagaagtggagggacaccatttgtgggtggggagaaagagggagaggttctatgtccacttgcttcattaagaatgttaaggtttaagaaagttgattctgcttggagaatttctcaagctttacatttttttttcactgaagaaaataaacaaactctaagaggtgtgcatatataacatttctttagatctttacctaaaaggaattttaatatattattggttgatgtaaattttgtttctgtggagttttgtttgttttgctttttgtagactgccatgtgcaagtaaaattcctgcttctgccatgttaaaattttaatatattttaaatgataataaacagagaaaacaaaatttatacctca

SEQ ID NO: 1113 - DNA, 2841 bp, Homo sapiens
ttgcaaaatgctccaaagaaattattcagaaacagaagtcctaatgggccaatgtctaaagaatttcaggttggaatgaagctggaggccgtggacaggaagaacccttccttggtgtgtgtggcgaccatagcagatattgttgaagatcgcttactagtgcattttgacaactgggatgatagttacgattactggtgcgatgttaatagcccttatgtccagccagttggttggtgtcaggagaatggaagaactctgatagcaccccaaggttatcccaatccagaaaatttttcctggacagaatacctggaagctactcaaaccaatgcagttcctgccaaagtttttaaaatgaggttgcctcatggttttctgccaaatatgaaacttgaagttgtggataaacggaaccccaggttaattcgtgttgctacgattgtagatgttgatgaccaaagagtaaaggttcattttgatggttgggaccataagtatgactactgggtggaggcagacagccctgatatccacccgatcggatggtgtgatgtcacagggcatccactggaagtgccacagcgaacgaatgacctgaagatccttccaggtcaagctgtctgtcctactcccgggtgccgaggaataggccatatccgtggtccacgttattcgggacatcacagtgcttttggctgcccgtattcagacatgaacttgaaaaaggaggcaacacttcacgatcgtttgagagaacaaacacaggcaaatttggaatcagactcttcacattcaaaatcaaaaagcctctgtagtttgaacttcaatggaaaacatgaaaaggtgaacagtcagcccagacttgtacagcaggcaaagtgtttgaaaatcaaaggaaaagaagatattgacttggataatctcttcagagaatactcggtggagcaggcgcagcaggtgcttcaccagtcagtgtccatgtccacggtgtcagcccacccttttcgggaccttcccctcggcagggagcaacactgcaagttgcttccaggcgtggctgacatccgggccagccaagtggcacgttggactgtggatgaggtggctgagtttgtacagtctcttctgggctgtgaagagcatgccaagtgctttaagaaagagcagatcgatggcaaagccttcctgcttctgacacagacggacattgtcaaagtgatgaagatcaaactgggcccagcactgaagatttacaactctatcctgatgttcaggcattcccaggaactccctgaagaagatattgcctcaggccaagaagtcaggggatgaatgggctccctgaacttcctctggcaccaagacctgcgctctttcagcaataaaagtggagcacattaatttgatgtgaatgtccccatggccgtatccacactgaatctggactttttaaagtgtctgtgatttgtttacatgtttagaggattttgatgactggtccagtgccaatgactcagaggcttaggcccatctgtgggtttggtttacgaacattgttatctttggtgggatccgctcagctctgatttgtttgcaagacagaccaaagaagcccacacatccacctttattcttctccgtcaccagaaaagaaaccattttccatcttacaagcataacactctcaagtggtgaaatattagaaaagcagtgttcatgaatacatcgttaatgtttttaccagagcaacatcgagcttggctcagatctgccatggagcacagctagtctaagagctagaggcctggtgctttcaaaagacttcatgtgagatttttgtgtactttactcaggaaagtgtgaatctctaaaaaataataataataagcacatgttttcatgattcattaattctcctttttgttccattaaccatttcttggttgtgctcccaagctttcctggagcctccacaaaggagagtagccaggagtaatgagaggacggtcaggtgggcacttccaaaagctggagagacccttctgaggaccctccaccatcagcggggcctcaggggaccctgtcctaacactggtgtggctgctgggccagacgctcacctgcacagaactcctccctgctcccactctgaagggcgtttcagaattgactcatttccactgcagtctgccagaacccctgtaataaggagctgtgttatattacatctggggctgtgtgcatctttacaaatggagacacactattcaaagggaagatctctaaagtagggagcgtggtacttattctttgtttgaaacattccgatttgttgtcaggccttatttgttttttgtaagtgattgtatcggaggcttaagttgtgtggaatcagtcccacagtgttgaaagacaagtacctcttttctgacacttcttactacttttacaggtagtaacagctacaaatactctcccagaagtggagggacaccatttgtgggtggggagaaagagggagaggttctatgtccacttgcttcattaagaatgttaaggtttaagaaagttgattctgcttggagaatttctcaagctttacatttttttttcactgaagaaaataaacaaactctaagaggtgtgcatatataacatttctttagatctttacctaaaaggaattttaatatattattggttgatgtaaattttgtttctgtggagttttgtttgttttgctttttgtagactgccatgtgcaagtaaaattcctgcttctgccatgttaaaattttaatatattttaaatgataataaacagagaaaacaaaattt

SEQ ID NO: 1114 - DNA, 2328 bp, Homo sapiens
gtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtcaggcaacgaactccctctggcagtggcttctactgctgacctgatacgctgtaagctcttggatgtaactggtggcttgggcactgatgaacttagactgctctatggcatggcattggtcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacgggaggctgtgctggatgcttttctggatgatggcttccttgtccccacatttgaacagttggcagctttgcagatagaatatgaagatggtcagactgaggtccagagaggggaaggtactgacccaaagtcacacaaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgacaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgt

SEQ ID NO: 1115 - DNA, 2261 bp, Homo sapiens
gtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgacaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgt

SEQ ID NO: 1116 - DNA, 2386 bp, Homo sapiens
gcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtcaggcaacgaactccctctggcagtggcttctactgctgacctgatacgctgtaagctcttggatgtaactggtggcttgggcactgatgaacttagactgctctatggcatggcattggtcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgacaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgta

SEQ ID NO: 1117 - DNA, 2439 bp, Homo sapiens
gtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtcaggcaacgaactccctctggcagtggcttctactgctgacctgatacgctgtaagctcttggatgtaactggtggcttgggcactgatgaacttagactgctctatggcatggcattggtcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagatggtcagactgaggtccagagaggggaaggtactgacccaaagtcacacaaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgacaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgta

SEQ ID NO: 1118 - DNA, 1082 bp, Homo sapiens
gctgcattacagacacagacctgcaaacatctatggttgtgacagagtttctttctgacacctgagtctttctcctgctgcacggaaagcttgctgggaggggcttggaatctggcatgaagccaaagggcatctctgagttgcagcatttaaatgatcccactcagagattcacacagaagactggacacaattccgaagagctgcccagaaggagagaacaatgtcatcactacccagtggcagacacctttcaccccagctacacaagagggggcagatgtgtgaggatcactgcagtccaggagttcgatgtttcagtgagctgtgattgcaccactgcatatcagcctgggtgacagagcaagaccctatctcaaaaatacagaaaaatcatcaaccacttgcagtcgtcgtagaaatcaatcattccctccagttatgtccctgacccacaggcttcatttgtgcaagtactggggctgtgctgtcagtaatgtgtgccgcttctgggaaggacgtccattgcccttgatgattgtggtaccatacacactgcctgtttccttgcctgttggttcgtgcgtgataatcacagggacaccgatcctcacttttgtcaaggacccacagctggaggtgaatttctacactgggatggatgaggactcagatattgctttccaattccgactgcactttggtcatcctgcaatcatgaacagttgtgtgtttggcatatggagatatgaggagaaatgctactatttaccctttgaagatggcaaaccatttgagctgtgcatctatgtgcgtcacaaggaatacaaggtaatggtaaatggccaacgcatttacaactttgcccatcgattcccgccagcatctgtgaagatgctgcaagtcttcagagatatctccctgaccagagtgcttatcagcgattgagggagatgatcagactcctcattgttgaggaatccctctttctacctgaccatgggattcccagagcctactaacagaataatccctcctcaccccttcccctacacttgatcattaaaacagcaccaaacttc

SEQ ID NO: 1119 - DNA, 777 bp, Homo sapiens
gctgcattacagacacagacctgcaaacatctatggttgtgacagagtttctttctgacacctgagtctttctcctgctgcacggaaagcttgctgggaggggcttggaatctggcatgaagccaaagggcatctctgagttgcagcatttaaatgatcccactcagagattcacacagaagactggacacaattccgaagagctgcccagaaggagagaacaatgtcatcactacccgtaccatacacactgcctgtttccttgcctgttggttcgtgcgtgataatcacagggacaccgatcctcacttttgtcaaggacccacagctggaggtgaatttctacactgggatggatgaggactcagatattgctttccaattccgactgcactttggtcatcctgcaatcatgaacagttgtgtgtttggcatatggagatatgaggagaaatgctactatttaccctttgaagatggcaaaccatttgagctgtgcatctatgtgcgtcacaaggaatacaaggtaatggtaaatggccaacgcatttacaactttgcccatcgattcccgccagcatctgtgaagatgctgcaagtcttcagagatatctccctgaccagagtgcttatcagcgattgagggagatgatcagactcctcattgttgaggaatccctctttctacctgaccatgggattcccagagcctactaacagaataatccctcctcaccccttcccctacacttgatcattaaaacagcaccaaacttc

SEQ ID NO: 1120 - DNA, 2792 bp, Homo sapiens
tctttcgcgggcacttcgaattctagtcccctccaggtgggtggtgaagccgcggagtgtgagaggcatctccgtgctcatccgtgaccccagctgtactccaagggaaggcatctccagggaagagcagcttggtcccgcaaaagctggactgaaagaaggactttgtgacttgggatgtgacgggcacggagatggagtggggggtggtggcagcgcaaggtgtgcaggtgacagcagggggacacccccaaggcaggagcccgggccgacggagaggacttaacgacactatcggaccctctgggaaaagaggggagacgtcgtgacccaggccccgccccaccttgccgcctcgtgcccggcgctaagacccagcgggcgcgccgcccgcccggggcccggccctgtccccttccgtccgcggggcagccagctcagctccggagagccggcggcgcggcgggcatggctcgggtggcgtgggggctgctgtggttgctgctgggcagcgccggggcgcagtacgagaagtacagcttccggggcttcccgcccgaggacctgatgccgctggccgcggcgtacgggcacgctctggagcagtacgagggagagagctggcgcgagagcgcgcgctacctggaggcggcgctgcggctgcaccggctcctgcgcgacagcgaggccttctgccacgccaactgcagcggccccgcgcccgcggccaagcccgatcccgacggcggccgcgcagacgagtgggcctgcgagctgcggctcttcggccgcgtcctggagcgagccgcctgcctgcggcgctgcaagcggacgctgcccgccttccaggtgccctacccgccgcggcagctgctgcgtgacttccagagccgcctgccctaccagtacctgcactacgcgctgttcaaggctaaccggctggagaaggcggtggcggcggcctacaccttcctccagaggaacccgaagcacgagctgaccgccaagtatctcaactactatcaggggatgctggacgtcgccgacgagtccctcacggacctagaggcccagccctacgaggccgtgttcctccgggctgtgaagctctacaacagcggggatttccgcagcagcacggaggacatggagcgggccttgtcagagtacctggcagtctttgcccggtgcctggccggctgtgaaggggcccatgagcaggtggacttcaaggacttctacccggccatagcagatctctttgcagagtccctgcagtgcaaggtggactgtgaggccaatttgacccccaatgtgggtggctacttcgtggacaagttcgtggccaccatgtaccactacctgcagtttgcctactataagttgaatgatgtgcgccaggctgcccgcagcgccgccagctacatgctcttcgaccccaaggacagcgtcatgcagcagaacctggtgtattaccggttccaccgggctcgctggggcctggaagaggaggacttccagccccgggaggaggccatgctctaccacaaccagaccgccgagctgcgggagctgctggagttcacccacatgtacctgcagtcagatgatgagatggagctggaggagacagaaccgcccctggagcctgaggatgccctatctgacgccgagtttgagggggagggtgactacgaggagggcatgtatgctgactggtggcaggagccggatgccaagggtgacgaggccgaggctgagccagagcctgaactcgcatgagaaggggacaccccacaccgctcaagcttgggaagcctggtgccgatggccccaccctcaccagcctgggcagcagcaagaactatttattaaaaacttaagatgggccaggtgcggtggctcacacctgtaatcccagcattttgggaggccaaggtgggtggatcacttgaggccaggagttcaagaccagcctggccaacatgatgagacctccgtctctactaaaatacataaattagccgggtgtggtggcaggcgcctgaaatcccagctactcaagaggctgaggcaggagaatcgcttgaacctgggaggcaaaggttgcagtgaactgagattgcgccaccgcactccagcctgggcgacagagcgagactccatctttaaaaaaaaacaagacgggccggcacggtggctcacgcctgtaatcccagcactgagaggccgatcacttgaggtcaggagttcaagaccagcctggccaacatggtgaaaccccatctctactaaaaaatacaaaaattagccaggcatggtggcacacacctgtaatcgtagctgaggcaggagaatcgcctgaacccaggaggcggagcttgcagtgagccgagatcgtgccactgcactccagcctgggcgacagagtgagactccatctcaaaaaaaaaaaaaaaaacttaagatggacacagctgactggacccccatcctgcctcacccatgggtgctgcaccccagacccatcctgccacttctatgtctctggaccacaggatggtggtggcattgcaggttggcaagtgggctgatggggtccgccctcctcactgctgagctcctcacctggacagtctcctggacaaggagtttccagctgctggctggagtctcaggccaaattgcagagggtcctccagggtcctgaagagcactggactaagagtctagtggttccagggccctgaccagtaggtgctcaataaatgtttgttgttgaatgagtcata

SEQ ID NO: 1121 - DNA, 2601 bp, Homo sapiens
gcttcctgggcttcccatctctggcgggaagcgctccccgacgcattctctacctaggggacacccccaaggcaggagcccgggccgacggagaggacttaacgacactatcggaccctctgggaaaagaggggagacgtcgtgacccaggccccgccccaccttgccgcctcgtgcccggcgctaagacccagcgggcgcgccgcccgcccggggcccggccctgtccccttccgtccgcggggcagccagctcagctccggagagccggcggcgcggcgggcatggctcgggtggcgtgggggctgctgtggttgctgctgggcagcgccggggcgcagtacgagaagtacagcttccggggcttcccgcccgaggacctgatgccgctggccgcggcgtacgggcacgctctggagcagtacgagggagagagctggcgcgagagcgcgcgctacctggaggcggcgctgcggctgcaccggctcctgcgcgacagcgaggccttctgccacgccaactgcagcggccccgcgcccgcggccaagcccgatcccgacggcggccgcgcagacgagtgggcctgcgagctgcggctcttcggccgcgtcctggagcgagccgcctgcctgcggcgctgcaagcggacgctgcccgccttccaggtgccctacccgccgcggcagctgctgcgtgacttccagagccgcctgccctaccagtacctgcactacgcgctgttcaaggctaaccggctggagaaggcggtggcggcggcctacaccttcctccagaggaacccgaagcacgagctgaccgccaagtatctcaactactatcaggggatgctggacgtcgccgacgagtccctcacggacctagaggcccagccctacgaggccgtgttcctccgggctgtgaagctctacaacagcggggatttccgcagcagcacggaggacatggagcgggccttgtcagagtacctggcagtctttgcccggtgcctggccggctgtgaaggggcccatgagcaggtggacttcaaggacttctacccggccatagcagatctctttgcagagtccctgcagtgcaaggtggactgtgaggccaatttgacccccaatgtgggtggctacttcgtggacaagttcgtggccaccatgtaccactacctgcagtttgcctactataagttgaatgatgtgcgccaggctgcccgcagcgccgccagctacatgctcttcgaccccaaggacagcgtcatgcagcagaacctggtgtattaccggttccaccgggctcgctggggcctggaagaggaggacttccagccccgggaggaggccatgctctaccacaaccagaccgccgagctgcgggagctgctggagttcacccacatgtacctgcagtcagatgatgagatggagctggaggagacagaaccgcccctggagcctgaggatgccctatctgacgccgagtttgagggggagggtgactacgaggagggcatgtatgctgactggtggcaggagccggatgccaagggtgacgaggccgaggctgagccagagcctgaactcgcatgagaaggggacaccccacaccgctcaagcttgggaagcctggtgccgatggccccaccctcaccagcctgggcagcagcaagaactatttattaaaaacttaagatgggccaggtgcggtggctcacacctgtaatcccagcattttgggaggccaaggtgggtggatcacttgaggccaggagttcaagaccagcctggccaacatgatgagacctccgtctctactaaaatacataaattagccgggtgtggtggcaggcgcctgaaatcccagctactcaagaggctgaggcaggagaatcgcttgaacctgggaggcaaaggttgcagtgaactgagattgcgccaccgcactccagcctgggcgacagagcgagactccatctttaaaaaaaaacaagacgggccggcacggtggctcacgcctgtaatcccagcactgagaggccgatcacttgaggtcaggagttcaagaccagcctggccaacatggtgaaaccccatctctactaaaaaatacaaaaattagccaggcatggtggcacacacctgtaatcgtagctgaggcaggagaatcgcctgaacccaggaggcggagcttgcagtgagccgagatcgtgccactgcactccagcctgggcgacagagtgagactccatctcaaaaaaaaaaaaaaaaacttaagatggacacagctgactggacccccatcctgcctcacccatgggtgctgcaccccagacccatcctgccacttctatgtctctggaccacaggatggtggtggcattgcaggttggcaagtgggctgatggggtccgccctcctcactgctgagctcctcacctggacagtctcctggacaaggagtttccagctgctggctggagtctcaggccaaattgcagagggtcctccagggtcctgaagagcactggactaagagtctagtggttccagggccctgaccagtaggtgctcaataaatgtttgttgttgaatg

SEQ ID NO: 1122 - DNA, 2284 bp, Homo sapiens
atggctcgggtggcgtgggggctgctgtggttgctgctgggcagcgccggggcgcagtacgagaagtacagcttccggggcttcccgcccgaggacctgatgccgctggccgcggcgtacgggcacgctctggagcagtacgagggagagagctggcgcgagagcgcgcgctacctggaggcggcgctgcggctgcaccggctcctgcgcgacagcgaggccttctgccacgccaactgcagcggccccgcgcccgcggccaagcccgatcccgacggcggccgcgcagacgagtgggcctgcgagctgcggctcttcggccgcgtcctggagcgagccgccttccaggtgccctacccgccgcggcagctgctgcgtgacttccagagccgcctgccctaccagtacctgcactacgcgctgttcaaggctaaccggctggagaaggcggtggcggcggcctacaccttcctccagaggaacccgaagcacgagctgaccgccaagtatctcaactactatcaggggatgctggacgtcgccgacgagtccctcacggacctagaggcccagccctacgaggccgtgttcctccgggctgtgaagctctacaacagcggggatttccgcagcagcacggaggacatggagcgggccttgtcagagtacctggcagtctttgcccggtgcctggccggctgtgaaggggcccatgagcaggtggacttcaaggacttctacccggccatagcagatctctttgcagagtccctgcagtgcaaggtggactgtgaggccaatttgacccccaatgtgggtggctacttcgtggacaagttcgtggccaccatgtaccactacctgcagtttgcctactataagttgaatgatgtgcgccaggctgcccgcagcgccgccagctacatgctcttcgaccccaaggacagcgtcatgcagcagaacctggtgtattaccggttccaccgggctcgctggggcctggaagaggaggacttccagccccgggaggaggccatgctctaccacaaccagaccgccgagctgcgggagctgctggagttcacccacatgtacctgcagtcagatgatgagatggagctggaggagacagaaccgcccctggagcctgaggatgccctatctgacgccgagtttgagggggagggtgactacgaggagggcatgtatgctgactggtggcaggagccggatgccaagggtgacgaggccgaggctgagccagagcctgaactcgcatgagaaggggacaccccacaccgctcaagcttgggaagcctggtgccgatggccccaccctcaccagcctgggcagcagcaagaactatttattaaaaacttaagatgggccaggtgcggtggctcacacctgtaatcccagcattttgggaggccaaggtgggtggatcacttgaggccaggagttcaagaccagcctggccaacatgatgagacctccgtctctactaaaatacataaattagccgggtgtggtggcaggcgcctgaaatcccagctactcaagaggctgaggcaggagaatcgcttgaacctgggaggcaaaggttgcagtgaactgagattgcgccaccgcactccagcctgggcgacagagcgagactccatctttaaaaaaaaacaagacgggccggcacggtggctcacgcctgtaatcccagcactgagaggccgatcacttgaggtcaggagttcaagaccagcctggccaacatggtgaaaccccatctctactaaaaaatacaaaaattagccaggcatggtggcacacacctgtaatcgtagctgaggcaggagaatcgcctgaacccaggaggcggagcttgcagtgagccgagatcgtgccactgcactccagcctgggcgacagagtgagactccatctcaaaaaaaaaaaaaaaaacttaagatggacacagctgactggacccccatcctgcctcacccatgggtgctgcaccccagacccatcctgccacttctatgtctctggaccacaggatggtggtggcattgcaggttggcaagtgggctgatggggtccgccctcctcactgctgagctcctcacctggacagtctcctggacaaggagtttccagctgctggctggagtctcaggccaaattgcagagggtcctccagggtcctgaagagcactggactaagagtctagtggttccagggccctgaccagtaggtgctcaataaatgtttgttgttgaatg

SEQ ID NO: 1123 - DNA, 1701 bp, Homo sapiens
agggaagatggcttcgtttcggaagctaacgctttctgaaaaagtgccgccaaatcatcccagtcggaaaaaggttaacttcctagatatgtctctagacgacattataatctataaagagttagaagggacaaatgctgaagaagaaaagaataaaagacagaaccatagtaaaaaggaatcgccttcaagacagcaatcaaaagctcatagacatcgccatcggagaggctactcaagatgcagaagcaactctgaggaaggaaatcatgataaaaaaccatcccaaaaaccttctggattcaagtctggacaacaccctttaaatgggcagcctttaattgagcaggagaagtgcagtgacaattatgaggcccaagcagagaagaatcaaggccagtcagaggggaaccagcatcaatcagaaggaaatccggacaaatcagaagaatcccagggccaaccagaagaaaatcatcattctgagcgatcccgaaaccacttagagagatctctttctcagtcagacagatctcaagggcagctaaagagacatcatccccaatatgagagatctcatggccaatacaagagatctcatggtcaatctgagagatctcatggccactcagagagatctcatggtcactcagagagatctcatggtcactcagagagatctcatggtcactcaaagagatctcgtagccagggagatcttgtggacactcagagtgatctcatagccactcagagagatctcatagccactcagaaagatctcatagccactcagagagatctcatagccactcagagagatctcatagtcactcagagagatctcgtggccactgagagagatctcataaatcagtcagggagatctcatggccaatcagaaagacatcagagatactcaacaggtaaaaatacaataactacttaatcatcagaacaatgtgttgaattctgtggaaatagaaaagcatatatctatattctaatggctaaatatgtatttgttgaaacatgtatattgggacaaagacataaatattagaatggaggtaatacatacatagtatcaatattgtttcaacttgatgtcctctaagctatcatccagttacccaagatgtcccattaagttgttcccggtaggtctgctttccctggaagagccgtatgtactcagcctttcctattgggccttccccacaattagaatattttgacttagtgtcctgtcccccttggacgttccaacttgacttagtgtccagtgccccttggacattccaacctggtaggtaagctaatctaacaactaactgccaaattgataatatataatctatgataatgaatatctcttttgtgtctccttcctaagccatcctcagagagtccttagcagacaaatggtagatgtatctttgggcagctgaacttttctgctttcctcaaatcagaccatatgagaggatatattctatgcatagatgtaatgctaaccttctgaatatattttgaatacatttatatattcactgttgccttataaaactgttagggtaggtctgtctaccctagcaaaagaaacacagaaatttaaatgtactgggagttatgttgttaaaaacacaagatatgttaactgcagtttgtttggttattcaataaaagttttagttttaa

SEQ ID NO: 1124 - DNA, 1606 bp, Homo sapiens
cctcggagtgtgtggcgccatgatgcagggaagatggcttcgtttcggaagctaacgctttctgaaaaagtgccgccaaatcatcccagtcggaaaaaggttaacttcctagatatgtctctagacgacattataatctataaagagttagaagggacaaatgctgaagaagaaaagaataaaagacagaaccatagtaaaaaggaatcgccttcaagacagcaatcaaaagctcatagacatcgccatcggagaggagaagtgcagtgacaattatgaggcccaagcagagaagaatcaaggccagtcagaggggaaccagcatcaatcagaaggaaatccggacaaatcagaagaatcccagggccaaccagaagaaaatcatcattctgagcgatcccgaaaccacttagagagatctctttctcagtcagacagatctcaagggcagctaaagagacatcatccccaatatgagagatctcatggccaatacaagagatctcatggtcaatctgagagatctcatggccactcagagagatctcatggtcactcagagagatctcatggtcactcagagagatctcatggtcactcaaagagatctcgtagccagggagatcttgtggacactcagagtgatctcatagccactcagagagatctcatagccactcagaaagatctcatagccactcagagagatctcatagccactcagagagatctcatagtcactcagagagatctcgtggccactgagagagatctcataaatcagtcagggagatctcatggccaatcagaaagacatcagagatactcaacaggtaaaaatacaataactacttaatcatcagaacaatgtgttgaattctgtggaaatagaaaagcatatatctatattctaatggctaaatatgtatttgttgaaacatgtatattgggacaaagacataaatattagaatggaggtaatacatacatagtatcaatattgtttcaacttgatgtcctctaagctatcatccagttacccaagatgtcccattaagttgttcccggtaggtctgctttccctggaagagccgtatgtactcagcctttcctattgggccttccccacaattagaatattttgacttagtgtcctgtcccccttggacgttccaacttgacttagtgtccagtgccccttggacattccaacctggtaggtaagctaatctaacaactaactgccaaattgataatatataatctatgataatgaatatctcttttgtgtctccttcctaagccatcctcagagagtccttagcagacaaatggtagatgtatctttgggcagctgaacttttctgctttcctcaaatcagaccatatgagaggatatattctatgcatagatgtaatgctaaccttctgaatatattttgaatacatttatatattcactgttgccttataaaactgttagggtaggtctgtctaccctagcaaaagaaacacagaaatttaaatgtactgggagttatgttgttaaaaacacaagatatgttaactgcagtttgtttggttattcaataaaagttttagtttt

SEQ ID NO: 1125 - DNA, 1606 bp, Homo sapiens; identical to SEQ ID NO: 1124

SEQ ID NO: 1126 - DNA, 2215 bp, Homo sapiens
gcttccttccggtcgttaacgcccacgggctcgcgcggcgccgcctcctgggctcagttaccgcggacgccagtgccgggctccaggagacgcagggcgacgccacacgccggggtggccgactgggtcagcgcgggctgcgcctcctcgccatgggccccctctcggcgcggctgctaatgcagcgcgggcgccccaagagcgaccggctggggaagatccggagtctggacctgtcaggattggagctgctttccgagcacctggaccccaaactcctgtgccgcctgacgcagctgcaggagcttgacctgtctaacaaccacctggagacgctgccggacaacctgggcctgtcccacctgcgtgtcctccgctgcgccaacaaccagctgggggatgttactgccttgtgccagttccccaagctcgaggaactcagcctggagggcaaccccttcctgacggtcaatgacaacctgaaagtctcctttctcctgcccacgctccgtaaggtcaatggcaaggatgcgtcctcaacttactctcaggtggagaacctgaatcgggagctgaccagcagggtcacagctcactgggagaagttcatggccacactgggtcctgaagaggaggctgagaaggcccaggcggactttgtgaagtcggctgtcagggatgtccgctacgggcccgagtccctcagcgagttcacccagtggcgggtgcggatgatctctgaggagctggtggccgccagtaggacccaggtgcaaaaggctaacagcccagagaagcccccagaagctggagctgcccacaagcccagggccagactggcggccttgaaacggccagacgacgtcccactcagcctctctcccagcaagcgggcgtgtgcctccccgtcggcccaggtggagggcagccctgtggcaggctccgatggcagccagcctgctgtgaagctggagcccctgcacttcctgcagtgccacagcaagaacaacagcccccaggacctcgagacccagctgtgggcctgtgccttcgagccggcctgggaggagggggccacatcccagaccgtggccacgtgcggcggggaggctgtgtgcgtaattgattgccagacgggcatcgtgctccacaagtacaaggcacccggcgaggagttcttttctgtggcctggaccgctctgatggtggtcacacaggctggccacaagaagcgctggagtgtgctggcggctgcaggcctacggggcctggtccggctgctgcacgtgcgtgccggcttctgctgcggggtcatccgagcccacaagaaggccatcgccaccctgtgcttcagccccgcccacgagacccatctcttcacggcctcctatgacaagcggatcatcctctgggacatcggggtgcccaaccaggactacgaattccaggccagccagctgctcacactggacaccacctctatccccctgcgcctctgccctgtcgcctcctgcccggacgcccgcctgctggccggctgcgagggcggctgctgctgctgggacgtgcggctggaccagccccaaaagaggagggtgtgtgaagtggaattcgtcttctctgagggctccgaggcatctggacggagagtggatgggctggcatttgtgaatgaggacatcgtggcctccaaggggagcggcctgggcaccatctgcctgtggagctggaggcagacgtgggggggccggggcagccagtccacggtggcagtggtggtcctggcgcggctgcaatggtcgtccaccgagttggcctacttctcgctcagcgcctgccctgataaggggattgtgctctgtggggatgaggagggcaacgtgtggctctacgacgtcagcaacatcctgaagcagccacccctgctgccggcagccctgcaggcccccacacagatcctgaagtggccccagccctgggcccttggccaggtggtgaccaagaccatggtgaacacagtggtggccaatgcctccttcacctacctcaccgccctgacggactccaacatcgtagccatctgggggaggatgtagcctcacaccatcgcaaaggaccagggacacagctaactaacttattcagctttgggccgatgggggtgggggggggtctttcagtgaatatttttattaaactctactgtggacaagaa

SEQ ID NO: 1127 - DNA, 3475 bp, Homo sapiens
agactgacgcagtcttcagcactgaccaggctctgttgggggtggtgccaccaaggccacgccccctgcgcctgctccggcggagtctggagagttgtcgtaggctctgagggcggagactcacgccgattctctctcagcgtagggctgtgagggcgcagtccaccgccaggagccttccggtttctgcgcggtgcgcgacctcgtcccgaagcctggggatacaccctctcgagagcccgctgtcgccctccgttaaggtcgaacccctcacagttgctgtgggcaactccagcccaacattccctcgctctggttctcgccccattgggaaactcggccccacgcttcccacttttctggatgaggtgtcccctttctccccactaaaatgtcaaataacctacggagggtcttcctgaaacccgcagaggaaaattcaggcaacgcctcgcgttgtgtttcaggctgcatgtaccaagtagttcagacgattggctcggatggaaaaaatcttctgcaattacttccaattcctaagtcttctggaaatcttataccactagttcaatcttcagtcatgtctgatgctttgaaagggaatacaggaaaaccagttcaagttacttttcagactcagatttccagctcttccacaagtgcatcagttcaattgcccatttttcagccagccagttcttcaaactattttcttacaagaacagtagatacatcagaaaaaggtagagttacttctgtgggaactggaaatttttcttcatcagtttctaaagttcagagtcatggtgtgaaaattgatggactcaccatgcaaacatttgctgttcctccctcaacacaaaaagactcatcttttattgtagttaatacccagagtcttccagtgactgtgaagtctccagttttgccttctgggcatcatttacagattccagcccatgctgaagtgaaatctgtaccagcgtcatcattgcctccttcagtgcagcaaaagatacttgcaactgccaccaccagtacctcaggaatggttgaggcctcccaaatgccaaccgttatttatgtatctcctgtaaatacagtgaaaaatgtagttaccaagaactttcaaaacatttacccaaaacctgttacagaaatagcaaagccagtaatactaaataccacacaaattccaaagaatgttgctacagagacacaattgaaaggtggtcagcattctcaagctgctccagtgaaatggattttccaagataatctacagccttttacgccatctcttgttcctgttaagtcttcaaataatgtggcttcaaagattttaaaaacttttgtagataggaaaaatttgggagataatactataaatatgccaccattgagtaccatcgatcctagtgggacgcgatccaaaaatatgcctattaaagataatgctttggttatgtttaatgggaaagtctatctgttggctaaaaaggggacagatgttctgccatcacaaattgaccaacagaattctgtttctcctgatactccagtaagaaaagacacgttacagacagtgagttcaagtccagtcacagaaatatccagagaggttgtaaatattgttttggctaaaagtaaatcttcccagatggagacaaaatcactttccaatacccagcttgcttccatggccaatctaagggcagagaagaataaagtggagaaaccatctccttctaccacaaatccacatatgaaccaatccagtaactacttaaaacagagtaagactttattcacaaatccaatctttccagttggatttagtacaggacacaatgcccccagaaaagtaacagccgtcatttatgctagaaaaggaagtgtcctccagagcatagagaaaataagttcctctgttgatgcaacaactgttacttcacaacagtgtgttttcagagaccaagaaccaaagatccataatgagatggcatcaacatcagataaaggtgcccaaggaagaaatgacaagaaagattctcaaggaagaagtaataaggcattacatctgaagagtgatgctgaatttaaaaagatatttggccttactaaggatttgagagtgtgccttactcgaattcctgaccatttgacctctggagaaggtttcgattcctttagcagtttggtaaagagtggtacttacaaagagacagagtttatggtgaaggaaggagagagaaaacagcagaattttgataagaaaagaaaagcaaaaactaataagaagatggatcacataaagaagagaaaaacagagaatgcttataacgcaatcataaatggggaagctaatgtcaccggttcccaactcctaagcagtattttaccaacttcagatgtgtcacaacataacattctcacgagtcacagcaaaaccagacaagaaaagagaactgagatggaatactatacccatgagaagcaagagaaaggcactttgaattcaaatgcagcttatgaacaaagtcatttcttcaataaaaattataccgaagatattttcccagtgacaccaccggagttagaagaaaccattcgagatgaaaaaataagaagacttaagcaggtgctgagagagaaagaagcagctcttgaagaaatgcgtaagaagatgcaccaaaaataaaatctcctgtaaagacttcagtgaaatagctgttttttaaaatatacttcagcattaataagttaattgtaggtgtgttctgaaagtgtctttgaatatgaagcttgttttttcatcagtcgattgtacaactttaaggaatacagaaaaggttgattcacatatgacttgtgaataatttacatggggtatctatacctttgtcttagatacctttttttggaaggataaattttatatttttctattattttaactagaattctccaagtttgaatatttgggcagggtttttgttattgtttgtatctttacctaaattgctcaggcattattccagcagtagatagtgactgtgtattactgaaattttacaattcaagagaggaaatcagctccaaacttagcttttccagtggatttgtatatgtacttgctttatctctttacccttaaaatgatgataccttgtattcaccattgttttttttaatgtcgtgaaataatatgtattatggcaacattatttaaacattcaaacatttctcaagaatgagcaacatttgtaactttacaatgtaattttatataatccaaaggtattttagaattcaggccatttgatgttttgtttgcttatagtgatgtgttcccaggcaaatgctgctttttttttttttgggactatgtacatacgttactgagattgtgtaaaaagtagatcctgaacagttatcacatttaatatttcttaaactgtaaaagtgtattttc

SEQ ID NO: 1128 - DNA, 1796 bp, Homo sapiens
ggagactcacgccgattctctctcagcgtagggctgtgagggcgcagtccaccgccaggagccttccggtttctgcgcggtgcgcgacctcgtcccgaagcctggggatacaccctctcgagagcccgctgtcgccctccgttaaggtcgaacccctcacagttgctgtgggcaactccagcccaacattccctcgctctggttctcgccccattgggaaactcggccccacgcttcccacttttctggatgaggtgtcccctttctccccactaaaatgtcaaataacctacggagggtcttcctgaaacccgcagaggaaaattcaggcaacgcctcgcgttgatccataatgagatggcatcaacatcagataaaggtgcccaaggaagaaatgacaagaaagattctcaaggaagaagtaataaggcattacatctgaagagtgatgctgaatttaaaaagatatttggccttactaaggatttgagagtgtgccttactcgaattcctgaccatttgacctctggagaaggtttcgattcctttagcagtttggtaaagagtggtacttacaaagagacagagtttatggtgaaggaaggagagagaaaacagcagaattttgataagaaaagaaaagcaaaaactaataagaagatggatcacataaagaagagaaaaacagagaatgcttataacgcaatcataaatggggaagctaatgtcaccggttcccaactcctaagcagtattttaccaacttcagatgtgtcacaacataacattctcacgagtcacagcaaaaccagacaagaaaagagaactgagatggaatactatacccatgagaagcaagagaaaggcactttgaattcaaatgcagcttatgaacaaagtcatttcttcaataaaaattataccgaagatattttcccagtgacaccaccggagttagaagaaaccattcgagatgaaaaaataagaagacttaagcaggtgctgagagagaaagaagcagctcttgaagaaatgcgtaagaagatgcaccaaaaataaaatctcctgtaaagacttcagtgaaatagctgttttttaaaatatacttcagcattaataagttaattgtaggtgtgttctgaaagtgtctttgaatatgaagcttgttttttcatcagtcgattgtacaactttaaggaatacagaaaaggttgattcacatatgacttgtgaataatttacatggggtatctatacctttgtcttagatacctttttttggaaggataaattttatatttttctattattttaactagaattctccaagtttgaatatttgggcagggtttttgttattgtttgtatctttacctaaattgctcaggcattattccagcagtagatagtgactgtgtattactgaaattttacaattcaagagaggaaatcagctccaaacttagcttttccagtggatttgtatatgtacttgctttatctctttacccttaaaatgatgataccttgtattcaccattgttttttttaatgtcgtgaaataatatgtattatggcaacattatttaaacattcaaacatttctcaagaatgagcaacatttgtaactttacaatgtaattttatataatccaaaggtattttagaattcaggccatttgatgttttgtttgcttatagtgatgtgttcccaggcaaatgctgctttttttttttttgggactatgtacatacgttactgagattgtgtaaaaagtagatcctgaacagttatc

SEQ ID NO: 1129 - DNA, 1912 bp, Homo sapiens
gttttgcagtctttcactttaaaaactcaaaatggaaaattatatactttattttaatatttacaaatatttacaaatatttatttttaaataaaatgtatataccatgtagtatgttgtatttatttactcaatgttcttttaagtgtttcaggctgcatgtaccaagtagttcagacgattggctcggatggaaaaaatcttctgcaattacttccaattcctaagtcttctggaaatcttataccactagttcaatcttcagtcatgtctgatgctttgaaagggaatacaggaaaaccagttcaagttacttttcagactcagatttccagctcttccacaagtgcatcagttcaattgcccatttttcagccagccagttcttcaaactattttcttacaagaacagtagatacatcagaaaaagatccataatgagatggcatcaacatcagataaaggtgcccaaggaagaaatgacaagaaagattctcaaggaagaagtaataaggcattacatctgaagagtgatgctgaatttaaaaagatatttggccttactaaggatttgagagtgtgccttactcgaattcctgaccatttgacctctggagaaggtttcgattcctttagcagtttggtaaagagtggtacttacaaagagacagagtttatggtgaaggaaggagagagaaaacagcagaattttgataagaaaagaaaagcaaaaactaataagaagatggatcacataaagaagagaaaaacagagaatgcttataacgcaatcataaatggggaagctaatgtcaccggttcccaactcctaagcagtattttaccaacttcagatgtgtcacaacataacattctcacgagtcacagcaaaaccagacaagaaaagagaactgagatggaatactatacccatgagaagcaagagaaaggcactttgaattcaaatgcagcttatgaacaaagtcatttcttcaataaaaattataccgaagatattttcccagtgacaccaccggagttagaagaaaccattcgagatgaaaaaataagaagacttaagcaggtgctgagagagaaagaagcagctcttgaagaaatgcgtaagaagatgcaccaaaaataaaatctcctgtaaagacttcagtgaaatagctgttttttaaaatatacttcagcattaataagttaattgtaggtgtgttctgaaagtgtctttgaatatgaagcttgttttttcatcagtcgattgtacaactttaaggaatacagaaaaggttgattcacatatgacttgtgaataatttacatggggtatctatacctttgtcttagatacctttttttggaaggataaattttatatttttctattattttaactagaattctccaagtttgaatatttgggcagggtttttgttattgtttgtatctttacctaaattgctcaggcattattccagcagtagatagtgactgtgtattactgaaattttacaattcaagagaggaaatcagctccaaacttagcttttccagtggatttgtatatgtacttgctttatctctttacccttaaaatgatgataccttgtattcaccattgttttttttaatgtcgtgaaataatatgtattatggcaacattatttaaacattcaaacatttctcaagaatgagcaacatttgtaactttacaatgtaattttatataatccaaaggtattttagaattcaggccatttgatgttttgtttgcttatagtgatgtgttcccaggcaaatgctgctttttttttttttgggactatgtacatacgttactgagattgtgtaaaaagtagatcctgaacagttatcacatttaatatttcttaaactgtaaaagtgt

SEQ ID NO: 1130 - DNA, 3459 bp, Homo sapiens
gaggcagcggcggcagcagccagggaggccggggctgcgcgcgggccgggggcgggggctgaggccgggcccggggcggcggggccggcgcctcggctctcctcctgctcctgcagcagcctctgctcccactgcggctgtggtccccctcggcgcagctctccgcgctgcgcgcccgctgagcccgaggttccccggcccatgtactggaagcatgagaacgccgccccggcgttgcccgagggctgccggctgccggccgagggcggccccgccaccgaccaggtgatggcccagccagggtccggctgcaaagcgaccacccgctgtcttgaagggaccgcgccgcccgccatggctcagtctgacgccgaggccctggcaggagctctggacaaggacgagggtcaggcctccccatgtacgcccagcacgccatctgtctgctcaccgccctctgccgcctcctccgtgccgtctgcaggcaagaacatctgctccagctgcggcctcgagatcctggaccgatatctgctcaaggtcaacaacctcatctggcacgtgcggtgcctcgagtgctccgtgtgtcgcacgtcgctgaggcagcagaacagctgctacatcaagaacaaggagatcttctgcaagatggactacttcagccgattcgggaccaagtgtgcccggtgcggccgacagatctacgccagcgactgggtgcggagagctcgcggcaacgcctaccacctggcctgcttcgcctgcttctcgtgcaagcgccagctgtccactggtgaggagttcggcctggtcgaggagaaggtgctctgccgcatccactacgacaccatgattgagaacctcaagagggccgccgagaacgggaacggcctcacgttggagggggcagtgccctcggaacaggacagtcaacccaagccggccaagcgcgcgcggacgtccttcaccgcggaacagctgcaggttatgcaggcgcagttcgcgcaggacaacaaccccgacgctcagacgctgcagaagctggcggacatgacgggcctcagccggagagtcatccaggtgtggtttcaaaactgccgggcgcgtcataaaaagcacacgccgcaacacccagtgccgccctcgggggcgcccccgtcccgccttccctccgccctgtccgacgacatccactacaccccgttcagcagccccgagcgggcgcgcatggtcaccctgcacggctacattgagagtcatcctttttcagtactaacgctgccggcacttccgcatctgcccgtgggcgccccacagctgcccctcagccgctgagatccagtgtccaagctgcggccaggagtccacccacctccgcatccacccccgtccgccatcctgcccaccaccaggtcggttcccgaggcctggcctttccctctcctgctgagaaccagaacccaccaggagcaccacagagtcctcctcttggaaggcagaactccctgaaatctggaatcagggtggaaacagcctgtttttcccatttaaacaggagtcctcttcaacttcagctgattacaataacaaaaggcggaattgaattgtgcgatgccaacggccttctcatttacaggtttttttcccccacattggcctttatttactacttccttggaaccatctctgaattctgaatagctgacaacccccaatgttatccactctgttgcttttgtctggaaaactctacagtgtttgtgggatgtccccaaaggaaagctatgttctaattttatcatttccatctgtctggttatgtcaagttaattcagaaagagaagagacagtgaccaaccctgagaggcctaatagggcagagatggaggcctgcccagactaggaggcagcggggatagacagggaatggggagaagaaagacccccattggtttggaaatcaaggagagggcggtgacatattggaccagaagaggcactagccattttaaggagaggaaagagaaaactctggggtcagggagagaccctacccccacctaattatccagcatatatgtaagaaacatagcagcgatggtattcgatctgtgccatgactcttctgaatgtttggacaggttagagttggggacccctgttggccacttgttgacctctcatagtggtgcttgggccaggtcttctcaatggaaggggaatcccttataggggagagggaacagagcccagtgaaatggcagtcagaatgttaaccctggatccatctctaagtagagagagggtgcccattgcctaggtgagtgtgccaagctcaggattccaactggtgcctctgagcttcccaatcaatacttcctggagccagccccacccacccctgagaacagaggtcagacacagctgcgtaacatccatcctgctacaactcttccaccccaaacaaaagggctcaggctacacacgaccatgatttatgttttcaggggatgcccatttgtcccaagcttatcctgtaattctagaattacctggtgtcctgatgcattttccactagaggttgctaatcagcatgttttagcccaagtccgccttcctgctgtggttaacctgttatgttgcttttggaaggagactctaagacagggaaagcaagttcatggtacatacgcagccattgtctctgtttttacccatggcagacattgctaatcaatggcagctctatttcactgagtctggataaggtttcagagttcaaatgcttgacgttggcacttaacatgaaagcctataggtcattcttgctctgggatctacaggcagggtaggcacaggtgcagcctaagaagggaacctgcttcctctcccttccaaagacagtgacagctgactgagggcaaagagcaggcaccactcagaacgtggtgagtacagctcagctcagcactcagtcagtggtaacttgtgcccagccctgtgctaggcgctgacattaacaggagcaaccagggcccaattcctggccttggagctcaaatctttcctttgatttttgctcctgatcatcaaggccccagtggcaaccatgtggtaagtggccaaccaagccctacccagggtcacccaacacactctgccttgagcctctcctcagggtctattccttgcgtggattatgtggccgtagcatgttacagttcaaacatgtctccactaccctgttaagagcagcctgggaacgtacaggccatcaagactatttatttaaatacaaaaaaaggggaaaacacacacacggaaaaaaaattgtaagcactttttttgtaaaaccaatgtctgttttgttacatacctttcatgtcgtgctttgtaaatgtcttatttgtgtaataaagttaatgcaagtagaagtgctggcactgaaatccagaaca

SEQ ID NO: 1131 - DNA, 3384 bp, Homo sapiens
gttcggcgccggtttatataacaggcgcggggaggcgctgggctcaggctgtgcggagccagttcagcagccgccgccgcctgcgttccctccccccctcccccaggtgatggcccagccagggtccggctgcaaagcgaccacccgctgtcttgaagggaccgcgccgcccgccatggctcagtctgacgccgaggccctggcaggagctctggacaaggacgagggtcaggcctccccatgtacgcccagcacgccatctgtctgctcaccgccctctgccgcctcctccgtgccgtctgcaggcaagaacatctgctccagctgcggcctcgagatcctggaccgatatctgctcaaggtcaacaacctcatctggcacgtgcggtgcctcgagtgctccgtgtgtcgcacgtcgctgaggcagcagaacagctgctacatcaagaacaaggagatcttctgcaagatggactacttcagccgattcgggaccaagtgtgcccggtgcggccgacagatctacgccagcgactgggtgcggagagctcgcggcaacgcctaccacctggcctgcttcgcctgcttctcgtgcaagcgccagctgtccactggtgaggagttcggcctggtcgaggagaaggtgctctgccgcatccactacgacaccatgattgagaacctcaagagggccgccgagaacgggaacggcctcacgttggagggggcagtgccctcggaacaggacagtcaacccaagccggccaagcgcgcgcggacgtccttcaccgcggaacagctgcaggttatgcaggcgcagttcgcgcaggacaacaaccccgacgctcagacgctgcagaagctggcggacatgacgggcctcagccggagagtcatccaggtgtggtttcaaaactgccgggcgcgtcataaaaagcacacgccgcaacacccagtgccgccctcgggggcgcccccgtcccgccttccctccgccctgtccgacgacatccactacaccccgttcagcagccccgagcgggcgcgcatggtcaccctgcacggctacattgagagtcaggtacagtgcgggcaggtgcactgccggctgccttacaccgcaccccccgtccacctcaaagccgatatggatgggccgctctccaaccggggtgagaaggtcatcctttttcagtactaacgctgccggcacttccgcatctgcccgtgggcgccccacagctgcccctcagccgctgagatccagtgtccaagctgcggccaggagtccacccacctccgcatccacccccgtccgccatcctgcccaccaccaggtcggttcccgaggcctggcctttccctctcctgctgagaaccagaacccaccaggagcaccacagagtcctcctcttggaaggcagaactccctgaaatctggaatcagggtggaaacagcctgtttttcccatttaaacaggagtcctcttcaacttcagctgattacaataacaaaaggcggaattgaattgtgcgatgccaacggccttctcatttacaggtttttttcccccacattggcctttatttactacttccttggaaccatctctgaattctgaatagctgacaacccccaatgttatccactctgttgcttttgtctggaaaactctacagtgtttgtgggatgtccccaaaggaaagctatgttctaattttatcatttccatctgtctggttatgtcaagttaattcagaaagagaagagacagtgaccaaccctgagaggcctaatagggcagagatggaggcctgcccagactaggaggcagcggggatagacagggaatggggagaagaaagacccccattggtttggaaatcaaggagagggcggtgacatattggaccagaagaggcactagccattttaaggagaggaaagagaaaactctggggtcagggagagaccctacccccacctaattatccagcatatatgtaagaaacatagcagcgatggtattcgatctgtgccatgactcttctgaatgtttggacaggttagagttggggacccctgttggccacttgttgacctctcatagtggtgcttgggccaggtcttctcaatggaaggggaatcccttataggggagagggaacagagcccagtgaaatggcagtcagaatgttaaccctggatccatctctaagtagagagagggtgcccattgcctaggtgagtgtgccaagctcaggattccaactggtgcctctgagcttcccaatcaatacttcctggagccagccccacccacccctgagaacagaggtcagacacagctgcgtaacatccatcctgctacaactcttccaccccaaacaaaagggctcaggctacacacgaccatgatttatgttttcaggggatgcccatttgtcccaagcttatcctgtaattctagaattacctggtgtcctgatgcattttccactagaggttgctaatcagcatgttttagcccaagtccgccttcctgctgtggttaacctgttatgttgcttttggaaggagactctaagacagggaaagcaagttcatggtacatacgcagccattgtctctgtttttacccatggcagacattgctaatcaatggcagctctatttcactgagtctggataaggtttcagagttcaaatgcttgacgttggcacttaacatgaaagcctataggtcattcttgctctgggatctacaggcagggtaggcacaggtgcagcctaagaagggaacctgcttcctctcccttccaaagacagtgacagctgactgagggcaaagagcaggcaccactcagaacgtggtgagtacagctcagctcagcactcagtcagtggtaacttgtgcccagccctgtgctaggcgctgacattaacaggagcaaccagggcccaattcctggccttggagctcaaatctttcctttgatttttgctcctgatcatcaaggccccagtggcaaccatgtggtaagtggccaaccaagccctacccagggtcacccaacacactctgccttgagcctctcctcagggtctattccttgcgtggattatgtggccgtagcatgttacagttcaaacatgtctccactaccctgttaagagcagcctgggaacgtacaggccatcaagactatttatttaaatacaaaaaaaggggaaaacacacacacggaaaaaaaattgtaagcactttttttgtaaaaccaatgtctgttttgttacatacctttcatgtcgtgctttgtaaatgtcttatttgtgtaataaagttaatgcaagtagaagtgctggcactgaaatccagaaca

SEQ ID NO: 1132 - DNA, 3466 bp, Homo sapiens
ctctcctcctgctcctgcagcagcctctgctcccactgcggctgtggtccccctcggcgcagctctccgcgctgcgcgcccgctgagcccgaggttccccggcccatgtactggaagcatgagaacgccgccccggcgttgcccgagggctgccggctgccggccgagggcggccccgccaccgaccaggtgatggcccagccagggtccggctgcaaagcgaccacccgctgtcttgaagggaccgcgccgcccgccatggctcagtctgacgccgaggccctggcaggagctctggacaaggacgagggtcaggcctccccatgtacgcccagcacgccatctgtctgctcaccgccctctgccgcctcctccgtgccgtctgcaggcaagaacatctgctccagctgcggcctcgagatcctggaccgatatctgctcaaggtcaacaacctcatctggcacgtgcggtgcctcgagtgctccgtgtgtcgcacgtcgctgaggcagcagaacagctgctacatcaagaacaaggagatcttctgcaagatggactacttcagccgattcgggaccaagtgtgcccggtgcggccgacagatctacgccagcgactgggtgcggagagctcgcggcaacgcctaccacctggcctgcttcgcctgcttctcgtgcaagcgccagctgtccactggtgaggagttcggcctggtcgaggagaaggtgctctgccgcatccactacgacaccatgattgagaacctcaagagggccgccgagaacgggaacggcctcacgttggagggggcagtgccctcggaacaggacagtcaacccaagccggccaagcgcgcgcggacgtccttcaccgcggaacagctgcaggttatgcaggcgcagttcgcgcaggacaacaaccccgacgctcagacgctgcagaagctggcggacatgacgggcctcagccggagagtcatccaggtgtggtttcaaaactgccgggcgcgtcataaaaagcacacgccgcaacacccagtgccgccctcgggggcgcccccgtcccgccttccctccgccctgtccgacgacatccactacaccccgttcagcagccccgagcgggcgcgcatggtcaccctgcacggctacattgagagtcaggtacagtgcgggcaggtgcactgccggctgccttacaccgcaccccccgtccacctcaaagccgatatggatgggccgctctccaaccggggtgagaaggtcatcctttttcagtactaacgctgccggcacttccgcatctgcccgtgggcgccccacagctgcccctcagccgctgagatccagtgtccaagctgcggccaggagtccacccacctccgcatccacccccgtccgccatcctgcccaccaccaggtcggttcccgaggcctggcctttccctctcctgctgagaaccagaacccaccaggagcaccacagagtcctcctcttggaaggcagaactccctgaaatctggaatcagggtggaaacagcctgtttttcccatttaaacaggagtcctcttcaacttcagctgattacaataacaaaaggcggaattgaattgtgcgatgccaacggccttctcatttacaggtttttttcccccacattggcctttatttactacttccttggaaccatctctgaattctgaatagctgacaacccccaatgttatccactctgttgcttttgtctggaaaactctacagtgtttgtgggatgtccccaaaggaaagctatgttctaattttatcatttccatctgtctggttatgtcaagttaattcagaaagagaagagacagtgaccaaccctgagaggcctaatagggcagagatggaggcctgcccagactaggaggcagcggggatagacagggaatggggagaagaaagacccccattggtttggaaatcaaggagagggcggtgacatattggaccagaagaggcactagccattttaaggagaggaaagagaaaactctggggtcagggagagaccctacccccacctaattatccagcatatatgtaagaaacatagcagcgatggtattcgatctgtgccatgactcttctgaatgtttggacaggttagagttggggacccctgttggccacttgttgacctctcatagtggtgcttgggccaggtcttctcaatggaaggggaatcccttataggggagagggaacagagcccagtgaaatggcagtcagaatgttaaccctggatccatctctaagtagagagagggtgcccattgcctaggtgagtgtgccaagctcaggattccaactggtgcctctgagcttcccaatcaatacttcctggagccagccccacccacccctgagaacagaggtcagacacagctgcgtaacatccatcctgctacaactcttccaccccaaacaaaagggctcaggctacacacgaccatgatttatgttttcaggggatgcccatttgtcccaagcttatcctgtaattctagaattacctggtgtcctgatgcattttccactagaggttgctaatcagcatgttttagcccaagtccgccttcctgctgtggttaacctgttatgttgcttttggaaggagactctaagacagggaaagcaagttcatggtacatacgcagccattgtctctgtttttacccatggcagacattgctaatcaatggcagctctatttcactgagtctggataaggtttcagagttcaaatgcttgacgttggcacttaacatgaaagcctataggtcattcttgctctgggatctacaggcagggtaggcacaggtgcagcctaagaagggaacctgcttcctctcccttccaaagacagtgacagctgactgagggcaaagagcaggcaccactcagaacgtggtgagtacagctcagctcagcactcagtcagtggtaacttgtgcccagccctgtgctaggcgctgacattaacaggagcaaccagggcccaattcctggccttggagctcaaatctttcctttgatttttgctcctgatcatcaaggccccagtggcaaccatgtggtaagtggccaaccaagccctacccagggtcacccaacacactctgccttgagcctctcctcagggtctattccttgcgtggattatgtggccgtagcatgttacagttcaaacatgtctccactaccctgttaagagcagcctgggaacgtacaggccatcaagactatttatttaaatacaaaaaaaggggaaaacacacacacggaaaaaaaattgtaagcactttttttgtaaaaccaatgtctgttttgttacatacctttcatgtcgtgctttgtaaatgtcttatttgtgtaataaagttaatgcaagtagaagtgctggcactgaaatccagaac

SEQ ID NO: 1133 - DNA, 2942 bp, Homo sapiens
agtaaagacacaggcgaatcaagaggaggcgaggccggtattgtccgtctgaataggcgctgatagcgccgatgcgccgggggttgtgccggcgcagcgctgagaatcccgacgcggggccggtgatggcccagccagggtccggctgcaaagcgaccacccgctgtcttgaagggaccgcgccgcccgccatggctcagtctgacgccgaggccctggcaggagctctggacaaggacgagggtcaggcctccccatgtacgcccagcacgccatctgtctgctcaccgccctctgccgcctcctccgtgccgtctgcaggcaagaacatctgctccagctgcggcctcgagatcctggaccgatatctgctcaaggtcaacaacctcatctggcacgtgcggtgcctcgagtgctccgtgtgtcgcacgtcgctgaggcagcagaacagctgctacatcaagaacaaggagatcttctgcaagatggactacttcagccgattcgggaccaagtgtgcccggtgcggccgacagatctacgccagcgactgggtgcggagagctcgcggcaacgcctaccacctggcctgcttcgcctgcttctcgtgcaagcgccagctgtccactggtgaggagttcggcctggtcgaggagaaggtgctctgccgcatccactacgacaccatgattgagaacctcaagagggccgccgagaacgggaacggcctcacgttggagggggcagtgccctcggaacaggacagtcaacccaagccggccaagcgcgcgcggacgtccttcaccgcggaacagctgcaggttatgcaggcgcagttcgcgcaggacaacaaccccgacgctcagacgctgcagaagctggcggacatgacgggcctcagccggagagtcatccaggtgtggtttcaaaactgccgggcgcgtcataaaaagcacacgccgcaacacccagtgccgccctcgggggcgcccccgtcccgccttccctccgccctgtccgacgacatccactacaccccgttcagcagccccgagcgggcgcgcatggtcaccctgcacggctacattgagagtcatcctttttcagtactaacgctgccggcacttccgcatctgcccgtgggcgccccacagctgcccctcagccgctgagatccagtgtccaagctgcggccaggagtccacccacctccgcatccacccccgtccgccatcctgcccaccaccaggtcggttcccgaggcctggcctttccctctcctgctgagaaccagaacccaccaggagcaccacagagtcctcctcttggaaggcagaactccctgaaatctggaatcagggtggaaacagcctgtttttcccatttaaacaggagtcctcttcaacttcagctgattacaataacaaaaggcggaattgaattgtgcgatgccaacggccttctcatttacaggtttttttcccccacattggcctttatttactacttccttggaaccatctctgaattctgaatagctgacaacccccaatgttatccactctgttgcttttgtctggaaaactctacagtgtttgtgggatgtccccaaaggaaagctatgttctaattttatcatttccatctgtctggttatgtcaagttaattcagaaagagaagagacagtgaccaaccctgagaggcctaatagggcagagatggaggcctgcccagactaggaggcagcggggatagacagggaatggggagaagaaagacccccattggtttggaaatcaaggagagggcggtgacatattggaccagaagaggcactagccattttaaggagaggaaagagaaaactctggggtcagggagagaccctacccccacctaattatccagcatatatgtaagaaacatagcagcgatggtattcgatctgtgccatgactcttctgaatgtttggacaggttagagttggggacccctgttggccacttgttgacctctcatagtggtgcttgggccaggtcttctcaatggaaggggaatcccttataggggagagggaacagagcccagtgaaatggcagtcagaatgttaaccctggatccatctctaagtagagagagggtgcccattgcctaggtgagtgtgccaagctcaggattccaactggtgcctctgagcttcccaatcaatacttcctggagccagccccacccacccctgagaacagaggtcagacacagctgcgtaacatccatcctgctacaactcttccaccccaaacaaaagggctcaggctacacacgaccatgatttatgttttcaggggatgcccatttgtcccaagcttatcctgtaattctagaattacctggtgtcctgatgcattttccactagaggttgctaatcagcatgttttagcccaagtccgccttcctgctgtggttaacctgttatgttgcttttggaaggagactctaagacagggaaagcaagttcatggtacatacgcagccattgtctctgtttttacccatggcagacattgctaatcaatggcagctctatttcactgagtctggataaggtttcagagttcaaatgcttgacgttggcacttaacatgaaagcctataggtcattcttgctctgggatctacaggcagggtaggcacaggtgcagcctaagaagggaacctgcttcctctcccttccaaagacagtgacagctgactgagggcaaagagcaggcaccactcagaacgtggtgagtacagctcagctcagcactcagtcagtggtaacttgtgcccagccctgtgctaggcgctgacattaacaggagcaaccagggcccaattcctggccttggagctcaaatctttcctttgatttttgctcctgatcatcaaggccccagtgg

SEQ ID NO: 1134 - DNA, 550 bp, Homo sapiens
aatcccttccaagagaattcagggaaactaccctcccgtttcacctcagtccctgggagctggtgcactgtctggttcttatagagcagaggtatctgtgcaggtgtgtgagagtaagtgtggtgcctcgtgcccgtgtaaatgatgtgaacaggtaatcacttacattagtgtgtacacaaatgtaccaggcatgggattgcatcaacacagtgtaataacgtgtgacctcctacggaatctatctccgcagatgcagcctctgctcccactgcggctgtggtccccctcggcgcagctctccgcgctgcgcgcccgctgagcccgaggttccccggcccatgtactggaagcatgagaacgccgccccggcgttgcccgagggctgccggctgccggccgagggcggccccgccaccgaccagttggaattgacactctggctacctcttatcttgggcattcacgacaatttctaattgcaggtgatggcccagccagggtccggctgcaaagcgaccacccgctgtcttgaagggaccgcgccgcc

SEQ ID NO: 1135 - DNA, 736 bp, Homo sapiens
tttagtaaagacacaggcgaatcaagaggaggcgaggccggtattgtccgtctgaataggcgctgatagcgccgatgcgccgggggttgtgccggcgcagcgctgagaatcccgacgcggggccggtacccggcgcgccgaggggctggagggtgctttttcctccccttgagcgcctctcttttctctttttggtcccgtttcgccccgatctcgctctctttttgctccgggtttccctccgactggccctcgaaaggcgcctgaatccgtgtcaatatagctgcttcaatttcgccgcgcgtgtcaggcgggcgggcgggcgggtgctcaccgcgctcggggttttcttttcttcaaccaccctccgcccctcacccatctcttttttattttctttctttctctcttttctcctttttgcattttgtgccgagaggagaagggagcgaggaaggggagtggggtgggggggcgggtggagagagaaaaaattcgatttttaattactaccattaaaaaatcaaatttgcaattctttgggcggcctgatggatctcactgattgacagttggaattgacactctggctacctcttatcttgggcattcacgacaatttctaattgcaggtgatggcccagccagggtccggctgcaaagcgaccacccgctgtcttgaagggaccgcgccgcccgccatggctcagtctgacgccgaggccctggcaggagc

SEQ ID NO: 1136 - DNA, 3587 bp, Homo sapiens
gatgtgtggctccctgggtgatcttgcaacacttaggcaggagtgacctcagaggcctgtgaatggagcacctttgtcaatatcaggtcactgcggtccctggccctcctgccttctgacaatgggagtggggagtaaagggttaactgcttcccctcgtgtttatgggggtgggggttcagtgagtgccctggaggctaaagttcctcttcccagctaggcccaaacgacttcatgcaagcccctagccttctctggccctccgccttgagcccaagctctgtcgcgggctccagcgggagaagcctaccccctcccgcaaagcgagggtcccaggggaagcgcagagcgggaagcggccccccaccgcggcagagagcggcccagcggcggccagctgttgggggacagatgttgggggagccgagaggggagctgggggaggagcctcggggccgggacctccgagaagcggtcgttttaacctcttaattgctggttctgggttttttttccccctctggcttcttcccctacgggtttacctagaagggaaggagcagagagaataggtagggccccacctccaacccaccttgttcgcctcacaggatctaaagccttcaagaaggtcttgaacctaaaataagtgaacctccgtttgagtttcggcctctcggctcaatagcttgccgattcgggaccaagtgtgcccggtgcggccgacagatctacgccagcgactgggtgcggagagctcgcggcaacgcctaccacctggcctgcttcgcctgcttctcgtgcaagcgccagctgtccactggtgaggagttcggcctggtcgaggagaaggtgctctgccgcatccactacgacaccatgattgagaacctcaagagggccgccgagaacgggaacggcctcacgttggagggggcagtgccctcggaacaggacagtcaacccaagccggccaagcgcgcgcggacgtccttcaccgcggaacagctgcaggttatgcaggcgcagttcgcgcaggacaacaaccccgacgctcagacgctgcagaagctggcggacatgacgggcctcagccggagagtcatccaggtgtggtttcaaaactgccgggcgcgtcataaaaagcacacgccgcaacacccagtgccgccctcgggggcgcccccgtcccgccttccctccgccctgtccgacgacatccactacaccccgttcagcagccccgagcgggcgcgcatggtcaccctgcacggctacattgagagtcaggtacagtgcgggcaggtgcactgccggctgccttacaccgcaccccccgtccacctcaaagccgatatggatgggccgctctccaaccggggtgagaaggtcatcctttttcagtactaacgctgccggcacttccgcatctgcccgtgggcgccccacagctgcccctcagccgctgagatccagtgtccaagctgcggccaggagtccacccacctccgcatccacccccgtccgccatcctgcccaccaccaggtcggttcccgaggcctggcctttccctctcctgctgagaaccagaacccaccaggagcaccacagagtcctcctcttggaaggcagaactccctgaaatctggaatcagggtggaaacagcctgtttttcccatttaaacaggagtcctcttcaacttcagctgattacaataacaaaaggcggaattgaattgtgcgatgccaacggccttctcatttacaggtttttttcccccacattggcctttatttactacttccttggaaccatctctgaattctgaatagctgacaacccccaatgttatccactctgttgcttttgtctggaaaactctacagtgtttgtgggatgtccccaaaggaaagctatgttctaattttatcatttccatctgtctggttatgtcaagttaattcagaaagagaagagacagtgaccaaccctgagaggcctaatagggcagagatggaggcctgcccagactaggaggcagcggggatagacagggaatggggagaagaaagacccccattggtttggaaatcaaggagagggcggtgacatattggaccagaagaggcactagccattttaaggagaggaaagagaaaactctggggtcagggagagaccctacccccacctaattatccagcatatatgtaagaaacatagcagcgatggtattcgatctgtgccatgactcttctgaatgtttggacaggttagagttggggacccctgttggccacttgttgacctctcatagtggtgcttgggccaggtcttctcaatggaaggggaatcccttataggggagagggaacagagcccagtgaaatggcagtcagaatgttaaccctggatccatctctaagtagagagagggtgcccattgcctaggtgagtgtgccaagctcaggattccaactggtgcctctgagcttcccaatcaatacttcctggagccagccccacccacccctgagaacagaggtcagacacagctgcgtaacatccatcctgctacaactcttccaccccaaacaaaagggctcaggctacacacgaccatgatttatgttttcaggggatgcccatttgtcccaagcttatcctgtaattctagaattacctggtgtcctgatgcattttccactagaggttgctaatcagcatgttttagcccaagtccgccttcctgctgtggttaacctgttatgttgcttttggaaggagactctaagacagggaaagcaagttcatggtacatacgcagccattgtctctgtttttacccatggcagacattgctaatcaatggcagctctatttcactgagtctggataaggtttcagagttcaaatgcttgacgttggcacttaacatgaaagcctataggtcattcttgctctgggatctacaggcagggtaggcacaggtgcagcctaagaagggaacctgcttcctctcccttccaaagacagtgacagctgactgagggcaaagagcaggcaccactcagaacgtggtgagtacagctcagctcagcactcagtcagtggtaacttgtgcccagccctgtgctaggcgctgacattaacaggagcaaccagggcccaattcctggccttggagctcaaatctttcctttgatttttgctcctgatcatcaaggccccagtggcaaccatgtggtaagtggccaaccaagccctacccagggtcacccaacacactctgccttgagcctctcctcagggtctattccttgcgtggattatgtggccgtagcatgttacagttcaaacatgtctccactaccctgttaagagcagcctgggaacgtacaggccatcaagactatttatttaaatacaaaaaaaggggaaaacacacacacggaaaaaaaattgtaagcactttttttgtaaaaccaatgtctgttttgttacatacctttcatgtcgtgctttgtaaatgtcttatttgtgtaataaagttaatgcaagtagaagtgctggcactgaaatcc

SEQ ID NO: 1137 - DNA, 850 bp, Homo sapiens
ggacagagcggcccggtcgccggcatggtttctccgtcctgctgcagccggcgggaggcagccagtccaggcgcccgctagcttcggcggcgacccagacggggaaagcggaaggaatgtcgcgtgcaagcaggcagctggtgtggaagaatggcggtgagccattcagtgaaggagcggaccatctctgagaacagcctgatcatcctactgcagggcctccagggccgggtaaccactgtggacctgcgggatgagagcgtggcccacggacgcatagacaatgtcgatgctttcatgaacatccgcctggccaaagtcacctacacggaccgttgggggcatcaggtcaagctggatgacctctttgtgacaggccgcaatgtccgctacgtccacatcccagatgacgtgaacatcacctcgaccattgagcagcagctgcagattatccatcgggtgcgaaactttggtggcaagggccaaggccggtgggaatttcccccaaaaaactgtaagtgaggccctcagcaagccctggccccaactcggagtcctccagtgatctccggagctagttccctgccctcacaccctgtctggtacccgagaagaaagcagggccaggccagaagctggtgtccaacagacaccacctgtcaaagctgcctttcacagggttccacctcccagactcactctgggacccagaatcctatatgtggccttggggtaggtgacaatccccctttttgatgatctgaatctctgacttattgattatggaacctgtcaagtagttttcaactctcccagtgaggataattaaacatgctcagcctgagccacc

SEQ ID NO: 1138 - DNA, 6584 bp, Homo sapiens
cctctggcggcttcgttccttcttcccatcggcctcggcttgcgggcctttcaaacatggaggagcgggagcggggggcgaggtcggctggcgccgggagccccgcgcgcccgcccagcccgcggctggatgtcagctctgacagcttcgacccgctgctggccctgtacgcgccccgcctgcctcccattccctaccccaatgccccctgcttcaacaacgtggcggagtacgagagcttcctcaggaccggagtccggggcggcgggcgcgggcgcgggcgggctcggggcgcggccgcgggctctggggttcccgccgcacccgggccctcgggcaggactcgtcgccgcccggacgcgcccgccccggaccccgagcgcatccagcgcctccgccgtctcatggtggccaaagaggaaggggacggggccgcaggagcgggccggaggggtccgggtcggagcaggaaggcgccacgcaacgtgctcacgcgaatgcccttgcacgaaggcagccctctgggtgaactccatcgctgtatccgtgagggggtgaaggtgaatgttcacatccgcactttcaagggacttcggggcgtctgtacaggcttccttgttgcattcgacaagttctggaatatggcacttactgatgtggatgagacctaccgaaaacctgtcctaggcaaagcatatgaacgggattcttcactgactctcactaggctatttgatcggctgaaacttcaagattcctccaagaaggaagcagattctaagtctgcagttgaagattccactctgtctagatactcacagacatccacttggaagttggcttcagtgtggggaagagcagacactggccggggctcacacaagcgttcccgctctgtcccttcttccctgcaggcctctgcaagggaggagtccaggtcagagctgtcagggaggactacacggacagacggctccagtgtgggaggtaccttttccagggctaccaccctttccagaggccagtcccgtaagaaaaagcgaaagcccaaagtggattaccagcaggtattcactcgacacataaatcagattttcattcgaggcgagaatgtcctgctggttcatcttgcacagtgaccagctcagcctgagctttggtttttagaaataaagtgcatgaattgctgctatgctgtatcctagtatcccagtgaaactctgagttggaatgattccctctggtcctgcatatgcagaggacggagcaggctcagccccctggaagatgagctcaaggggaggacaggccttgggagggcaggcgtttgcattaatatcaaggcaaaaagcattcatagatacatgcatctgatttggtattgtgatttacttcagaccctgaaaccaaatatctgatcttccattagacttaggggtcatgatatgagtggaatttacattttagatactataggggaaagaaaagtctcaaaaagaagtattgcatgtctaaaagctagtgccctgagtactcatgaattcgattccaagagtagtggtgtaaattgccttggagccctgcatccacgtcttgtaactaacttttgaattttgcctgacatgattctctcttgatgaagaaatgacatatattatctttgaatatctacaaggaaagttaccaacttatgtaggggtgaaatttggataggcggtatgctcaaagcagccagcaatgagtgctctgttttgatccttcttcttattatggaaaggagtacaggacctcttcagtcttccccttaccagaggtagcctctgcaaatggcataccagatgggactctaagatgcttgtgtggtggcttcttgtccttctctttgacttctgtggcatggtgctagtgcatgtaccctgtggtattgcccctctgtccgtagtgtgaactgtcctgtgagctttatgtcaggagactgtgaccttcatgtccagcttcaaagagttgtgcatgaactcggtaatacacatcacacggctgagagtcccctttccaggcagggccagcatgtgtagaatatctttcagaatatggtttcaccatgaaacaggggtggtagatttattcccttgtgtcaggccaaagaagttcttacaaagtacagtgggtagtgtctaaagcgacactttactcacagcctggcttgagtcaacaggaacaccatagcacccacaaatacttctacttgaatcatattctgtgctttttcaatcactagtgcagaataggctgcatttgacacagactgttaggcaatattgatttttttgttttgtttttatttggttttatctgagataacttatgttcaaggtgagaataagaaatagccaactagttaaaatgtatgaaaagaaaactttcccctgctgtatttgttgtgtaacataaataagccttctgagaagcagggtgaataaagtttagggagctgggacacctggtcctgctagctggaccactggctcatcatgcaatgaaaaggtgagcagacttaacccctccgtgcctcagctttttccccacagacacctacctcacaggggcattgagaaaaaaaaaatgaaggcattttacagtctctaaacatctttaagtgccatgagtaatttttcctgactctgtttcatagctttgtaagaattctgtgtctttataagacacagaagcaaggcaggtgctacataaaaaagtaatctcagccaggcacggtggctcacgcctgtaatcccagcactttgggaggctgaggcgggtggatcacaaggtcaggagatcaagaccatcctggctaacacggtgaaaccctgtctctactaaaaatacaaaaattagccgggcgtggtggcgggcgcctgtagtcccagctacgtgggtggctgaggcaggagaatggggtgaacccgggaggcggagcttgcagtgagccaagattgcaccactgtactccagcctgggcgacagagcaagactctgtctcaaaaaaaggaaaaaaaaaaaaagtaatcttagggttcatagttatgatcctgttgtaactatcttcggaaggcagcagtatcttctggaacttccatattccattccttcctcctaagggacaatggaagttctcagaagagtatcttcagtaagaggagagtaactttttttttgctgctcccgctatatcccaggcctcacccttttctgatcattatcagaaagaatcccctgaacttttcaaggggtttatatggtagcaccaaatggagaatgagcatctaaaaatgacacatcccgaaagggcaatctgtggaagtttgttgtttgtttgtttttatttttaaatgcattgtaaagtgtactctagagccagatcaggtgcactaaagtttatagaggttccagtttacaaactcaagtgaacagtaatctttggaagctgccagtctaaattctaaatagtgtatctgaaatctcagttcccaaaatagttgtcaggtttaatcatcaggcaacactgcgtatacctgtgtggctatcctcatctgcctgccctctcatccctcggctagaatgatgtactctactttcccaataaggtagaaatttggaatccaacggaatataatcagttttcattcattccagtgcctagttaaatctaacctgacttaaacatatgcctgtttttatgtttacctataattttcatatagccgtataaggattgatttaccattttttgcccaacatgacaattctggctatgaaaattatgtttaaactgtgtatgatctattttatgtgctctatgttcccatttgtttgtttggtctggacagtggttctggaatgaattctatctagtaaattagtaaatgtgctgttttgtataaagcatgataattactttttaacagaagttcatttttaaagattactcccttttctttctctcttttttttgagacaatttctctcttgttgcctaggcagtgcagtggcgcgatctcagctccctgcaacttctgcctcccaggttcaagcgattctcctgccttagcctcctgagtagctgggtcagccaccatggctgactcattttttgtatttttagtagagaaggggttttaccgtgttagccaggctggtcttgaactcctgaccttgggtgatccacctgcctcagcctcccaaagtgctgggattacaggcgtgagctatcccgcccggtccccttttctttattatcgaagatattgtttaaaagaaagaaaaagtaggtcccaataatatatgtgctattcaaaaaatgtgatcatttaggacattatcacaagttgctatggaaataactgaagacttcctcaggagaaggaaagaaaatgaggaacataatgatagagtcggggaactcccactagctcacctgaggggggctcgatgcagctgaaatactgaatactgaaatactagaaaccaacaaaactggtttctagaattctccagggatttgggcttgggaaacttggtaagaatagtttttatttttgaacattcaactttggttcttcaaagtaatctttaaacatgggaatatgttttcaagacaatttataggacatacttatgtagttggtgaggtcttctcaaaagtatctacctttgttagataataacaagtgattaagaaaggggagatatggttttatactcataacaatttcctgtgccattctctgtacacagaggtgattcatttactctcccattagtagaacttgcactttgggctgtctgttctagtatttgggaagtgtttatgcttccttccagggaccatcttatgatcagaggcaggatgtctgtgagatggttagctagagttagcagtgtccggggagagtggctttagaccagtcagtaccttgctctttgtgcatggtgcatgtcaagtcaggaagccaagaaaccgttggcattaaaatctagatgcatagagatccttgctatgagttgtggataggagtggctccatctatccttgtggtgaaagagtccaggagctcctttagagattgtcaagtcctgagcgatgagctgcccttaatcctcagaagccttacaaaaattgagatgtaccatttctaccctttgagaaaaaagaaatagaaacttacttgatgcagaatggatatttatatttctgcttgcaccatttccatagcagctgacaaaggcaaaatcatgaaatagaatcatttctataaattgcttctttaagttttctctaaattttgcctctaggaaaaaattaaaactattcaatgacagctagctgtcactggtgctaccccaaagctttccaatcttttatgtattttttgtgaatgaaactgttgctgtaggaaagtcaaggttcatgtaagagtatcgtggtgtaaatataatggtttcacagctgtttgaatttttcttttcctgtgccagatatagaatgcagtcaaccctttttcagtaacttatgttcaccagtctgtgcttttcttctcccagaaggcttttcttagtggttgtaaatgcaagaatcctgagccctgtgttgcaaaggtgggtggtctgtcagcactttctggcaaattgagttgatggatttaagataagcctttggggttcctgtcagttttctgggccctgaggaagggttgggcctcctttactctcagtattttgagtgtttttcaaatgtttgtacgttatcttgcactgctctaataaaaatgaaagctctctgacaagaaatagttctggatggtttgaagatctgcggggaaaaataagtgtgcacctgagaccttcagttagtcttttatttatttagaataaaaaatagtttgataacctaccagagttagtgcttctttaaaaacactccttggaaagatggggactgtcccttaggaaagccataaaagtgattcccaatactttgcaattgcttttgatttttagtcctttggaacaaatgtgtgatgttatgtctgatgttgtgtttttagagctgtgaaaagtctgaaaaatttcaaggggtattatttaaatgatgattatctggctgaattatgtgtgagctagaatctagggtagctgtccacttctttttctgttgtcctgacagtaaagcaaatagtaagccatgtcttgaaagtgatttgcttgtttcatactgacatctaaagacatcagccttctctttggcaaccctggggatactcctctgcaccataacttattaatgtttttttagacaaggctaaacctgaatgactctacgtatctatagtttcactgctcatataccagctgctacaagaaaaaccatgacttgtaagtttgtctttactcctaattgctaaattaactgaaacccttcctgtctagggagaattgctgctagtaaggtcagtttgcaatgttcagctttagatatgtgtcgtaatgggagtctgaaaactgtaataaactgtattcatatcctg

SEQ ID NO: 1139 - DNA, 1569 bp, Homo sapiens
cgcgctgggtggttcagaagcgaattctgcaccgcgaagcctgagaggcaggtagctgcggcgctgggctggcggcggcgagtccacgtgctccccgcggccggttgaaaccgttggcgggcgctggctgagaggcaatgtttgctgtcttccattggagtgactgaatttctacatgacggctttttgacaagacttaaaacctgtcttggatagagaatatttagccatttacctaaaaatggtattttttacatgcaatgcatgtggtgaatcagtgaagaaaatacaagtggaaaagcatgtgtctgtttgcagaaactgtgaatgcctttcttgcattgactgcggtaaagatttctggggcgatgactataaaaaccacgtgaaatgcataagtgaagatcagaagtatggtggcaaaggctatgaaggtaaaacccacaaaggcgacatcaaacagcaggcgtggattcagaaaattagtgaattaataaagagacccaatgtcagccccaaagtgagagaacttttagagcaaattagtgcttttgacaacgttcccaggaaaaaggcaaaatttcagaattggatgaagaacagtttaaaagttcataatgaatccattctggaccaggtgtggaatatcttttctgaagcttccaacagcgaaccagtcaataaggaacaggatcaacggccactccacccagtggcaaatccacatgcagaaatctccaccaaggttccagcctccaaagtgaaagacgccgtggaacagcaaggggaggtgaagaagaataaaagagaaagaaaggaagaacggcagaagaaaaggaaaagagaaaagaaagaactaaagttagaaaaccaccaggaaaactcaaggaatcagaagcctaagaagcgcaaaaagggacaggaggctgaccttgaggctggtggggaggaagtccctgaggccaatggctctgcagggaagaggagcaagaagaagaagcagcgcaaggacagcgccagtgaggaagaggcacacgtgggcgcagggaagaggaagcggaggcactcggaagttgaaacagattctaagaagaaaaagatgaagctcccagagcatcctgagggcggagaaccagaagacgatgaggctcctgcaaaaggtaaattcaactggaagggaactattaaagcaattctgaaacaggccccagacaatgaaataaccatcaaaaagctaaggaaaaaggttttagctcagtactacacagtgacagatgagcatcacagatccgaagaggaactcctggtcatctttaacaagaaaatcagcaagaaccctacctttaagttattaaaggacaaagtcaagcttgtgaaatgaacatttgtgtatttaaaaattgaatccattctgctgacttcttcctttcactgctgtttataaaatgtgtaatgaattctaacaactcaaattttgctttttgaagctgtatttttaagttaagaaaatatatttttggtataacttttatgagaaaaataaaatatattctggtccaaacttctaaa

SEQ ID NO: 1140 - DNA, 1468 bp, Homo sapiens
cccagaggtccgacctgggaggctggggctcagagagcaatgtttgctgtcttccattggagtgactgaatttctacatgacggctttttgacaagacttaaaacctgtcttggatagagaatatttagccatttacctaaaaatggtattttttacatgcaatgcatgtggtgaatcagtgaagaaaatacaagtggaaaagcatgtgtctgtttgcagaaactgtgaatgcctttcttgcattgactgcggtaaagatttctggggcgatgactataaaaaccacgtgaaatgcataagtgaagatcagaagtatggtggcaaaggctatgaaggtaaaacccacaaaggcgacatcaaacagcaggcgtggattcagaaaattagtgaattaataaagagacccaatgtcagccccaaagtgagagaacttttagagcaaattagtgcttttgacaacgttcccaggaaaaaggcaaaatttcagaattggatgaagaacagtttaaaagttcataatgaatccattctggaccaggtgtggaatatcttttctgaagcttccaacagcgaaccagtcaataaggaacaggatcaacggccactccacccagtggcaaatccacatgcagaaatctccaccaaggttccagcctccaaagtgaaagacgccgtggaacagcaaggggaggtgaagaagaataaaagagaaagaaaggaagaacggcagaagaaaaggaaaagagaaaagaaagaactaaagttagaaaaccaccaggaaaactcaaggaatcagaagcctaagaagcgcaaaaagggacaggaggctgaccttgaggctggtggggaggaagtccctgaggccaatggctctgcagggaagaggagcaagaagaagaagcagcgcaaggacagcgccagtgaggaagaggcacacgtgggcgcagggaagaggaagcggaggcactcggaagttgaaacagattctaagaagaaaaagatgaagctcccagagcatcctgagggcggagaaccagaagacgatgaggctcctgcaaaaggtaaattcaactggaagggaactattaaagcaattctgaaacaggccccagacaatgaaataaccatcaaaaagctaaggaaaaaggttttagctcagtactacacagtgacagatgagcatcacagatccgaagaggaactcctggtcatctttaacaagaaaatcagcaagaaccctacctttaagttattaaaggacaaagtcaagcttgtgaaatgaacatttgtgtatttaaaaattgaatccattctgctgacttcttcctttcactgctgtttataaaatgtgtaatgaattctaacaactcaaattttgctttttgaagctgtatttttaagttaagaaaatatatttttggtataacttttatgagaaaaataaaatatattctggtccaaacttct

SEQ ID NO: 1141 - DNA, 780 bp, Homo sapiens
gaggtgaggggtggtggcccagaggtccgacctgggaggctggggctcagagagtgagtaggggagggacgggatttccaccgtcagcccctctgggttacgcatggaggaaggagttccattcagatctcactcctgctctggggaagtggcaggagtcctggacttagggtgaccaactcgttttagttttaaaacttaaggtccggcgtcctgggaactccctcgggcctggccaaaccaggacgattggtcaccgcccgactgggcttcaggcttgctgcatgttggagacagggctcttctctgagccttgggagatcagtccctaaagaggaggccttaggatgtagcggtccagagcacatacttaggatcagaataactactgcgtgtgaatctgggttgccactacctggatgtgggatgacctggtgcaatgtttgctgtcttccattggagtgactgaatttctacatgacggctttttgacaagacttaaaacctgtcttggatagagaatatttagccatttacctaaaaatggtattttttacatgcaatgcatgtggtgaatcagtgaagaaaatacaagtggaaaagcatgtgtctgtttgcagaaactgtgaatgcctttcttgcattgactgcggtaaagatttctggggcgatgactataaaaaccacgtgaaatgcataagtgaagatcagaagtatggtggcaaaggctatgaaggtaaaacccacaaaggcgacatcaaacagcaggcgtggattcag

SEQ ID NO: 1142 - DNA, 3629 bp, Homo sapiens
gttgcaaagcatttctgggagctgcatgtgggtgacgcagcagcattgttcgcaggcacaggaagccgcggctgagctgaagggctcgagaaggagcccagagcgctgcacgctgctccctctgggtagtctgaagggtcagagctggactgccctgccctatgtgctctgggagattccagaatattcaagtaaatccggattttcccagaggcagaatatctaactccttcaggagaacttccagtacagaaaacaaaacaaagacgctggggaaacttcaccaagagcctcggcagctccagagcgacgggaaacgaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcctgtcccttgagcccttcctctacaggtggggcagagagggtggtggacaccaggcttatctgcctgctcctctccctcctaaggaaaagggagtagcagattgatctgaggggaaagcacaggctgtgctgtcgaggcgcctgctcgcttactcgcctgccaggaggccgggctctcagtttggggtgtttgtgcaaccttcatctgcactgggccctgtgcccctcctccccatccatggtccccagcagtgcctggttctgagcaaactcccagggaagaaaacggccctgtctccatggccaggttcttgtggtgtccagtgcgcgtctctcctccatcacactctcccggcttgcgcaggaggggccagcagccccaggagtcccagacccgtgccgatcacactggtgctgttgagatctcccaaacctcacgtccttaactgtgctctccctcctttcctctcccttgagcttggttctgcccagcactcgtgcttgttcacataattaggtttcccaccccagcctacccgacttacttgctagtctctatgaggtccttattgcacttattggggttgaagctcttcagaggagctggaactgtctaccccagggacacacccatttcgttgctacccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcacttt

SEQ ID NO: 1143 - DNA, 6511 bp, Homo sapiens
gagtctgacgggttcaaaatggcggcggctgcttcagcggctcctcctgtgtgagggaaacaacacccctccccggcagcggcggcggcggcggcggctctcggagcaccttcccagcggctgggcccgtggccgctctgtctttcctgggcaggggacgctccgggaggaggggcaacgccagggggcccatcccccggaatccctcttctgcgactggggagtagccggggggctcgtcccgcagcgcggagccagacctgagggggagacgcgaggggagccagggcccccatcccggcgcgccgcgccgctcccgccctgtccgccccccggggccggggcccgcgttccggggggccggggcggcgcggggagcctcgggccggccggtctcagctgatcggccgctgctcccgcaggcgaccagcccctgctggccgagggcacggcgaggagggcgctccctgcggccggggccggcccggggctcgggcccgggctgctgaccgctggcctgggggaggcgggggcgccccgggctcggcgccgaggggtcgcgctcctctctcctgacgcctccgactcccggtctccaaagccagaagagaaggtttgattcagcaactgtttgctcccttttcctggtcgctctgaccctctctggatactgggttgatccacggaaaaaccgaagacgacgtttgggatttaattattcctctcagctttggaatcttttacttctcacttggacaagaactcaagagcagaatctccgtgttgcaatctggttcctaaggaggaagaggaaggcagccctggagtggtttctttacagtaatttcaacagaagagtgagagatggaacccgaagaagaaaggattcgttacagccagagattgcgtggtaccatgcgacgacgctatgaagatgatggcatttcagatgatgaaattgaaggaaaaagaacttttgacttggaagagaaactgcacaccaacaaatataatgccaattttgttacttttatggaaggaaaagattttaatgtagagtatattcagcggggtggcttgagagatcctctgattttcaagaattctgatggactcggaataaaaatgccggatccagacttcactgtgaatgatgtcaaaatgtgtgtggggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggtggatttcattgactgggtagacaacatgtggccaaggcacttgaaggaaagccagactgaatcaacaaatgccatcttggagatgcagtaccctaaagtgcagaagtactgtctaatgagtgttcgaggctgctatactgacttccatgtggactttggtggtacctctgtttggtatcacatccatcaagggggaaaggtcttctggctcatcccccctacagcccacaacctggagctgtacgagaattggctgctgtcagggaaacagggagacatctttctgggtgaccgggtatcagattgtcagcgcattgagctcaagcagggctataccttcgtcattccctcaggctggattcatgctgtgtatactcctacagacacattagtgtttgggggcaattttttgcatagcttcaacatccctatgcagttaaaaatatacaacattgaagatcggacacgggttccaaataagtttcgctatccattctactatgagatgtgttggtatgtgttggagcgctatgtgtactgcataaccaaccgttcccacctaactaaggaatttcagaaagagtccctcagcatggatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcctgtcccttgagcccttcctctacaggtggggcagagagggtggtggacaccaggcttatctgcctgctcctctccctcctaaggaaaagggagtagcagattgatctgaggggaaagcacaggctgtgctgtcgaggcgcctgctcgcttactcgcctgccaggaggccgggctctcagtttggggtgtttgtgcaaccttcatctgcactgggccctgtgcccctcctccccatccatggtccccagcagtgcctggttctgagcaaactcccagggaagaaaacggccctgtctccatggccaggttcttgtggtgtccagtgcgcgtctctcctccatcacactctcccggcttgcgcaggaggggccagcagccccaggagtcccagacccgtgccgatcacactggtgctgttgagatctcccaaacctcacgtccttaactgtgctctccctcctttcctctcccttgagcttggttctgcccagcactcgtgcttgttcacataattaggtttcccaccccagcctacccgacttacttgctagtctctatgaggtccttattgcacttattggggttgaagctcttcagaggagctggaactgtctaccccagggacacacccatttcgttgctacccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaagaaagaaagaaaggtcggaatttcttttgggtcaatatttttaagtgtgtgaggagatgctcagtagcagcagcctatggcaagagcttataaatgattgatgcaaatttgcactctgctccccctctgtaaggatactgatagcacaacctcttccccccaccccgccccgccttttggtcgtccatccctgtccctttctggccctcttcctgtagcccagtctcaggctttcctcttcctgaagccctacagagttagggaatggagcccaggcaccaggggtctaaagtgtgagccactgagaagagagacgccaactgcacccttgccacttccaaagcaatagaggcagagtggtcccctctttgccacctaggccagttttgaccctggcattaactggccttagaagaaactggatcctggtagggggtggcattttgtttgtttcttccaatctgctgaatcttttgactgcaccttacaaacagcagtctgctcccatgaccctctgcccacttccattggtctccaggccccaataatctggggttgaaactttgaggaaatgccagtgacttattccagagtgcctcagttaggggaacttctctgtaaagaaccctgggtattgagcaaaaaccttattatcgttaatgacctataattggaagcttcctgcctttttctttggttgctcctgtggaaaatactgaaaagattactttgttttattttgttgtctttttataaaaggggaggtggagagaccccttcagagcagggattgtgccgggagagtgcctctgactttgggacatttcatccacagaaatttccaagccaatggtttcttttgggttttggtttttatgtttgttttttggggtttggaaaaacatgcatttttaccgtgcacgtaaattggtcagcagaaaagggagcccagaaaaggcagcagatggaccatgcccttgctgggttttccttttctttgggactgtgaggggaaatggtttttagaggtgagggttggtccatgtggaggaaagaagtgtctctgttgggggacagaggaacctggggagtccatcgcatgtcctacaatctgctcttagacacggccttgccaggagagcctgccctcagactgcaggaccagaacccctgcctccatctttccaagcaccggggcgaaaaaccacaaaggaaaggaagaaaatttatatatatataatataaaatcacttggtgattaaaaaaataactgctccataaataaaactcctaaagtcactta

SEQ ID NO: 1144 - DNA, 1424 bp, Homo sapiens
gttgcaaagcatttctgggagctgcatgtgggtgacgcagcagcattgttcgcaggcacaggaagccgcggctgagctgaagggctcgagaaggagcccagagcgctgcacgctgctccctctgggtagtctgaagggtcagagctggactgccctgccctatgtgctctgggagattccagaatattcaagtaaatccggattttcccagaggcagaatatctaactccttcaggagaacttccagtacagaaaacaaaacaaagacgctggggaaacttcaccaagagcctcggcagctccagagcgacgggaaacgaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctccatggccaggttcttgtggtgtccagtgcgcgtctctcctccatcacactctcccggcttgcgcaggaggggccagcagccccaggagtcccagacccgtgccgatcacactggtgctgttga

SEQ ID NO: 1145 - DNA, 5253 bp, Homo sapiens
gcaggcgaccagcccctgctggccgagggcacggcgaggagggcgctccctgcggccggggccggcccggggctcgggcccgggctgctgaccgctggcctgggggaggcgggggcgccccgggctcggcgccgaggggtcgcgctcctctctcctgacgcctccgactcccggtctccaaagccagaagagaaggtttgattcagcaactgtttgctcccttttcctggtcgctctgaccctctctggatactgggttgatccacggaaaaaccgaagacgacgtttgggatttaattattcctctcagctttggaatcttttacttctcacttggacaagaactcaagagcagaatctccgtgttgcaatctggttcctaaggaggaagaggaaggcagccctggagtggtttctttacagtaatttcaacagaagagtgagagatggaacccgaagaagaaaggattcgttacagccagagattgcgtggtaccatgcgacgacgctatgaagatgatggcatttcagatgatgaaattgaaggaaaaagaacttttgacttggaagagaaactgcacaccaacaaatataatgccaattttgttacttttatggaaggaaaagattttaatgtagagtatattcagcggggtggcttgagagatcctctgattttcaagaattctgatggactcggaataaaaatgccggatccagacttcactgtgaatgatgtcaaaatgtgtgtggggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggtggatttcattgactgggtagacaacatgtggccaaggcacttgaaggaaagccagactgaatcaacaaatgccatcttggagatgcagtaccctaaagtgcagaagtactgtctaatgagtgttcgaggctgctatactgacttccatgtggactttggtggtacctctgtttggtatcacatccatcaagggggaaaggtcttctggctcatcccccctacagcccacaacctggagctgtacgagaattggctgctgtcagggaaacagggagacatctttctgggtgaccgggtatcagattgtcagcgcattgagctcaagcagggctataccttcgtcattccctcaggctggattcatgctgtgtatactcctacagacacattagtgtttgggggcaattttttgcatagcttcaacatccctatgcagttaaaaatatacaacattgaagatcggacacgggttccaaataagtttcgctatccattctactatgagatgtgttggtatgtgttggagcgctatgtgtactgcataaccaaccgttcccacctaactaaggaatttcagaaagagtccctcagcatggatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcctgtcccttgagcccttcctctacaggtggggcagagagggtggtggacaccaggcttatctgcctgctcctctccctcctaaggaaaagggagtagcagattgatctgaggggaaagcacaggctgtgctgtcgaggcgcctgctcgcttactcgcctgccaggaggccgggctctcagtttggggtgtttgtgcaaccttcatctgcactgggccctgtgcccctcctccccatccatggtccccagcagtgcctggttctgagcaaactcccagggaagaaaacggccctgtctccatggccaggttcttgtggtgtccagtgcgcgtctctcctccatcacactctcccggcttgcgcaggaggggccagcagccccaggagtcccagacccgtgccgatcacactggtgctgttgagatctcccaaacctcacgtccttaactgtgctctccctcctttcctctcccttgagcttggttctgcccagcactcgtgcttgttcacataattaggtttcccaccccagcctacccgacttacttgctagtctctatgaggtccttattgcacttattggggttgaagctcttcagaggagctggaactgtctaccccagggacacacccatttcgttgctacccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaagaaagaaagaa

SEQ ID NO: 1146 - DNA, 3651 bp, Homo sapiens
gttgcaaagcatttctgggagctgcatgtgggtgacgcagcagcattgttcgcaggcacaggaagccgcggctgagctgaagggctcgagaaggagcccagagcgctgcacgctgctccctctgggtagtctgaagggtcagagctggactgccctgccctatgtgctctgggagattccagaatattcaagtaaatccggattttcccagaggcagaatatctaactccttcaggagaacttccagtacagaaaacaaaacaaagacgctggggaaacttcaccaagagcctcggcagctccagagcgacgggaaacgaaagattttgctggaggagcttgccaacagcgatcccaagttagccctcactggagttcctatagtacagtggccaaaaagggataagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcacccagactgcctcactcagtcacatgttccctctgtggagaggtggatcagaatgaagagacacaagactttgagaagaaactcatggaatgctgtatctgcaatgagattgttcatcctggctgcctccagatggacggagaggggttgcttaacgaagaattgccaaattgctgggaatgtccaaagtgctaccaggaggacagctcggagaaagcccagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcctgtcccttgagcccttcctctacaggtggggcagagagggtggtggacaccaggcttatctgcctgctcctctccctcctaaggaaaagggagtagcagattgatctgaggggaaagcacaggctgtgctgtcgaggcgcctgctcgcttactcgcctgccaggaggccgggctctcagtttggggtgtttgtgcaaccttcatctgcactgggccctgtgcccctcctccccatccatggtccccagcagtgcctggttctgagcaaactcccagggaagaaaacggccctgtctccatggccaggttcttgtggtgtccagtgcgcgtctctcctccatcacactctcccggcttgcgcaggaggggccagcagccccaggagtcccagacccgtgccgatcacactggtgctgttgagatctcccaaacctcacgtccttaactgtgctctccctcctttcctctcccttgagcttggttctgcccagcactcgtgcttgttcacataattaggtttcccaccccagcctacccgacttacttgctagtctctatgaggtccttattgcacttattggggttgaagctcttcagaggagctggaactgtctaccccagggacacacccatttcgttgctacccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaagaaagaaagaa

SEQ ID NO: 1147 - DNA, 4025 bp, Homo sapiens
gtgtgtccacatctttgagtgccgggagtttaaaagttaggcagtccttataggtatggaagccgagctaatttccttctgagccccccaaatgcctcctccacatggcgggtccgcaaatggggggatctgcagaggatcaccccccacgaaaaagacatgcagcagaaaagcaaaaaaagaaaacagttatatatacaaaatgctttgaatttgagtcggccacacagcgcccgattgaccgccagcgatacgacgagaacgaggacttgtcggacgtggaggagatcgtcagcgtccgcggcttcagcctggaggagaagcttcgcagccagctgtaccagggggacttcgtgcacgccatggagggcaaagatttcaactatgagtacgtacagagagaagctctcagggttcccctgatatttcgagaaaaggatggactgggaattaagatgcctgaccctgatttcacagtccgagacgtcaaactcctagtggggagccggcggcttgtggacgtgatggatgtgaacacccagaagggcacggagatgagcatgtcccagtttgtgcgttactacgagacgcccgaggcccagcgggacaagctgtacaacgtcatcagcctagagttcagccacaccaagctggagcacttggtcaagcgtccgactgtggtagacctggtggactgggtggacaacatgtggccccagcatctgaaggagaagcagacagaagccacgaacgccattgcagagatgaagtacccgaaagtgaaaaagtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacatcctgcacagctttaacgtgcccatgcagctgcggatctacgagatcgaggacaggacgcgggtgcagcccaaattccgttaccccttctactatgagatgtgctggtatgtcctggagagatacgtgtactgtgtgacccagcgctcccacctcactcaggaataccagagggagtcgatgcttattgatgccccgaggaagcccagcatagacggcttctcttcggattcctggctggagatggaggaggaggcctgtgatcagcagcctcaggaggaggaggagaaggacgaggagggcgagggcagggacagggcacccaaaccgcccaccgatggctccacttcacccaccagcacgccctctgaggaccaggaggccctcgggaagaagcccaaagcacctgccctgcgattcctcaaaaggactttgtctaatgagtcggaggaaagtgtgaagtccaccacattggccgtagactaccccaagacccccaccggctctcccgccacggaggtctctgccaaatggacccatctcactgagtttgaactgaagggcctgaaagctctggtggagaaactggaatccctcccggagaacaagaagtgtgtccccgagggcatcgaggacccccaggcactcctggagggtgtgaagaacgtcctgaaggagcacgcagatgatgaccctagtctggccatcactggggtccctgtggtgacttggccaaagaagactccaaagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcgccagtgctgccccacaccgccgtgtgccttgtgtgtggcgaggcggggaaggaagacacggtggaagaggaggaaggcaagtttaacctcatgctcatggagtgctccatctgcaatgaaatcatccaccctggatgccttaagattaaggagtcagagggtgtggtcaacgacgagcttccaaactgctgggagtgtccgaagtgtaaccacgccggcaagaccgggaaagcctacaagcaaaagcgtggccctggctttaagtacgcctccaacctgcccggctccctgctcaaggagcagaagatgaaccgggacaacaaggaagggcaggaacctgccaagcggaggagtgagtgtgaggaggcgccccggcgcaggtcggatgagcactcgaagaaggtgccgccggacggccttctgcgcagaaagtctgacgacgtgcacctgaggaagaagcggaaatacgagaagccccaggagctgagtggacgcaagcgggcctcatcgcttcaaacgtcccccggttcctcctctcacctctcgccgaggccccctctaggcagcagcctcagcccctggtggagatccagtctcacttacttccagcagcagctcaaacctggcaaagaagataagcttttcaggaaaaagcggcggtcctggaagaacgccgaggaccgcatggcgctggccaacaagcccctccggcgcttcaagcaggaacccgaggacgaactgcccgaggcgccccccaagaccagggagagcgaccactcccgctccagctcccccaccgcgggacccagcaccgaaggggccgagggcccggaggagaagaagaaggtgaagatgcgccggaagcggcggcttcccaacaaggagctgagcagggagctgagcaaggagctcaaccacgagatccagaggacggagaacagcctggccaacgagaaccagcagcccatcaagtcggagcctgagagcgagggcgaggagcccaagcggcccccgggcatctgcgagcgtccccaccgcttcagcaaggggctcaacggcaccccccgggagctgcggcaccagctggggcccagcctgcgcagcccgccccgtgtcatctcccggcccccaccctccgtgtccccgcccaagtgtatccagatggagcgccatgtgatccggccaccccccatcagccccccgcctgactcgctacccctggacgatggggcagcccacgtcatgcacagggaggtgtggatggccgtcttcagctacctcagccaccaagacctgtgtgtgtgcatgcgggtctgcaggacctggaaccgctggtgctgcgataagcggttgtggacccgcattgacctgaaccactgcaagtctatcacacccctgatgctgagtggcatcatccggcgacagcccgtctccctcgacctcagctggaccaatatctccaagaagcagctgagctggctcatcaaccggctgcctgggctccgggacttggtgctgtcaggctgctcatggatcgcggtctcggccctttgcagctccagttgtccgctgctccggaccctggatgtccagtgggtggagggactaaaggatgcccagatgcgggatctcctgtccccgcccacagacaacaggccaggtcagatggacaatcggagcaagctccggaacatcgtggagctgcgcctggcaggcctggacatcacagatgcctccctgcggctcatcatccgccacatgcccctgctctccaagctccacctcagttactgtaaccacgtcaccgaccagtctatcaacctgctcactgctgttggcaccaccacccgagactccttaaccgagatcaacctgtctggcttctttgttggaagggtctttgggctccagttttggggaatatgtgaaccacaagccaggaagaatgctggctgggcatga

SEQ ID NO: 1148 - DNA, 4812 bp, Homo sapiens
ccaacaacaaaacagcgatgccacggcgctaacggcgcccggtgcctcccgggctccctccccgccccatacctcctcgggccgccgcccccacccccccaagcccgggccgagagcccccccaaatagcccggccgcgggctccgagcgcgatcggcaacaatgtttacgttccggggattatgacgtcgacgcctccccccccccacaactgctgaaaatggtttcctaggactttgcaaacggatctgcctaagtgttggtgcaaaactttgtagatctcggctctggcttgctttatttatttattttttggtttgttttctttggtcttccctccttcccccctcggccaaaatgcagggggcaggagtgttgacaattaattggtgaactctcctaaaaaaatggaggcagagaaagactctggaagaagattgcgcccgattgaccgccagcgatacgacgagaacgaggacttgtcggacgtggaggagatcgtcagcgtccgcggcttcagcctggaggagaagcttcgcagccagctgtaccagggggacttcgtgcacgccatggagggcaaagatttcaactatgagtacgtacagagagaagctctcagggttcccctgatatttcgagaaaaggatggactgggaattaagatgcctgaccctgatttcacagtccgagacgtcaaactcctagtggggagccggcggcttgtggacgtgatggatgtgaacacccagaagggcacggagatgagcatgtcccagtttgtgcgttactacgagacgcccgaggcccagcgggacaagctgtacaacgtcatcagcctagagttcagccacaccaagctggagcacttggtcaagcgtccgactgtggtagacctggtggactgggtggacaacatgtggccccagcatctgaaggagaagcagacagaagccacgaacgccattgcagagatgaagtacccgaaagtgaaaaagtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacatcctgcacagctttaacgtgcccatgcagctgcggatctacgagatcgaggacaggacgcgggtgcagcccaaattccgttaccccttctactatgagatgtgctggtatgtcctggagagatacgtgtactgtgtgacccagcgctcccacctcactcaggaataccagagggagtcgatgcttattgatgccccgaggaagcccagcatagacggcttctcttcggattcctggctggagatggaggaggaggcctgtgatcagcagcctcaggaggaggaggagaaggacgaggagggcgagggcagggacagggcacccaaaccgcccaccgatggctccacttcacccaccagcacgccctctgaggaccaggaggccctcgggaagaagcccaaagcacctgccctgcgattcctcaaaaggactttgtctaatgagtcggaggaaagtgtgaagtccaccacattggccgtagactaccccaagacccccaccggctctcccgccacggaggtctctgccaaatggacccatctcactgagtttgaactgaagggcctgaaagctctggtggagaaactggaatccctcccggagaacaagaagtgtgtccccgagggcatcgaggacccccaggcactcctggagggtgtgaagaacgtcctgaaggagcacgcagatgatgaccctagtctggccatcactggggtccctgtggtgacttggccaaagaagactccaaagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcgccagtgctgccccacaccgccgtgtgccttgtgtgtggcgaggcggggaaggaagacacggtggaagaggaggaaggcaagtttaacctcatgctcatggagtgctccatctgcaatgaaatcatccaccctggatgccttaagattaaggagtcagagggtgtggtcaacgacgagcttccaaactgctgggagtgtccgaagtgtaaccacgccggcaagaccgggaaacaaaagcgtggccctggctttaagtacgcctccaacctgcccggctccctgctcaaggagcagaagatgaaccgggacaacaaggaagggcaggaacctgccaagcggaggagtgagtgtgaggaggcgccccggcgcaggtcggatgagcactcgaagaaggtgccgccggacggccttctgcgcagaaagtctgacgacgtgcacctgaggaagaagcggaaatacgagaagccccaggagctgagtggacgcaagcggctcaaacctggcaaagaagataagcttttcaggaaaaagcggcggtcctggaagaacgccgaggaccgcatggcgctggccaacaagcccctccggcgcttcaagcaggaacccgaggacgaactgcccgaggcgccccccaagaccagggagagcgaccactcccgctccagctcccccaccgcgggacccagcaccgaaggggccgagggcccggaggagaagaagaaggtgaagatgcgccggaagcggcggcttcccaacaaggagctgagcagggagctgagcaaggagctcaaccacgagatccagaggacggagaacagcctggccaacgagaaccagcagcccatcaagtcggagcctgagagcgagggcgaggagcccaagcggcccccgggcatctgcgagcgtccccaccgcttcagcaaggggctcaacggcaccccccgggagctgcggcaccagctggggcccagcctgcgcagcccgccccgtgtcatctcccggcccccaccctccgtgtccccgcccaagtgtatccagatggagcgccatgtgatccggccaccccccatcagccccccgcctgactcgctacccctggacgatggggcagcccacgtcatgcacagggaggtgtggatggccgtcttcagctacctcagccaccaagacctgtgtgtgtgcatgcgggtctgcaggacctggaaccgctggtgctgcgataagcggttgtggacccgcattgacctgaaccactgcaagtctatcacacccctgatgctgagtggcatcatccggcgacagcccgtctccctcgacctcagctggaccaatatctccaagaagcagctgagctggctcatcaaccggctgcctgggctccgggacttggtgctgtcaggctgctcatggatcgcggtctcggccctttgcagctccagttgtccgctgctccggaccctggatgtccagtgggtggagggactaaaggatgcccagatgcgggatctcctgtccccgcccacagacaacaggccaggtcagatggacaatcggagcaagctccggaacatcgtggagctgcgcctggcaggcctggacatcacagatgcctccctgcggctcatcatccgccacatgcccctgctctccaagctccacctcagttactgtaaccacgtcaccgaccagtctatcaacctgctcactgctgttggcaccaccacccgagactccttaaccgagatcaacctgtctgactgcaataaggtcactgatcagtgcctgtccttcttcaaacgctgtggaaacatctgtcatattgacctgaggtactgcaagcaagtcaccaaggaaggctgtgagcagttcatagccgagatgtcttctttccaagggagaagctgttcaaccacccgtttgggggatgagtgagccgacactttcctttggtctttctgaatcgtaactgcactgctttctggaccatttctaaggcggcctttacaagaagacattcctgtcggagaggagggtggacttcggagaaattctcatactgaagcatgagcttaggagtttctgttagtggtagtggtgttttggacacttcattccttgcaacaccgaggttttgggtgttgacataaagtggaccacacaccacatctgctgccgtcttgacacttttttttgtttggttggttttgttacatcttacattatgcagaactatttttgtacaaattgtttaaaagttatttatgcaaggtttgaatgcataccagtgtttttattgttttgagattgccaattttcctgatttccttaaggtaggagagaatttaacgtgtacttcatcgacacaacccatctacaaatgtgcccagatctaacaaagtaggctaagaccttccacttaaaagcatgtttaactggaagttgagagtctgctttgtacctcaagagttacatgagcatgttgtggataaatgtaaattatagtcaaagtaagatactctgccaagtttcctctgtagag

SEQ ID NO: 1149 - DNA, 4851 bp, Homo sapiens
aaaagttaggcagtccttataggtatggaagccgagctaatttccttctgagccccccaaatgcctcctccacatggcgggtccgcaaatggggggatctgcagaggatcaccccccacgaaaaagacatgcagcagaaaagcaaaaaaagaaaacagttatatatacaaaatgctttgaatttgagtcggccacacagcgcccgattgaccgccagcgatacgacgagaacgaggacttgtcggacgtggaggagatcgtcagcgtccgcggcttcagcctggaggagaagcttcgcagccagctgtaccagggggacttcgtgcacgccatggagggcaaagatttcaactatgagtacgtacagagagaagctctcagggttcccctgatatttcgagaaaaggatggactgggaattaagatgcctgaccctgatttcacagtccgagacgtcaaactcctagtggggagccggcggcttgtggacgtgatggatgtgaacacccagaagggcacggagatgagcatgtcccagtttgtgcgttactacgagacgcccgaggcccagcgggacaagctgtacaacgtcatcagcctagagttcagccacaccaagctggagcacttggtcaagcgtccgactgtggtagacctggtggactgggtggacaacatgtggccccagcatctgaaggagaagcagacagaagccacgaacgccattgcagagatgaagtacccgaaagtgaaaaagtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacatcctgcacagctttaacgtgcccatgcagctgcggatctacgagatcgaggacaggacgcgggtgcagcccaaattccgttaccccttctactatgagatgtgctggtatgtcctggagagatacgtgtactgtgtgacccagcgctcccacctcactcaggaataccagagggagtcgatgcttattgatgccccgaggaagcccagcatagacggcttctcttcggattcctggctggagatggaggaggaggcctgtgatcagcagcctcaggaggaggaggagaaggacgaggagggcgagggcagggacagggcacccaaaccgcccaccgatggctccacttcacccaccagcacgccctctgaggaccaggaggccctcgggaagaagcccaaagcacctgccctgcgattcctcaaaaggactttgtctaatgagtcggaggaaagtgtgaagtccaccacattggccgtagactaccccaagacccccaccggctctcccgccacggaggtctctgccaaatggacccatctcactgagtttgaactgaagggcctgaaagctctggtggagaaactggaatccctcccggagaacaagaagtgtgtccccgagggcatcgaggacccccaggcactcctggagggtgtgaagaacgtcctgaaggagcacgcagatgatgaccctagtctggccatcactggggtccctgtggtgacttggccaaagaagactccaaagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcgccagtgctgccccacaccgccgtgtgccttgtgtgtggcgaggcggggaaggaagacacggtggaagaggaggaaggcaagtttaacctcatgctcatggagtgctccatctgcaatgaaatcatccaccctggatgccttaagattaaggagtcagagggtgtggtcaacgacgagcttccaaactgctgggagtgtccgaagtgtaaccacgccggcaagaccgggaaacaaaagcgtggccctggctttaagtacgcctccaacctgcccggctccctgctcaaggagcagaagatgaaccgggacaacaaggaagggcaggaacctgccaagcggaggagtgagtgtgaggaggcgccccggcgcaggtcggatgagcactcgaagaaggtgccgccggacggccttctgcgcagaaagtctgacgacgtgcacctgaggaagaagcggaaatacgagaagccccaggagctgagtggacgcaagcgggcctcatcgcttcaaacgtcccccggttcctcctctcacctctcgccgaggccccctctaggcagcagcctcagcccctggtggagatccagtctcacttacttccagcagcagctcaaacctggcaaagaagataagcttttcaggaaaaagcggcggtcctggaagaacgccgaggaccgcatggcgctggccaacaagcccctccggcgcttcaagcaggaacccgaggacgaactgcccgaggcgccccccaagaccagggagagcgaccactcccgctccagctcccccaccgcgggacccagcaccgaaggggccgagggcccggaggagaagaagaaggtgaagatgcgccggaagcggcggcttcccaacaaggagctgagcagggagctgagcaaggagctcaaccacgagatccagaggacggagaacagcctggccaacgagaaccagcagcccatcaagtcggagcctgagagcgagggcgaggagcccaagcggcccccgggcatctgcgagcgtccccaccgcttcagcaaggggctcaacggcaccccccgggagctgcggcaccagctggggcccagcctgcgcagcccgccccgtgtcatctcccggcccccaccctccgtgtccccgcccaagtgtatccagatggagcgccatgtgatccggccaccccccatcagccccccgcctgactcgctacccctggacgatggggcagcccacgtcatgcacagggaggtgtggatggccgtcttcagctacctcagccaccaagacctgtgtgtgtgcatgcgggtctgcaggacctggaaccgctggtgctgcgataagcggttgtggacccgcattgacctgaaccactgcaagtctatcacacccctgatgctgagtggcatcatccggcgacagcccgtctccctcgacctcagctggaccaatatctccaagaagcagctgagctggctcatcaaccggctgcctgggctccgggacttggtgctgtcaggctgctcatggatcgcggtctcggccctttgcagctccagttgtccgctgctccggaccctggatgtccagtgggtggagggactaaaggatgcccagatgcgggatctcctgtccccgcccacagacaacaggccaggtcagatggacaatcggagcaagctccggaacatcgtggagctgcgcctggcaggcctggacatcacagatgcctccctgcggctcatcatccgccacatgcccctgctctccaagctccacctcagttactgtaaccacgtcaccgaccagtctatcaacctgctcactgctgttggcaccaccacccgagactccttaaccgagatcaacctgtctgactgcaataaggtcactgatcagtgcctgtccttcttcaaacgctgtggaaacatctgtcatattgacctgaggtactgcaagcaagtcaccaaggaaggctgtgagcagttcatagccgagatgtctgtgagtgtccagtttgggcaagtagaagaaaaactcctgcaaaaactgagttagtccaaggataagtatgtaaatacggggcgggctctgggaggggagagactttacaaaaatgagggcttttattttccatttggaacgtgggacaacagaccacaacgcaattccattttgcaagtctttccaagggagaagctgttcaaccacccgtttgggggatgagtgagccgacactttcctttggtctttctgaatcgtaactgcactgctttctggaccatttctaaggcggcctttacaagaagacattcctgtcggagaggagggtggacttcggagaaattctcatactgaagcatgagcttaggagtttctgttagtggtagtggtgttttggacacttcattccttgcaacaccgaggttttgggtgttgacataaagtggaccacacaccacatctgctgccgtcttgacacttttttttgtttggttggttttgttacatcttacattatgcagaactatttttgtacaaattgtttaaaagttatttatgcaaggtttgaatgcataccagtgtttttattgttttgagattgccaattttcctgatttccttaaggtaggagagaatttaacgtgtacttcatcgacacaacccatctacaaatgtgcccagatctaacaaagtaggctaagaccttccacttaaaagcatgtttaactggaagttgagagtctgctttgtacctcaagagttacatgagcatgttgtggataaatgtaaattatagtcaaagtaagatactctgccaagtt

SEQ ID NO: 1150 - DNA, 2762 bp, Homo sapiens
gccgagctaatttccttctgagccccccaaatgcctcctccacatggcgggtccgcaaatggggggatctgcagaggatcaccccccacgaaaaagacatgcagcagaaaagcaaaaaaagaaaacagttatatatacaaaatgctttgaatttgagtcggccacacagcgcccgattgaccgccagcgatacgacgagaacgaggacttgtcggacgtggaggagatcgtcagcgtccgcggcttcagcctggaggagaagcttcgcagccagctgtaccagggggacttcgtgcacgccatggagggcaaagatttcaactatgagtacgtacagagagaagctctcagggttcccctgatatttcgagaaaaggatggactgggaattaagatgcctgaccctgatttcacagtccgagacgtcaaactcctagtggggagccggcggcttgtggacgtgatggatgtgaacacccagaagggcacggagatgagcatgtcccagtttgtgcgttactacgagacgcccgaggcccagcgggacaagctgtacaacgtcatcagcctagagttcagccacaccaagctggagcacttggtcaagcgtccgactgtggtagacctggtggactgggtggacaacatgtggccccagcatctgaaggagaagcagacagaagccacgaacgccattgcagagatgaagtacccgaaagtgaaaaagtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacatcctgcacagctttaacgtgcccatgcagctgcggatctacgagatcgaggacaggacgcgggtgcagcccaaattccgttaccccttctactatgagatgtgctggtatgtcctggagagatacgtgtactgtgtgacccagcgctcccacctcactcaggaataccagagggagtcgatgcttattgatgccccgaggaagcccagcatagacggcttctcttcggattcctggctggagatggaggaggaggcctgtgatcagcagcctcaggaggaggaggagaaggacgaggagggcgagggcagggacagggcacccaaaccgcccaccgatggctccacttcacccaccagcacgccctctgaggaccaggaggccctcgggaagaagcccaaagcacctgccctgcgattcctcaaaaggactttgtctaatgagtcggaggaaagtgtgaagtccaccacattggccgtagactaccccaagacccccaccggctctcccgccacggaggtctctgccaaatggacccatctcactgagtttgaactgaagggcctgaaagctctggtggagaaactggaatccctcccggagaacaagaagtgtgtccccgagggcatcgaggacccccaggcactcctggagggtgtgaagaacgtcctgaaggagcacgcagatgatgaccctagtctggccatcactggggtccctgtggtgacttggccaaagaagactccaaagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcgccagtgctgccccacaccgccgtgtgccttgtgtgtggcgaggcggggaaggaagacacggtggaagaggaggaaggcaagtttaacctcatgctcatggagtgctccatctgcaatgaaatcatccaccctggatgccttaagcgagatcaacctgtctgactgcaataaggtcactgatcagtgcctgtccttcttcaaacgctgtggaaacatctgtcatattgacctgaggtactgcaagcaagtcaccaaggaaggctgtgagcagttcatagccgagatgtctgtgagtgtccagtttgggcaagtagaagaaaaactcctgcaaaaactgagttagtccaaggataagtatgtaaatacggggcgggctctgggaggggagagactttacaaaaatgagggcttttattttccatttggaacgtgggacaacagaccacaacgcaattccattttgcaagtctttccaagggagaagctgttcaaccacccgtttgggggatgagtgagccgacactttcctttggtctttctgaatcgtaactgcactgctttctggaccatttctaaggcggcctttacaagaagacattcctgtcggagaggagggtggacttcggagaaattctcatactgaagcatgagcttaggagtttctgttagtggtagtggtgttttggacacttcattccttgcaacaccgaggttttgggtgttgacataaagtggaccacacaccacatctgctgccgtc

SEQ ID NO: 1151 - DNA, 5274 bp, Homo sapiens
gtgtgtccacatctttgagtgccgggagtttaaaagttaggcagtccttataggtatggaagccgagctaatttccttctgagccccccaaatgcctcctccacatggcgggtccgcaaatggggggatctgcagaggatcaccccccacgaaaaagacatgcagcagaaaagcaaaaaaagaaaacagttatatatacaaaatgctttgaatttgagtcggccacacagcgcccgattgaccgccagcgatacgacgagaacgaggacttgtcggacgtggaggagatcgtcagcgtccgcggcttcagcctggaggagaagcttcgcagccagctgtaccagggggacttcgtgcacgccatggagggcaaagatttcaactatgagtacgtacagagagaagctctcagggttcccctgatatttcgagaaaaggatggactgggaattaagatgcctgaccctgatttcacagtccgagacgtcaaactcctagtggggagccggcggcttgtggacgtgatggatgtgaacacccagaagggcacggagatgagcatgtcccagtttgtgcgttactacgagacgcccgaggcccagcgggacaagctgtacaacgtcatcagcctagagttcagccacaccaagctggagcacttggtcaagcgtccgactgtggtagacctggtggactgggtggacaacatgtggccccagcatctgaaggagaagcagacagaagccacgaacgccattgcagagatgaagtacccgaaagtgaaaaagtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacatcctgcacagctttaacgtgcccatgcagctgcggatctacgagatcgaggacaggacgcgggtgcagcccaaattccgttaccccttctactatgagatgtgctggtatgtcctggagagatacgtgtactgtgtgacccagcgctcccacctcactcaggaataccagagggagtcgatgcttattgatgccccgaggaagcccagcatagacggcttctcttcggattcctggctggagatggaggaggaggcctgtgatcagcagcctcaggaggaggaggagaaggacgaggagggcgagggcagggacagggcacccaaaccgcccaccgatggctccacttcacccaccagcacgccctctgaggaccaggaggccctcgggaagaagcccaaagcacctgccctgcgattcctcaaaaggactttgtctaatgagtcggaggaaagtgtgaagtccaccacattggccgtagactaccccaagacccccaccggctctcccgccacggaggtctctgccaaatggacccatctcactgagtttgaactgaagggcctgaaagctctggtggagaaactggaatccctcccggagaacaagaagtgtgtccccgagggcatcgaggacccccaggcactcctggagggtgtgaagaacgtcctgaaggagcacgcagatgatgaccctagtctggccatcactggggtccctgtggtgacttggccaaagaagactccaaagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcgccagtgctgccccacaccgccgtgtgccttgtgtgtggcgaggcggggaaggaagacacggtggaagaggaggaaggcaagtttaacctcatgctcatggagtgctccatctgcaatgaaatcatccaccctggatgccttaagattaaggagtcagagggtgtggtcaacgacgagcttccaaactgctgggagtgtccgaagtgtaaccacgccggcaagaccgggaaacaaaagcgtggccctggctttaagtacgcctccaacctgcccggctccctgctcaaggagcagaagatgaaccgggacaacaaggaagggcaggaacctgccaagcggaggagtgagtgtgaggaggcgccccggcgcaggtcggatgagcactcgaagaaggtgccgccggacggccttctgcgcagaaagtctgacgacgtgcacctgaggaagaagcggaaatacgagaagccccaggagctgagtggacgcaagcgggcctcatcgcttcaaacgtcccccggttcctcctctcacctctcgccgaggccccctctaggcagcagcctcagcccctggtggagatccagtctcacttacttccagcagcagcagcggcggtcctggaagaacgccgaggaccgcatggcgctggccaacaagcccctccggcgcttcaagcaggaacccgaggacgaactgcccgaggcgccccccaagaccagggagagcgaccactcccgctccagctcccccaccgcgggacccagcaccgaaggggccgagggcccggaggagaagaagaaggtgaagatgcgccggaagcggcggcttcccaacaaggagctgagcagggagctgagcaaggagctcaaccacgagatccagaggacggagaacagcctggccaacgagaaccagcagcccatcaagtcggagcctgagagcgagggcgaggagcccaagcggcccccgggcatctgcgagcgtccccaccgcttcagcaaggggctcaacggcaccccccgggagctgcggcaccagctggggcccagcctgcgcagcccgccccgtgtcatctcccggcccccaccctccgtgtccccgcccaagtgtatccagatggagcgccatgtgatccggccaccccccatcagccccccgcctgactcgctacccctggacgatggggcagcccacgtcatgcacagggaggtgtggatggccgtcttcagctacctcagccaccaagacctgtgtgtgtgcatgcgggtctgcaggacctggaaccgctggtgctgcgataagcggttgtggacccgcattgacctgaaccactgcaagtctatcacacccctgatgctgagtggcatcatccggcgacagcccgtctccctcgacctcagctggaccaatatctccaagaagcagctgagctggctcatcaaccggctgcctgggctccgggacttggtgctgtcaggctgctcatggatcgcggtctcggccctttgcagctccagttgtccgctgctccggaccctggatgtccagtgggtggagggactaaaggatgcccagatgcgggatctcctgtccccgcccacagacaacaggccagcaccaggtcagatggacaatcggagcaagctccggaacatcgtggagctgcgcctggcaggcctggacatcacagatgcctccctgcggctcatcatccgccacatgcccctgctctccaagctccacctcagttactgtaaccacgtcaccgaccagtctatcaacctgctcactgctgttggcaccaccacccgagactccttaaccgagatcaacctgtctgactgcaataaggtcactgatcagtgcctgtccttcttcaaacgctgtggaaacatctgtcatattgacctgaggtactgcaagcaagtcaccaaggaaggctgtgagcagttcatagccgagatgtctgtgagtgtccagtttgggcaagtagaagaaaaactcctgcaaaaactgagttagtccaaggataagtatgtaaatacggggcgggctctgggaggggagagactttacaaaaatgagggcttttattttccatttggaacgtgggacaacagaccacaacgcaattccattttgcaagtctttccaagggagaagctgttcaaccacccgtttgggggatgagtgagccgacactttcctttggtctttctgaatcgtaactgcactgctttctggaccatttctaaggcggcctttacaagaagacattcctgtcggagaggagggtggacttcggagaaattctcatactgaagcatgagcttaggagtttctgttagtggtagtggtgttttggacacttcattccttgcaacaccgaggttttgggtgttgacataaagtggaccacacaccacatctgctgccgtcttgacacttttttttgtttggttggttttgttacatcttacattatgcagaactatttttgtacaaattgtttaaaagttatttatgcaaggtttgaatgcataccagtgtttttattgttttgagattgccaattttcctgatttccttaaggtaggagagaatttaacgtgtacttcatcgacacaacccatctacaaatgtgcccagatctaacaaagtaggctaagaccttccacttaaaagcatgtttaactggaagttgagagtctgctttgtacctcaagagttacatgagcatgttgtggataaatgtaaattatagtcaaagtaagatactctgccaagtttcctctgtagagaattcacttttctcaaattttaaaatttcgacttcagcctttgcactcaggaggttctgctccagcatgagctcttgtacttacatagatctaatttatacagtgagtcaagacgtagaataaatgctcccacatagcctttcttttgcttttgcttctctcctctgaagtgtgagttgagttctcatttaggtttgtaacatggctatttcctagttgtaaagttctgcatttataagtgccattgttgtaaggtggtgtttcctagaccttccctgatgcgattttacctttgttgaatttgtataaacaattgtacaaaaaaaaccactcttgaactttgagggtttctgttctaggagtggactagaagtttaagcccagagtcagtaaacactgttttgaagtcc

SEQ ID NO: 1152 - DNA, 2522 bp, Homo sapiens
gccgagctaatttccttctgagccccccaaatgcctcctccacatggcgggtccgcaaatggggggatctgcagaggatcaccccccacgaaaaagacatgcagcagaaaagcaaaaaaagaaaacagttatatatacaaaatgctttgaatttgagtcggccacacagcgcccgattgaccgccagcgatacgacgagaacgaggacttgtcggacgtggaggagatcgtcagcgtccgcggcttcagcctggaggagaagcttcgcagccagctgtaccagggggacttcgtgcacgccatggagggcaaaggatgcctgaccctgatttcacagtccgagacgtcaaactcctagtggggagccggcggcttgtggacgtgatggatgtgaacacccagaagggcacggagatgagcatgtcccagtttgtgcgttactacgagacgcccgaggcccagcgggacaagctgtacaacgtcatcagcctagagttcagccacaccaagctggagcacttggtcaagcgtccgactgtggtagacctggtggactgggtggacaacatgtggccccagcatctgaaggagaagcagacagaagccacgaacgccattgcagagatgaagtacccgaaagtgaaaaagtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacatcctgcacagctttaacgtgcccatgcagctgcggatctacgagatcgaggacaggacgcgggtgcagcccaaattccgttaccccttctactatgagatgtgctggtatgtcctggagagatacgtgtactgtgtgacccagcgctcccacctcactcaggaataccagagggagtcgatgcttattgatgccccgaggaagcccagcatagacggcttctcttcggattcctggctggagatggaggaggaggcctgtgatcagcagcctcaggaggaggaggagaaggacgaggagggcgagggcagggacagggcacccaaaccgcccaccgatggctccacttcacccaccagcacgccctctgaggaccaggaggccctcgggaagaagcccaaagcacctgccctgcgattcctcaaaaggactttgtctaatgagtcggaggaaagtgtgaagtccaccacattggccgtagactaccccaagacccccaccggctctcccgccacggaggtctctgccaaatggacccatctcactgagtttgaactgaagggcctgaaagctctggtggagaaactggaatccctcccggagaacaagaagtgtgtccccgagggcatcgaggacccccaggcactcctggagggtgtgaagaacgtcctgaaggagcacgcagatgatgaccctagtctggccatcactggggtccctgtggtgacttggccaaagaagactccaaagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcgactgcaataaggtcactgatcagtgcctgtccttcttcaaacgctgtggaaacatctgtcatattgacctgaggtactgcaagcaagtcaccaaggaaggctgtgagcagttcatagccgagatgtctgtgagtgtccagtttgggcaagtagaagaaaaactcctgcaaaaactgagttagtccaaggataagtatgtaaatacggggcgggctctgggaggggagagactttacaaaaatgagggcttttattttccatttggaacgtgggacaacagaccacaacgcaattccattttgcaagtctttccaagggagaagctgttcaaccacccgtttgggggatgagtgagccgacactttcctttggtctttctgaatcgtaactgcactgctttctggaccatttctaaggcggcctttacaagaagacattcctgtcggagaggagggtggacttcggagaaattctcatactgaagcatgagcttaggagtttctgttagtggtagtggtgttttggacacttcattccttgcaacaccgaggttttgggtgttgacataaagtggaccacacaccacatctgctgccgtc

SEQ ID NO: 1153 - DNA, 2634 bp, Homo sapiens
agggcgagccgagcctgctccgggcgggcggcggcggcggcgccgctccagccatgtcagcgcgcgcgagcctgggcccaccatgagccatggccatgtccgtgagcgccgaggacgacgactatgaatcggagccggaccagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcgccagtgctgccccacaccgccgtgtgccttgtgtgtggcgaggcggggaaggaagacacggtggaagaggaggaaggcaagtttaacctcatgctcatggagtgctccatctgcaatgaaatcatccaccctggatgccttaagattaaggagtcagagggtgtggtcaacgacgagcttccaaactgctgggagtgtccgaagtgtaaccacgccggcaagaccgggaaagcctacaagcaaaagcgtggccctggctttaagtacgcctccaacctgcccggctccctgctcaaggagcagaagatgaaccgggacaacaaggaagggcaggaacctgccaagcggaggagtgagtgtgaggaggcgccccggcgcaggtcggatgagcactcgaagaaggtgccgccggacggccttctgcgcagaaagtctgacgacgtgcacctgaggaagaagcggaaatacgagaagccccaggagctgagtggacgcaagcgggcctcatcgcttcaaacgtcccccggttcctcctctcacctctcgccgaggccccctctaggcagcagcctcagcccctggtggagatccagtctcacttacttccagcagcagctcaaacctggcaaagaagataagcttttcaggaaaaagcggcggtcctggaagaacgccgaggaccgcatggcgctggccaacaagcccctccggcgcttcaagcaggaacccgaggacgaactgcccgaggcgccccccaagaccagggagagcgaccactcccgctccagctcccccaccgcgggacccagcaccgaaggggccgagggcccggaggagaagaagaaggtgaagatgcgccggaagcggcggcttcccaacaaggagctgagcagggagctgagcaaggagctcaaccacgagatccagaggacggagaacagcctggccaacgagaaccagcagcccatcaagtcggagcctgagagcgagggcgaggagcccaagcggcccccgggcatctgcgagcgtccccaccgcttcagcaaggggctcaacggcaccccccgggagctgcggcaccagctggggcccagcctgcgcagcccgccccgtgtcatctcccggcccccaccctccgtgtccccgcccaagtgtatccagatggagcgccatgtgatccggccaccccccatcagccccccgcctgactcgctacccctggacgatggggcagcccacgtcatgcacagggaggtgtggatggccgtcttcagctacctcagccaccaagacctgtgtgtgtgcatgcgggtctgcaggacctggaaccgctggtgctgcgataagcggttgtggacccgcattgacctgaaccactgcaagtctatcacacccctgatgctgagtggcatcatccggcgacagcccgtctccctcgacctcagctggaccaatatctccaagaagcagctgagctggctcatcaaccggctgcctgggctccgggacttggtgctgtcaggctgctcatggatcgcggtctcggccctttgcagctccagttgtccgctgctccggaccctggatgtccagtgggtggagggactaaaggatgcccagatgcgggatctcctgtccccgcccacagacaacaggccaggtcagatggacaatcggagcaagctccggaacatcgtggagctgcgcctggcaggcctggacatcacagatgcctccctgcggctcatcatccgccacatgcccctgctctccaagctccacctcagttactgtaaccacgtcaccgaccagtctatcaacctgctcactgctgttggcaccaccacccgagactccttaaccgagatcaacctgtctgactgcaataaggtcactgatcagtgcctgtccttcttcaaacgctgtggaaacatctgtcatattgacctgaggtactgcaagcaagtcaccaaggaaggctgtgagcagttcatagccgagatgtctgtgagtgtccagtttgggcaagtagaagaaaaactcctgcaaaaactgagttagtccaaggataagtatgtaaatacggggcgggctctgggaggggagagactttacaaaaatgagggcttttattttccatttggaacgtgggacaacagaccacaacgcaattccattttgcaagtctttccaagggagaagctgttcaaccacccgtttgggggatgagtgagccgacactttcctttggtctttctgaatcgta

SEQ ID NO: 1154 - DNA, 5601 bp, Homo sapiens
agggctcggtcgccagcaaccgagcggggcccggcccgagcggggcctgggggtgcgacgccgagggcgggggagagcgcgccgctgctcccggaccgggccgcgcacgccgcctcaggaaccatcactgttgctggaggcacctgacaaatcctagcgaatttttggagcatctccacccaggaacctcgccatccagaagtgtgcttcccgcacagctgcagccatggggtctgaggaccacggcgcccagaaccccagctgtaaaatcatgacgtttcgcccaaccatggaagaatttaaagacttcaacaaatacgtggcctacatagagtcgcagggagcccaccgggcgggcctggccaagatcatccccccgaaggagtggaagccgcggcagacgtatgatgacatcgacgacgtggtgatcccggcgcccatccagcaggtggtgacgggccagtcgggcctcttcacgcagtacaatatccagaagaaggccatgacagtgggcgagtaccgccgcctggccaacagcgagaagtactgtaccccgcggcaccaggactttgatgaccttgaacgcaaatactggaagaacctcacctttgtctccccgatctacggggctgacatcagcggctctttgtatgatgacgacgtggcccagtggaacatcgggagcctccggaccatcctggacatggtggagcgcgagtgcggcaccatcatcgagggcgtgaacacgccctacctgtacttcggcatgtggaagaccaccttcgcctggcacaccgaggacatggacctgtacagcatcaactacctgcactttggggagcctaagtcctggtacgccatcccaccagagcacggcaagcgcctggagcggctggccatcggcttcttccccgggagctcgcagggctgcgacgccttcctgcggcataagatgaccctcatctcgcccatcatcctgaagaagtacgggatccccttcagccggatcacgcaggaggccggggaattcatgatcacatttccctacggctaccacgccggcttcaatcacgggttcaactgcgcagaatctaccaacttcgccaccctgcggtggattgactacggcaaagtggccactcagtgcacgtgccggaaggacatggtcaagatctccatggacgtgttcgtgcgcatcctgcagcccgagcgctacgagctgtggaagcagggcaaggacctcacggtgctggaccacacgcggcccacggcgctcaccagccccgagctgagctcctggagtgcatcccgggcctcgctgaaggccaagctcctccgcaggtctcaccggaaacggagccagcccaagaagccgaagcccgaagaccccaagttccctggggagggtacggctggggcagcgctcctagaggaggctgggggcagcgtgaaggaggaggctgggccggaggttgaccccgaggaggaggaggaggagccgcagccactgccacacggccgggaggccgagggcgcagaagaggacgggaggggcaagctgcggccaaccaaggccaagagcgagcggaagaagaagagcttcggcctgctgcccccacagctgccgcccccgcctgctcacttcccctcagaggaggcgctgtggctgccatccccactggagcccccggtgctgggcccaggccctgcagccatggaggagagccccctgccggcaccccttaatgtcgtgccccctgaggtgcccagtgaggagctagaggccaagcctcggcccatcatccccatgctgtacgtggtgccgcggccgggcaaggcagccttcaaccaggagcacgtgtcctgccagcaggcctttgagcactttgcccagaagggtccgacctggaaggaaccagtttcccccatggagctgacggggccagaggacggtgcagccagcagtggggcaggtcgcatggagaccaaagcccgggccggagaggggcaggcaccgtccacattttccaaattgaagatggagatcaagaagagccggcgccatcccctgggccggccgcccacccggtccccactgtcggtggtgaagcaggaggcctcaagtgacgaggaggcatcccctttctccggggaggaagatgtgagtgacccggacgccttgaggccgctgctgtctctgcagtggaagaacagggcggccagcttccaggccgagaggaagttcaacgcagcggctgcgcgcacggagccctactgcgccatctgcacgctcttctacccctactgccaggccctacagactgagaaggaggcacccatagcctccctcggaaagggctgcccggccacattaccctccaaaagccgtcagaagacccgaccgctcatccctgagatgtgcttcacctctggcggtgagaacacggagccgctgcctgccaactcctacatcggcgacgacgggaccagccccctgatcgcctgcggcaagtgctgcctgcaggtccatgccagttgctatggcatccgtcccgagctggtcaatgaaggctggacgtgttcccggtgcgcggcccacgcctggactgcggagtgctgcctgtgcaacctgcgaggaggtgcgctgcagatgaccaccgataggaggtggatccacgtgatctgtgccatcgcagtccccgaggcgcgcttcctgaacgtgattgagcgccaccctgtggacatcagcgccatccccgagcagcggtggaagctgaaatgcgtgtactgccggaagcggatgaagaaggtgtcaggtgcctgtatccagtgctcctacgagcactgctccacgtccttccacgtgacctgcgcccacgccgcaggcgtgctcatggagccggacgactggccctatgtggtctccatcacctgcctcaagcacaagtcggggggtcacgctgtccaactcctgagggccgtgtccctaggccaggtggtcatcaccaagaaccgcaacgggctgtactaccgctgtcgcgtcatcggtgccgcctcgcagacctgctacgaagtgaacttcgacgatggctcctacagcgacaacctgtaccctgagagcatcacgagtagggactgtgtccagctgggacccccttccgagggggagctggtggagctccggtggactgacggcaacctctacaaggccaagttcatctcctccgtcaccagccacatctaccaggtggagtttgaggacgggtcccagctgacggtgaagcgtggggacatcttcaccctggaggaggagctgcccaagagggtccgctctcggctgtcactgagcacgggggcaccgcaggagcccgccttctcgggggaggaggccaaggccgccaagcgcccgcgtgtgggcaccccgcttgccacggaggactccgggcggagccaggactacgtggccttcgtggagagcctcctgcaggtgcagggccggcccggagcccccttctaggacagctggccgctcaggcgaccctcagcccggcggggaggccatggcatgccccgggcgttcgcttgctgtgaattcctgtcctcgtgtccccgacccccgagaggccacctccaagccgcgggtgccccctagggcgacaggagccagcgggacgccgcacgcggccccagactcagggagcagggccaggcgggctcgggggccggccaggggagcaccccactcaactactcagaattttaaaccatgtaagctctcttcttctcgaaaaggtgctactgcaatgccctactgagcaacctttgagattgtcacttctgtacataaaccacctttgtgaggctctttctataaatacatattgtttaaaaaaaagcaagaaaaaaaggaaaacaaaggaaaatatccccaaagttgttttctagatttgtggctttaagaaaaacaaaacaaaacaaacacattgtttttctcagaaccaggattctctgagaggtcagagcatctcgctgtttttttgttgttgttttaaaatattatgatttggctacagaccaggcagggaaagagacccggtaattggagggtgagcctcggggggggggcaggacgccccggtttcggcacagcccggtcactcacggcctcgctctcgcctcaccccggctcctgggctttgatggtctggtgccagtgcctgtgcccactctgtgcctgctgggaggaggcccaggctctctggtggccgcccctgtgcacctggccaggggaagcccgggggtctggggcctccctccgtctgcgcccacctttgcagaataaactctctcctggggtttgtctatctttgtttctctcacctgagagaaacgcaggtgttccagaggcttccttgcagacaaagcacccctgcacctcctatggctcaggatgagggaggcccccaggcccttctggttggtagtgagtgtggacagcttcccagctcttcgggtacaaccctgagcaggtcgggggacacagggccgaggcaggccttcggggcccctttcgcctgcttccgggcagggacgaggcctggtgtcctcgctccacccacccacgctgctgtcacctgaggggaatctgcttcttaggagtgggttgagctgatagagaaaaaacggccttcagcccaggctgggaagcgccttctccaggtgcctctccctcaccagctctgcacccctctggggagccttccccaccttagctgtctcctgccccagggagggatggaggagataatttgcttatattaaaaacaaaaaatggctgaggcaggagtttgggaccagcctgggctatatagcaagaccccatcactacaaattttttacaaattagctaggtgtggtggtgcgcacctgtggtcccagctactcgggaggctgtggtgggaggattgcttgagtccaggaggttgaggctgcagtcagctcagattgcaccactgcactccagcctgggcaacagagcgagaccctgtctccaaaaaaaaaaaaaagcaatgtttatattataaaagagtgtcctaacagtccccgggctagagaggactaaggaaaacagagagagtgttacgcaggagcaagcctttcatttccttggtgggggaggggggcggttgccctggagagggccggggtcggggaggttggggggtgtcagccaaaacgtggaggtgtccctctgcacgcagccctcgcccggcgtggcgctgacactgtattcttatgttgtttgaaaatgctatttatattgtaaagaagcgggcgggtgcccctgctgcccttgtcccttgggggtcacacccatcccctggtgggctcctgggcggcctgcgcagatgggccacagaagggcaggccggagctgcacactctccccacgaaggtatctctgtgtcttactctgtgcaaagacgcggcaaaacccagtgccctggtttttccccacccgagatgaaggatacgctgtattttttgcctaatgtccctgcctctaggttcataatgaattaaaggttcatgaacgctgcg

SEQ ID NO: 1155 - DNA, 1573 bp, Homo sapiens
agggctcggtcgccagcaaccgagcggggcccggcccgagcggggcctgggggtgcgacgccgagggcgggggagagcgcgccgctgctcccggaccgggccgcgcacgccgcctcaggaaccatcactgttgctggaggcacctgacaaatcctagcgaatttttggagcatctccacccaggaacctcgccatccagaagtgtgcttcccgcacagctgcagccatggggtctgaggaccacggcgcccagaaccccagctgtaaaatcatgacgtttcgcccaaccatggaagaatttaaagacttcaacaaatacgtggcctacatagagtcgcagggagcccaccgggcgggcctggccaagatcatccccccgaaggagtggaagccgcggcagacgtatgatgacatcgacgacgtggtgatcccggcgcccatccagcaggtggtgacgggccagtcgggcctcttcacgcagtacaatatccagaagaaggccatgacagtgggcgagtaccgccgcctggccaacagcgagaagtactgtaccccgcggcaccaggactttgatgaccttgaacgcaaatactggaagaacctcacctttgtctccccgatctacggggctgacatcagcggctctttgtatgatgacgacgtggcccagtggaacatcgggagcctccggaccatcctggacatggtggagcgcgagtgcggcaccatcatcgagggcgtgaacacgccctacctgtacttcggcatgtggaagaccaccttcgcctggcacaccgaggacatggacctgtacagcatcaactacctgcactttggggagcctaagtcctggtacgccatcccaccagagcacggcaagcgcctggagcggctggccatcggcttcttccccgggagctcgcagggctgcgacgccttcctgcggcataagatgaccctcatctcgcccatcatcctgaagaagtacgggatccccttcagccggatcacgcaggaggccggggaattcatgatcacatttccctacggctaccacgccggcttcaatcacgggttcaactgcgcagaatctaccaacttcgccaccctgcggtggattgactacggcaaagtggccactcagtgcacgtgccggaaggacatggtcaagatctccatggacgtgttcgtgcgcatcctgcagcccgagcgctacgagctgtggaagcagggcaaggacctcacggtgctggaccacacgcggcccacggcgctcaccagccccgagctgagctcctggagtgcatcccgggcctcgctgaaggccaagctcctccgcagaacccctccctgcgtatcgccgcacagaccctcccagccaggtatctggtgtccgcctggaggagaggccaaagcatctgcagcctcttggcttctgaccacaagaggccatggggacacggaggcaggtcccggcctaggaggagatccacttcatgcccagagtgaaggccaggcctcctgtgtctcgacgtctcgactccgcatggcaactcaagacccttgcagatga

SEQ ID NO: 1156 - DNA, 5027 bp, Homo sapiens
cctcgccatccagaagtgtgcttcccgcacagctgcagccatggggtctgaggaccacggcgcccagaaccccagctgtaaaatcatgacgtttcgcccaaccatggaagaatttaaagacttcaacaaatacgtggcctacatagagtcgcagggagcccaccgggcgggcctggccaagatcatccccccgaaggagtggaagccgcggcagacgtatgatgacatcgacgacgtggtgatcccggcgcccatccagcaggtggtgacgggccagtcgggcctcttcacgcagtacaatatccagaagaaggccatgacagtgggcgagtaccgccgcctggccaacagcgagaagtactgtaccccgcggcaccaggactttgatgaccttgaacgcaaatactggaagaacctcacctttgtctccccgatctacggggctgacatcagcggctctttgtatgatgacgacgtggcccagtggaacatcgggagcctccggaccatcctggacatggtggagcgcgagtgcggcaccatcatcgagggcgtgaacacgccctacctgtacttcggcatgtggaagaccaccttcgcctggcacaccgaggacatggacctgtacagcatcaactacctgcactttggggagcctaagtcctggtacgccatcccaccagagcacggcaagcgcctggagcggctggccatcggcttcttccccgggagctcgcagggctgcgacgccttcctgcggcataagatgaccctcatctcgcccatcatcctgaagaagtacgggatccccttcagccggatcacgcaggaggccggggaattcatgatcacatttccctacggctaccacgccggcttcaatcacgggttcaactgcgcagaatctaccaacttcgccaccctgcggtggattgactacggcaaagtggccactcagtgcacgtgccggaaggacatggtcaagatctccatggacgtgttcgtgcgcatcctgcagcccgagcgctacgagctgtggaagcagggcaaggacctcacggtgctggaccacacgcggcccacggcgctcaccagccccgagctgagctcctggagtgcatcccgggcctcgctgaaggccaagctcctccgcagacaaattagtctgaaagaaaacagacactggagaaagactgaggaggagaggaaaccaagtctagaaaggaagaaagagcagaccaaaaggccggggctgtcgtctcaccggaaacggagccagcccaagaagccgaagcccgaagaccccaagttccctggggagggtacggctggggcagcgctcctagaggaggctgggggcagcgtgaaggaggaggctgggccggaggttgaccccgaggaggaggaggaggagccgcagccactgccacacggccgggaggccgagggcgcagaagaggacgggaggggcaagctgcggccaaccaaggccaagagcgagcggaagaagaagagcttcggcctgctgcccccacagctgccgcccccgcctgctcacttcccctcagaggaggcgctgtggctgccatccccactggagcccccggtgctgggcccaggccctgcagccatggaggagagccccctgccggcaccccttaatgtcgtgccccctgaggtgcccagtgaggagctagaggccaagcctcggcccatcatccccatgctgtacgtggtgccgcggccgggcaaggcagccttcaaccaggagcacgtgtcctgccagcaggcctttgagcactttgcccagaagggtccgacctggaaggaaccagtttcccccatggagctgacggggccagaggacggtgcagccagcagtggggcaggtcgcatggagaccaaagcccgggccggagaggggcaggcaccgtccacattttccaaattgaagatggagatcaagaagagccggcgccatcccctgggccggccgcccacccggtccccactgtcggtggtgaagcaggaggcctcaagtgacgaggaggcatcccctttctccggggaggaagatgtgagtgacccggacgccttgaggccgctgctgtctctgcagtggaagaacagggcggccagcttccaggccgagaggaagttcaacgcagcggctgcgcgcacggagccctactgcgccatctgcacgctcttctacccctactgccaggccctacagactgagaaggaggcacccatagcctccctcggaaagggctgcccggccacattaccctccaaaagccgtcagaagacccgaccgctcatccctgagatgtgcttcacctctggcggtgagaacacggagccgctgcctgccaactcctacatcggcgacgacgggaccagccccctgatcgcctgcggcaagtgctgcctgcaggtccatgccagttgctatggcatccgtcccgagctggtcaatgaaggctggacgtgttcccggtgcgcggcccacgcctggactgcggagtgctgcctgtgcaacctgcgaggaggtgcgctgcagatgaccaccgataggaggtggatccacgtgatctgtgccatcgcagtccccgaggcgcgcttcctgaacgtgattgagcgccaccctgtggacatcagcgccatccccgagcagcggtggaagctgaaatgcgtgtactgccggaagcggatgaagaaggtgtcaggtgcctgtatccagtgctcctacgagcactgctccacgtccttccacgtgacctgcgcccacgccgcaggcgtgctcatggagccggacgactggccctatgtggtctccatcacctgcctcaagcacaagtcggggggtcacgctgtccaactcctgagggccgtgtccctaggccaggtggtcatcaccaagaaccgcaacgggctgtactaccgctgtcgcgtcatcggtgccgcctcgcagacctgctacgaagtgaacttcgacgatggctcctacagcgacaacctgtaccctgagagcatcacgagtagggactgtgtccagctgggacccccttccgagggggagctggtggagctccggtggactgacggcaacctctacaaggccaagttcatctcctccgtcaccagccacatctaccaggtggagtttgaggacgggtcccagctgacggtgaagcgtggggacatcttcaccctggaggaggagctgcccaagagggtccgctctcggctgtcactgagcacgggggcaccgcaggagcccgccttctcgggggaggaggccaaggccgccaagcgcccgcgtgtgggcaccccgcttgccacggaggactccgggcggagccaggactacgtggccttcgtggagagcctcctgcaggtgcagggccggcccggagcccccttctaggacagctggccgctcaggcgaccctcagcccggcggggaggccatggcatgccccgggcgttcgcttgctgtgaattcctgtcctcgtgtccccgacccccgagaggccacctccaagccgcgggtgccccctagggcgacaggagccagcgggacgccgcacgcggccccagactcagggagcagggccaggcgggctcgggggccggccaggggagcaccccactcaactactcagaattttaaaccatgtaagctctcttcttctcgaaaaggtgctactgcaatgccctactgagcaacctttgagattgtcacttctgtacataaaccacctttgtgaggctctttctataaatacatattgtttaaaaaaaagcaagaaaaaaaggaaaacaaaggaaaatatccccaaagttgttttctagatttgtggctttaagaaaaacaaaacaaaacaaacacattgtttttctcagaaccaggattctctgagaggtcagagcatctcgctgtttttttgttgttgttttaaaatattatgatttggctacagaccaggcagggaaagagacccggtaattggagggtgagcctcggggggggggcaggacgccccggtttcggcacagcccggtcactcacggcctcgctctcgcctcaccccggctcctgggctttgatggtctggtgccagtgcctgtgcccactctgtgcctgctgggaggaggcccaggctctctggtggccgcccctgtgcacctggccaggggaagcccgggggtctggggcctccctccgtctgcgcccacctttgcagaataaactctctcctggggtttgtctatctttgtttctctcacctgagagaaacgcaggtgttccagaggcttccttgcagacaaagcacccctgcacctcctatggctcaggatgagggaggcccccaggcccttctggttggtagtgagtgtggacagcttcccagctcttcgggtacaaccctgagcaggtcgggggacacagggccgaggcaggccttcggggcccctttcgcctgcttccgggcagggacgaggcctggtgtcctcgctccacccacccacgctgctgtcacctgaggggaatctgcttcttaggagtgggttgagctgatagagaaaaaacggccttcagcccaggctgggaagcgccttctccaggtgcctctccctcaccagctctgcacccctctggggagccttccccaccttagctgtctcctgccccagggagggatggaggagataatttgcttatattaaaaacaaaaaatggctgaggcaggagtttgggaccagcctgggctatatagcaagaccccatcactacaaattttttacaaattagctaggtgtggtggtgcgcacctgtggtcccagctactcgggaggctgtggtgggaggattgcttgagtccaggaggttgaggctgcagtcagctcagattgcaccactgcactccagcctgggcaacagagcgagaccctgtctccaaaaaaaaaaaaaagcaatgtttatattataaaagagtgtcctaacagtccccgggcta

SEQ ID NO: 1157 - DNA, 4601 bp, Homo sapiens
cggcgcccaggaggacgtgtggcgcgtggactacatcaggtccagccctgcgggaccccagccagcgcttccgggcaaggttctgtgcacctgttttctccttctacgcgagtatctttcccctccggaaagaatgggatatgcctgtgtccaaaggacaagaagatgcgcgccagcaagcctaagttaaccacagcgcggaagttgagcccaaagcaagagcgtgccgggcacctttaagctgtttgtaagcccacgtgactcaccaagtgcgggccccagcggtcacgtgacggcgcgcgcgccctcgcgcagggagagccggcggtgcgcgcgccttcgccgctgcctcccacccaccccctcgacgggagggtgaggcgcggcgcagtgatcgggcggccggggtcctgtgcgcgtgcgcagcgaacagctgtcacctagtgcggaacaagtctcccaaatttcccaaatctccctgggccggaggccactgtcttctcttcctcctccaccgagtcgtgctctcgccccaacccgcgcgccagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataagtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgactggccttatgtggtgaacattacatgctttcgacataaggtcaaccccaacgtgaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaatgaagagagaggacatctacactttagatgaagagttacccaagagagtgaaagctcgatttgtaagtgctggcagatgccacttggggacctgccaagtgaattccttgtcctcacctcatgtttcccaagcccagcaggaaacatacttgggcttttggattaattctaaaaaaagccaatgcaacattttccttagtggaacctattgaatgcaaacttcaaattcaaccaaaatcggggaaattaatgcatgtgctttacttttcttctaatgaagtcacatgatgcttctttgtgttgacatttattggtgcacaaaaatacttactgaatgtgtgctctgtgtaaaacaccaggagcaaacaaagataccatcaaggcatttgcaatcttgttagtagaagcaacattaaaagtattcaggagtagatcaaaggggactcggcataattgaatgtctgtctattcttttataggtttttcatggattgactaccttctgtctcagaaagttactgatgtttgtgtcagttcatcattaagctaaactctgactttcataataaaagggataaacaaagcctaaatgctagttgtgggaatactaaagcagttttttaaaaaggaaatagtagtttcatgccctcacataccattaaaagatgaacaaacatggacaaatattcaaaactgcagtcattgaaaaatataattcacaataatttagacttcatattattgtatcataaaatattcagtggaccctgaaatgaagtcagttttattcatttagaattatatctattgtgtctgtgaaatgataaatcctaaatagagaaatttgaatggatggggtttttctgactaaaatgaaattttttttctgaataattcagtttagtgagtgcttatgatatacttgtctgcagtgatagagtcactatagattatttggttattttggaaaaaccaagggttttcttaaatcagggatgtccaatctttttgcatccctgggccatacttgaagaagaagaattgtctttggcctcacataaactacactaacaatagctgatgagctactaaaaaaaaaaaaaa

SEQ ID NO: 1158 - DNA, 4655 bp, Homo sapiens
cggcgcccaggaggacgtgtggcgcgtggactacatcaggtccagccctgcgggaccccagccagcgcttccgggcaaggttctgtgcacctgttttctccttctacgcgagtatctttcccctccggaaagaatgggatatgcctgtgtccaaaggacaagaagatgcgcgccagcaagcctaagttaaccacagcgcggaagttgagcccaaagcaagagcgtgccgggcacctttaagctgtttgtaagcccacgtgactcaccaagtgcgggccccagcggtcacgtgacggcgcgcgcgccctcgcgcagggagagccggcggtgcgcgcgccttcgccgctgcctcccacccaccccctcgacgggagggtgaggcgcggcgcagtgatcgggcggccggggtcctgtgcgcgtgcgcagcgaacagctgtcacctagtgcggaacaagtctcccaaatttcccaaatctccctgggccggaggccactgtcttctcttcctcctccaccgagtcgtgctctcgccccaacccgcgcgccagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataagtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgactggccttatgtggtgaacattacatgctttcgacataaggtcaaccccaacgtgaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaatgaagagagaggacatctacactttagatgaagagttacccaagagagtgaaagctcgattttccacagcctctgacatgcgatttgaagacacgttttatggagcagacattatccaaggggagagaaagagacaaagagtgctgagctccaggtttaagaatgaatatgtggccgaccctgtataccgcacttttttgaagagctctttccagaagaagtgccagaagagacagtagtctgcatacatcgctgcaggccacagagcagcttgggttggaagagagaagatgaagggacatccttggggctgtgccgtgagttttgctggcataggtgacagggtgtgtctctgacagtggtaaatcgggtttccagagtttggtcaccaaaaatacaaaatacacccaatgaattggacgcagcaatctgaaatcatctctagtcttgctttcacttgtgagcagttgtcttctatgatcccaaagaagttttctaagtgaaaggaaatactagtgaatcacccacaaggaaaagccactgccacagaggaggcgggtccccttgtgcggcttagggccctgtcaggaaacacacggggacctctctctctagctccagcaggtggcacctcggtacccagcgggtagggcgataatttatatattttccacagtcagggaaggactctcacttatttgtttcaaattgcagtttttataaaacatttttaaaacacaaatggcatgtatgctaatgagatttacccgtgtgctatctgtatttcccttgtacagaacttttacatttttgaatattcctattacttttgattgtgtctgatgggaactgagttgttggcctttgtgaaatgaaatttttggctcttgagaaagaattcttatgaattgttatgcgaattttatatatttaaagagggagatctggggctgttatttttaaacactttttttcataatacatattccgagtagatatttataaaatatatgtttctttcattatgtgtttgtaaaattagagtttaaataaatatgctttgatgcatagttttgaactaatgtaacatgatttttcttttttaaaacagcctgaaaatgtactagtgtttaaaaataaagatttccattttctcca

SEQ ID NO: 1159 - DNA, 1064 bp, Homo sapiens
ccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataagtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgactggccttatgtggtgaacattacatgctttcgacataaggtcaaccccaacgtgttcacagcacagagtaagcactcaaaaaatgaaagttgtattgctactactacttctgctgctgctgctggtgctacaatcttatgtgaactgggccacaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaat

SEQ ID NO: 1160 - DNA, 3039 bp, Homo sapiens
gctcatgctgctttcaatctcctggcatcaagcagtcctcccaccttggcctcccgaagttctggtacaagtgggagccaccatgcctgggcagaccctcagttctaaaaccgtcttggcttgtttaccatcagcccttcaccgtttcagaaagatgctgttcggagaacttgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataagtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgactggccttatgtggtgaacattacatgctttcgacataaggtcaaccccaacgtgaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaatgaagagagaggacatctacactttagatgaagagttacccaagagagtgaaagctcgattttccacagcctctgacatgcgatttgaagacacgttttatggagcagacattatccaaggggagagaaagagacaaagagtgctgagctccaggtttaagaatgaatatgtggccgaccctgtataccgcacttttttgaagagctctttccagaagaagtgccagaagagacagtagtctgcatacatcgctgcaggccacagagcagcttgggttggaagagagaagatgaagggacatccttggggctgtgccgtgagttttgctggcataggtgacagggtgtgtctctgacagtggtaaatcgggtttccagagtttggtcaccaaaaatacaaaatacacccaatgaattggacgcagcaatctgaaatcatctctagtcttgctttcacttgtgagcagttgtcttctatgatcccaaagaagttttctaagtgaaaggaaatactagtgaatcacccacaaggaaaagccactgccacagaggaggcgggtccccttgtgcggcttagggccctgtcaggaaacacacggggacctctctctctagctccagcaggtggcacctcggtacccagcgggtagggcgataatttatatattttccacagtcagggaaggactctcacttatttgtttcaaattgcagtttttataaaacatttttaaaacacaaatggcatgtatgctaatgagatttacccgtgtgctatctgtatttcccttgtacagaacttttacatttttgaatattcctattacttttgattgtgtctgatgggaactgagttg

SEQ ID NO: 1161 - DNA, 3021 bp, Homo sapiens
gtgcgcgtgcgcagcgaacagctgtcacctagtgcggaacaagtctcccaaatttcccaaatctccctgggccggaggccactgtcttctcttcctcctccaccgagtcgtgctctcgccccaacccgcgcgccagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaagatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatgaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataagtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgactggccttatgtggtgaacattacatgctttcgacataaggtcaaccccaacgtgaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaatgaagagagaggacatctacactttagatgaagagttacccaagagagtgaaagctcgattttccacagcctctgacatgcgatttgaagacacgttttatggagcagacattatccaaggggagagaaagagacaaagagtgctgagctccaggtttaagaatgaatatgtggccgaccctgtataccgcacttttttgaagagctctttccagaagaagtgccagaagagacagtagtctgcatacatcgctgcaggccacagagcagcttgggttggaagagagaagatgaagggacatccttggggctgtgccgtgagttttgctggcat

SEQ ID NO: 1162 - DNA, 3405 bp, Homo sapiens
atggctgacatgatggtctgtgacctgaaagttgttgaatagttggagtgttctgcattcatgtggaagaggctaaaggatgtttgatgaagcactatgggctgccctggaagaggactgaagaagcagctgcagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataagtgggcccatgtcatgtgcgccgttgcggtcccagaagttcgattcactaatgtcccagaaaggacacaaatagatgtaggcagaatacctttacagaggttaaaattgggaaggctgggaatctagacacagcaacagtaacaacaacaacaataacaatgaaggctcactgtgaaaacatcaattcattaggaaagttacatcccctccgccactgtttcagatgctgtttctcattctccatgggagcagccagcatcgtgtttaggatggggatacaatagcctgagctcctgattgagtcagaccctggactttcccttttgtatctgtcattttcctctggatcctcacacctttgtgtttaatttttttaaatttcatttgttgacttcctatgtggggtaaaatgacttcctttgattaatgtactttctgtatcctagagtttccctttccctttgtgatttagtccaacgtgtcctactacagcctcaaaaattgtcattggaatcaaaagctttccaaggtgcatcaggttaatgatttggatgcatcctgaggttgtctcctgtagcatggaggcattataataggagtctcagaagttacaccatttttctacagcacatcacaggcccagaggcttgaatctaagagaatccactctatgtctgtcagcctgaatccttccttcttgctgcacaacaaagcaactgaacgtattttgagtttaggtgaaaactatcactcattcatcaaagttctatctgggtgatatatgctatcgaaacagatgtggacactgggctgacagatgttgagaacggacctgttgctgaagctcatgttatcacacatgctgtgggaagagaggtcattggcattcaagatgcaacacctacaatatggtgaattaaagatgccatttgcatgg

SEQ ID NO: 1163 - DNA, 2778 bp, Homo sapiens
aatttcccaaatctccctgggccggaggccactgtcttctcttcctcctccaccgagtcgtgctctcgccccaacccgcgcgccagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaaggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataaaaatgcatcttctgcagacaccgggttaagagggtctctggagcctgcatccagtgttcctacggtcgctgcccggcctccttccatgtcacttgtgcccatgctgctggggtactgatggagcctgatgactggccttatgtggtgaacattacatgctttcgacataaggtcaaccccaacgtgaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtacc

SEQ ID NO: 1164 - DNA, 3833 bp, Homo sapiens
gccataggtgcgcgtcggcgcccaggaggacgtgtggcgcgtggactacatcaggtccagccctgcgggaccccagccagcgcttccgggcaaggttctgtgcacctgttttctccttctacgcgagtatctttcccctccggaaagaatgggatatgcctgtgtccaaaggacaagaagatgcgcgccagcaagcctaagttaaccacagcgcggaagttgagcccaaagcaagagcgtgccgggcacctttaagctgtttgtaagcccacgtgactcaccaagtgcgggccccagcggtcacgtgacggcgcgcgcgccctcgcgcagggagagccggcggtgcgcgcgccttcgccgctgcctcccacccaccccctcgacgggagggtgaggcgcggcgcagtgatcgggcggccggggtcctgtgcgcgtgcgcagcgaacagctgtcacctagtgcggaacaagtctcccaaatttcccaaatctccctgggccggaggccactgtcttctcttcctcctccaccgagtcgtgctctcgccccaacccgcgcgccagacactgccctaaccatcatggaggtggccgaggtggaaagtcctctgaaccccagctgtaagataatgaccttcagaccctccatggaggagttccgggagttcaacaaataccttgcatacatggagtctaaaggagcccatcgtgcgggtcttgcaaaggtgattcctcctaaggagtggaagccaagacagtgctatgatgacattgataatttgctcattccagcaccaattcagcagatggtcacagggcagtcaggactgttcactcagtacaacatccagaaaaaagcgatgactgtgaaggagttcaggcagctggccaacagtggcaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataagtgggcccatgtcatgtgcgccgttgcggtcccagaagttcgattcactaatgtcccagaaaggacacaaatagatgtaggcagaatacctttacagaggttaaaattgggaaggctgggaatctagacacagcaacagtaacaacaacaacaataacaatgaaggctcactgtgaaaacatcaattcattaggaaagttacatcccctccgccactgtttcagatgctgtttctcattctccatgggagcagccagcatcgtgtttaggatggggatacaatagcctgagctcctgattgagtcagaccctggactttcccttttgtatctgtcattttcctctggatcctcacacctttgtgtttaatttttttaaatttcatttgttgacttcctatgtggggtaaaatgacttcctttgattaatgtactttctgtatcctagagtttccctttccctttgtgatttagtccaacgtgtcctactacagcctcaaaaattgtcattggaatcaaaagctttccaaggtgcatcaggttaatgatttggatgcatcctgaggttgtctcctgtagcatggaggcattataataggagtctcagaagttacaccatttttctacagcacatcacaggcccagaggcttgaatctaagagaatccactctatgtctgtcagcctgaatccttccttcttgctgcacaacaaagcaactgaacgtattttgagtttaggtgaaaactatcactcattcatcaaagttctatctgggtgatatatgctatcgaaacagatgtggacactgggctgacagatgttgagaacggacctgttgctgaagctcatgttatcacacatgctgtgggaagagaggtcattggcattcaagatgcaacacctacaatatggtgaattaaagatgccatttgcatgg

SEQ ID NO: 1165 - DNA, 2978 bp, Homo sapiens
aaggggcggggccgaagcggcccagggggcgggcgtttgaaatcagtgccttagagtagaccctaaacctcattttataccttcaagaaccaattacttaatgtctcttccgtcttttccgtccccgaccccctcccagactccttcattccggtactgcgtggacggaaagccccgggtagccgacaccacgtccccggctagcgggagagagcgtggaaaaggattacaccaaactgtttaaatccaacgactcctgcttccatcctttctcctgagctagaaccaacaaacctagagagttgggcttcggaaaaactagtgttttcatttaattggatatgaagaaagaacaaatatgtacggggcaaccacgatctttacaaagaacataagttccaggaaagcaggaaccttgtctctcttgttcactgggtgtatcctctgcatatagaacagtgcctggcacataataggtgctgaattttgttctaaacactgaggacattctctgctacatttgggtcgtacccccaggtctgagtaattcaatagacttaagaagacagagcccagcagcaaccgaaacataacagagttgcaggatcagctaacgtcaatgcctgggcaaagctgctgcccagagtggaatctcactagtgaataaacaagcccaagaaagattatcatctcatttgcaaaaaaaaaagtacgctggtagatcctgctacctcatagataacaccagtcaaatttttttttaaagtagcattttcctacattgtcaactatctagaacatacctaaaaactaagagtttactgcttattaaatggaaactatgaagtctaaggccaactgtgcccagaatccaaattgtaacataatgatatttcatccaaccaaagaagagtttaatgattttgataaatatattgcttacatggaatcccaaggtgcacacagagctggcttggctaagataattccacccaaagaatggaaagccagagagacctatgataatatcagtgaaatcttaatagccactcccctccagcaggtggcctctgggcgggcaggggtgtttactcaataccataaaaaaaagaaagccatgactgtgggggagtatcgccatttggcaaacagtaaaaaatatcagactccaccacaccagaatttcgaagatttggagcgaaaatactggaagaaccgcatctataattcaccgatttatggtgctgacatcagtggctccttgtttgatgaaaacactaaacaatggaatcttgggcacctgggaacaattcaggacctgctggaaaaggaatgtggggttgtcatagaaggcgtcaatacaccctacttgtactttggcatgtggaaaaccacgtttgcttggcatacagaggacatggacctttacagcatcaactacctgcaccttggggagcccaaaacttggtatgtggtgcccccagaacatggccagcgcctggaacgcctggccagggagctcttcccaggcagttcccggggttgtggggccttcctgcggcacaaggtggccctcatctcgcctacagttctcaaggaaaatgggattcccttcaatcgcataactcaggaggctggagagttcatggtgacctttccctatggctaccatgctggcttcaaccatggtttcaactgcgcagaggccatcaattttgccactccgcgatggattgattatggcaaaatggcctcccagtgtagctgtggggaggcaagggtgaccttttccatggatgccttcgtgcgcatcctgcaacctgaacgctatgacctgtggaaacgtgggcaagaccgggcagttgtggaccacatggagcccagggtaccagccagccaagagctgagcacccagaaggaagtccagttacccaggagagcagcgctgggcctgagacaactcccttcccactgggcccggcattccccttggcctatggctgcccgcagtgggacacggtgccacacccttgtgtgctcttcactcccacgccgatctgcagttagtggcactgctacgcagccccgggctgctgctgtccacagctctaagaagcccagctcaactccatcatccacccctggtccatctgcacagattatccacccgtcaaatggcagacgtggtcgtggtcgccctcctcagaaactgagagctcaggagctgaccctccagactccagccaagaggcccctcttggcgggcacaacatgcacagcttcgggcccagaacctgagcccctacctgaggatggggctttgatggacaagcctgtaccactgagcccagggctccagcatcctgtcaaggcttctgggtgcagctgggcccctgtgccctaagtccacgggctgtctttatatcccactgccctgctgtgtgacagtttgatgaaactggttacatttacatcccaaaactttggttgagtttgcaggactctaggcatgcatgaaagagcccccctggtgatgcccttggatgctgccaagtccatggtagttttcaattttgccatacttttgttcttcctaccggaccctggaatgtctttggatattgctaaaatctatttctgcagctgaggttttatccactggacacatttgtgtgtgagaactaggtcttgttgaggttagcgtaacctggtatatgcaactaccatcctctgggccaactgtggaagctgctgcacttgtgaagaatcctgagctttgattcctcttcagtctacgcatttctctcttcccctccctcaccccctttttcttataaaactaggttctttatacagataaggtcagtagagttccagaataaaagatatgacttttctgagttatttatgtacttaaaatatgttgtcacagtatttgttcccaaatatattaaaggtaaccaaaatgttaaaatctg

SEQ ID NO: 1166 - DNA, 2339 bp, Homo sapiens
ccaagcctgagaatcaggagaagcctcacagtgacacccccaactgaggaaactcacagagctgggacatactctacttcttcagaaaaaagtatactgactagagtggagtccccctggggagtcagaaagcctgtgaaagatctcacttgttcaaaagtccaagtgtgaattactgtctcacagataaaccaaagtattttgaaaaacaaaggggagaaaagaaattactccccagaactctcaggcatctagaggacacccaagaacgtgggagtcagctgcttcttgtgtgcagccatgaagtctgtgcactccagtccccagaacacgagtcataccatcatgacgttttacccaaccatggaagaatttgcagatttcaacacatatgttgcttacatggagtcccaaggcgcacatcaagctggccttgccaaggtaattccacccaaggaatggaaagccagacagatgtatgatgatatcgaagacatcttaatagccactcccctccagcaggtgacctctgggcagggaggtgtgtttactcaataccataaaaagaagaaagccatgagggtggggcagtatcgccgcttggcaaacagtaaaaaatatcagactccgccacaccagaattttgcagatttggagcaacgatactggaagagccaccccggtaatccaccaatttatggtgctgatatcagcggctccttatttgaagaaagcactaaacaatggaacctaggacacctgggaacaattctggacctgttggagcaggaatgtggggttgtcatcgagggtgtcaacacaccctacctgtactttggcatgtggaagaccacgtttgcctggcacacagaggacatggacctttacagcatcaactacctgcactttggggagcccaaaacttggtacgtggtgcccccagaacatggtcagcacctggaacgcctggccagggagctcttcccagacatttctcggggctgtgaggccttcctgcggcacaaagtggccctcatctcgcctacagttctcaaggaaaatgggattcccttcaattgcatgactcaggaggctggggagttcatggtgacctttccctatggctaccatgctggcttcaatcacggcttcaactgcgcagaagccattaattttgccactccacgatggattgattatggcaaaatggcctctcagtgtagctgtggggagtcgacagtgaccttttccatggacccctttgtgcgcattgtgcaacccgagagttatgagctctggaaacacaggcaagacttggccattgtggaacacacagagcccagggttgcagaaagccaagagctgagcaactggagagatgatatagtacttagaagagctgctctgggcctgaggcttctcccaaacctcacagcccagtgtcccacacagcctgtgtcctcagggcactgttacaacccaaaaggctgtggcactgatgctgtgcctggatccgcattccaaagctctgcatatcatacccagacccagtcacttaccctggggatgtcagccagggttcttctcccttccactggaagctggggttctggtcgtggtcgtggtcgtggtcaaggtcaaggtcgaggttgcagtcgtggtcgtggtcatggttgttgtactcgagaactggggactgaggagccaactgttcagcctgcatccaagaggcgccttttaatgggtacaaggagtagagctcaaggccacaggcctcagctcccgcttgccaatgatttgatgacaaatctgtccctttgagtggtggccttcagcatcttgccaaggcttctggctgctgctgtgtccctgatcttcaactcctggggcccccactggatcgtgatgaaaccatgcaccctggcctgtgcctgctatccctcaacagcactactagtaatctccctgatgttgtctgcatgactcctcccaatgtcattgtgcctttgattaagttttccagggacactggtggggactggaactgattaagttcaccagggacacttgcctggtgaacatgggcaaggctgtagcaatggaccacttttacggctctagggttctgactccaactaagttttccagaatctcctgggctcctgactcatctgctgggtctaaagacactgagtttagggatattttcctccaatacatgatcaatcctctggatccacggctatggaatatggtgacaaatgtcagtgtctctcttattccaaccccaggatcagagaagattctttacctgcagtaactgacacatttccaaggcc

SEQ ID NO: 1167 - DNA, 2767 bp, Homo sapiens
ggagagagagaaagaaagagagagggagagagagagacagagagagttagaggaaagaagagagagcgagcacgaggaaggggggcgggggagagaagcagggggagagcggggcgagaaagaggtcggaggggagaggagggggagagacgactcagaaagtggaatctgtaaaagcaagctagaggagaagaaggaaaaccctgaatcgttataactacaccccagatgcaacgcaagcaacgacttcgtcacactaaaacggattttgtgagggccaaaagtataaattacgaagcagaaatgattatcaaacaacttccagcggtttgcacctaaagaaacacaaggagaacccactacaaacaaacaaacccagtccaaacaacgcctccagtaggaaaagaggaaaactgcgataacacgaccccccgagaagagacgagaccaacacgctgagactgtggggcgtcagcaaacctccaagtgcacggcggactgagttgtacttcgcagctctctggacattaattacctcctgcaccttccatttgggggagggtgaggaagaaggcactcacctacactgagcgaagaagtcctatcagcgtggaagagaagtttaagaatgaaccactgaatgtttcgcttttatttttaaatttactttggcacttaaaaaacctcatttccagatttctggacaatctcggctgcagacatctaagcctaaccttttggtatcctgagttttttccctctccttctccttcctcacgcccaccccgcttctctcgcacacggtcatctttacatatcaagagaaagcaaaaaggttccaagaggtacttttctttttagaaaatcaccttttctcccctaattcttctgcagaagaaaagaggtttcgaaagagggaaaaggaaaaaacaagccggctacggtatcagccggtcagcccaggtggaaaacgagagtgaaagtagggcttaacggggagcgcaccgcctctttcgaaagccgctgggccaccaccagtgcgtgagccttggatccctcaacgtattgcgagacgccggtgtatagcccggacctgtgccccaacatgatcgccgctcaggccaagctggtttaccagctcaataagtactacactgagcgctgtcaggcgcgcaaggcggccatcgccaaaaccatccgagaggtctgtaaggtggtctcggacgtgctcaaggaagtggaggtgcaggagcctcgcttcatcagctccttgagcgagatcgatgcccgctacgaggggctcgaggtcatttcgcccaccgaatttgaggtggtgctctacctaaaccagatgggcgtcttcaacttcgtggacgacggctcgctgcccggctgcgcagtgctcaaactgagcgatgggcggaagcggagcatgtctctctgggtcgagttcatcacggcgtcgggctatctctcagcgcgtaagatccgctcgcgtttccagacgctggtggcccaggcggtggacaagtgcagctatcgggatgtggtcaagatgatcgcggacaccagcgaggtcaagttgcgcatcagggagcgctatgtggtgcaaatcactccggcgttcaagtgcaccgggatctggcctcgcagcgcggcacagtggcctatgccccacatcccttggcccggccccaatcgggtggccgaggtcaaggccgaagggttcaacttgctctcgaaggagtgctactcgctgaccggcaagcagagctcggcagagagcgacgcctgggtgctacagttcggggaggcggagaaccgcctgctgatgggcggctgccgaaacaagtgcctctcagtgctgaagactctgcgggaccgccacctggagctacccggccagccgctcaacaactaccacatgaagacgctgctgctgtacgagtgcgagaaacacccacgagaaacggactgggacgagtcgtgcctgggcgaccggctcaacggcatcctgctgcagctcatctcctgcctgcagtgccgccgctgccctcactactttctgcccaacctcgacctctttcagggcaagccccattcggccctggagagcgctgccaagcagacctggaggttggccagggaaattctcaccaatcccaaaagcctggacaaactatagggtgctggggactgcttgaaaagcgacacaaacgggcgtgctctctcagacacacaactctgctataaacagcagaaactctggacacaaacttttatgtaagtcacctgaaataggaatccggcagaagaccttcattaattaagaagcaaacaaaaagagagcaacccaaccaaaacaaatcacattcttgcacaaaagtgatcgttttcttccaaacaatgtgaatttaaaaggtcacacaaaagaagcaatcgggctccgccaccacaaaatgaaacccaaggtacattttcaaatcaatgtatagtagttccccccccttttccttctttccccctatcctttttctctccaccccatccccccccccatttcgttttgcttttggttgcctgaatgttgtcaccaagtgaaaaaattatttaactatatgtaaaatttctcttttaaaaaaaagttttactgatgttaaacgttctcagtgccaatgtcagactgtgctcctccctctcctgaacctctaccctcaccctgagctgtcttgttgaaaacagtaataaaaacattactttacattgt

SEQ ID NO: 1168 - DNA, 800 bp, Homo sapiens
gtggtgacgcacttattccgcgcgatgacgtcactgcaaggcgccgggggacacgttggctgcgttttcggcgggcttcccgggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtcatgatcagaaaagaggcttatgtgcacaagagtgtaatggaagaactgaagagaattattgatgacagtgaaattacaaaagaagatgatgctttgtggcctccccctgatagggttggccgacaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcttaatggttatccttacttgagtccatatgggttggacagtccccacacacattaaattctgtaaatgaaagccaccttttgttaaaaatttgctctaataaaacataccaaatcctg

SEQ ID NO: 1169 - DNA, 660 bp, Homo sapiens
gtcactgcaaggcgccgggggacacgttggctgcgttttcggcgggcttcccgggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtcatgatcagaaaagaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcttaatggttatccttacttgagtccatatgggttggacagtccccacacacattaaattctgtaaatgaaagccaccttttgttaaaaatttgctctaataaaacataccaaatcctg

SEQ ID NO: 1170 - DNA, 1281 bp, Homo sapiens
tttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatag

SEQ ID NO: 1171 - DNA, 3900 bp, Homo sapiens
ggagcggggacccagccccgccgcgccgcctgcagctttccccagcctcctcccagcagaggggaggcccgacagggaggggtcccatcctcatgaacggtcacaaacagggcgctagggaagcacgcccgacccccgcggtccccgcgctccaggattcggcagactgcgcgcgtcctgcctcccgcggatcgcactgggtcccaacagggttcccagctccaggctgcgcccatgaacaagcccagcattgcggacgggcgcgcgcagacgccagcgtggtgaagacgcgggggcgcgcgcgcggcgacgagactgccaggggacgcttcgcaacaccgagagtctcagcgtttctcgagataggtgaggctgcgcgttccggaactggtttcccggaaggagcatgtctgcgcccgcgatccgaccggaagttgcacgctgagccgcggacaccatgcagtcggatgatgttatctgggatacactaggaaacaagcaattttgttccttcaaaataagaaccaagactcagagcttctgccgaaatgaatatagcctgactggactgtgtaatcggtcatcctgtcccctggcaaatagtcagtatgccactattaaagaagagaaaggacagtgctacttgtatatgaaggttatagaacgagcggcttttcctcggcgtctctgggaacgggtccggcttagtaaaaactatgagaaagcactggagcaaatagatgaaaatctgatttactggccccgtttcattcgacacaaatgtaagcagagattcaccaagatcacccaatacctaattcgaattagaaaacttacactaaagcgacagaggaaacttgttcctttgagtaagaaggtggagcgtagggagaaaagaagagaggaaaaggcattaatagctgctcagctggacaatgccattgagaaggaattactggagagactgaaacaagatacgtatggcgacatctacaacttccccattcatgccttcgacaaagccctggaacaacaggaggcagagagtgactcttcagatactgaggaaaaagatgatgatgatgatgatgaggaagatgtggggaaaagagaatttgtcgaagatggtgaggtagatgagagtgacataagtgattttgaggatatggataaactggatgccagcagtgatgaagatcaggatggtaaatcctccagtgaggaggaggaagaaaaggcccttagtgcgaaacacaaaggcaaaatgcccttgagaggaccactgcagagaaaacgagcctatgtggaaatagaatacgagcaggagacagagcccgtggccaaagccaaaaccacgtgatttccctttcagcatttatacccaggactgaacatgcagaactgttttttttttttttttatcttaaacacatacacacctccagtttttgctcttttgtgttgtactgaacacaatatttgtgtttttattatttatgccacgtcagtggggcaagaaatctggagtgagtgaagaaagctaagttgtgaacaagagtgtttttatagcatatgtgttgaagtaacagcttgtgcccgagaaacttaacagatgagttcttgaatctgggatgagatgacggatgtaaatatttctaaattttaaatgctacattacttggtgtccttttttctcccaaactttatttagaaatggaaggagttcaattttttcttgttctactttccctattcttatggaggtaaaaggaaaggaaggaaggaaaaagcagctttcacttacaaagtttcgtgtaaaaatatctttttttcttaaataactccattcatacaaattgggatgggaagaaaatcctttcctcttgggaaagtaatacaagtcttaagttccattgtagggtgcgccttcagaaacctgctgcacttttctgatatagttcaccacttttctgtcttcacagctttggggaattttggccaggagaccctgaaacatgaaaccaaacaggctttgatatttttttttttttaattactttccccttttgcttgattcttcttccttggtatcatattcaaaggaggaaagaatggatgacacttagggacaggtcactaagcagaataggtattagttggttttttattatttttaaatttatatagctctcatgtattgaaggtgctactttaaaaactgtgttaatgtacttgcaaatctcctgctggctcatgaaacagcagaattccagccaaggcaaattcagttggatctagggcttgaaaactgcccaagattaaagagctaagatgaaatagtttgaataaactggtaaaataacaattcatactatctctacatatttttaggatatgaatttttttttcctgctgggtagattgtccagtgacttatggcatgaatttcttttcatgctaccttcaatcttcaactaaagatttctaaaaggggtaagaaatgaggcagtagtttattaaatacatagaagtacacagctattatatgctgtggctttgagaagttaacttttgtggaatatgaaaccaaaggaagaatttccatgtagataaattaagaatagggaaaaacatctacctaaaagatggttgtccctaaaaaactggaaacatctgaaatgctctatttatgttattattcctgggagcttatagcccattatttttactttttttttttaattcagaagactagaacagaacttaaattttacaaacttttgatcataatgcttttgcccatactgtctcgtccttagccccagtgacatgtgctgatcctcctgcctttagttctaaatggttctgaatagctttaaaagatgaataagaaaaaagatcaagctcttttgaggctagagggctcatatggagatctaaaaccctccatgttcatttccagacttggtcaggcacatacatagtaaattataatcaatcatgggaattacataaggataatgaggcccaactgaaaccaagtttcagtctgccttacctttacccgtccttgagaacagcggtccaggagaatcaggcagtctgtggcctcctgtagcagggcgctcttaacagactcaggtgtaaggtttggatcccttgctacatcacaaatcagtttcaagagggccttcagtaagaccacaagtctgcaggaaactctggaatcaggaagaaaagctatgttcatactctaaatctggatattaaaattggaagagacttcaaagactgtcaagtggaaagctatcatttcctaaattaaggaacttaggtcaaagttaaatgaaaaagacctaaaaacagaaccaaagacagcctctagatttcttaccctcaagtctcctgttagcatactgcctatacacacagacacaccctctgccacactgctctcttccttccagaagcttggttctactgtaagcaacagctccttcatgggctgagaaggggaaaccaggatctccccaaccaagggcctatacttttatttttcaactctattaactgaactatgcttggagagagccctgaatcctttaactttaatgccatcttaggcctggaagttagagtgagggaaatgagcttggcttctgggactgtgtcaagttgaattttctgtcatttaatttcagatcctagctcatcatcagtgaagtccagcctacttacttgtaactattaacctttctaaaagttttcatcgccttggtaaagctccagaaatggacaatgctagtgactgcacaatattgtgactgtacttaatgccactgaactgtacactttaaaatggaaaatttatatgtatttttaccacaataaacaaaaaac

SEQ ID NO: 1172 - DNA, 3815 bp, Homo sapiens
agtcctcgaccccccgcacctcgccccttccccaccccctcctccgcctcggtgcccggcgctgctccggaccactatgaccatgagatccgcggtgttcaaggcggccgcggcccctgccggcggcaatcctgagcagcgactggactacgagcgggctgcggcgctgggcgggcccgaggacgagcctggggcggccgaagcccacttcctcccccggcaccatccttctgctgcaattggacctcatcgaacagcagcagcagcagctgcaggccaaggaaaaggagatcgaggagctgaagtcagagagagacacgctccttgctcggattgaacgtatggaaaggcggatgcagctggtaaagaaggataacgagaaagaaaggcacaagctgtttcagggctatgaaactgaagagagagaggaaacagagctatctgagaaaattaaactggagtgccagccggagctttccgagacatcccagactctgcctcccaagcccttctcatgtgggcggagtggaaagggacataaaaggaaatccccatttggaagtacagaaagaaagactcctgttaaaaagctggctcctgaattttcaaaagtcaaaacaaaaactcctaagcactctcctattaaagaggaaccctgtggttccttatctgaaactgtttgtaaacgtgaattgaggagccaagaaaccccagaaaagccccggtcttcagtggacaccccaccaagactctccactccccaaaagggacccagcacccatcccaaggagaaagccttctcaagtgagatagaagatttgccgtacctttccaccacagaaatgtatttgtgtcgttggcaccagcctcccccatcaccgttaccattacgggaatcctctccaaagaaggaggagactgtagcaaggtgtctgatgccatcaagtgttgcaggagaaacttcagtcttggctgttccttcttggagggaccactcagtagagcctctaagggacccaaatccttcagaccttttggagaacctggatgacagtgtgttttcgaagcggcatgcaaaactggagctggatgagaagagaaggaaaagatgggatattcagaggatcagggaacaaagaattttacagcgactgcagctcagaatgtataaaaagaaaggaattcaggaatctgagcctgaggttacctcatttttccctgagccagatgatgttgaaagtttgatgattacccccttcttgcctgttgtagcatttggacgaccattaccaaaattaactccacagaattttgagctaccctggttggatgagcgtagccgatgcagattggagatccagaagaagcaaacacctcaccggacgtgtaggaaatagctgtgctggcaagaaccctgtcttcagatagttgtagcatgccattcccgagagtggcagagacctgtatatgtgacctttgtcctcacatatgttatcactcgctgataataccctttcatacttccttgactttgttttcattactctgatttcacaaaaactctttcattcggctaattgtgagttatggagggtgattgggatttcttttcccttttttgggaaatgggctctcaagctaaagctataggatggcagattcagaagtttcaggggtctgtttctatacatttgcctatgttaaaggggtaaaagggctctcttcattagacatgtggaagatgaagcagccccttcctttagagctgtgcctgcatggcactcttctcaccctggtacaccctccttatagtgggtatagtgatttttaaccctaaaataaaacaaacaacctcaccatgagctttaggaccagaagaggaatgacaagtgaagcgatgaagcaagccatcttcacagagtagaaaagacatcggagagttggtagataactgtctgaaaagatagttgttcatttgaaactattctgtgatacagtcatgtgggaagggatgtttggctgtgattattttttcagttaatggataacaatttctttactgctcaaaaaccaaaatctttggaaaagaaagtggggatggttagtttcagaacaagttacagctgtaaacaaaagcacttagtatttgggatggcatgccaaaacctgtataaatgtccttgtatcacatcacttctcaagtattccttcattgggcttcatccttttagcagaactcttggtggtgggatagagacttagggagggtagggggagagtgtggaaataggtgcttcctttggctggcaaatgtctacatcttgaaacaaacagatgtacctaatgagcttctccattcactttgtaaaaataatttgtatgtgtaccatcttggtcctctcccctcccgttttgttaaaatatcaggatagcactcccaggccactttggtctcagtgtaagatccctattaactatctgaaaggaaaatagagccaagacctctggtctcaaatatataggaattgcctttctttagtcttcaggactattgtgtgaaaacaagtaggggtctaatctcctagaaggtaggggcttttatccttaaagagaatatgtccccagattattagcacttttagaggagaagccaaggtatgtagggtgtgtggctggcccatcagtggagcacgaagagagaatgggataccattgtgggaagagaagaaaagttcctcaggggcctcccactgctaaagttttttgtgagatgttgatctgtgcttcctggatttgacttttaaaggaattattctggcagcacatgtagtattcttggatgatcttgctgctcttatttctccttttgtgtgtgtgtgtgtgtgtgtgtggctatgggttttcatttgtaactccatctgcttaggagagtgggctctctataagggaacctgctgtaaacttcattgcagcaaggatgtagagagaaataggacttaattccactaggggctctcatctcacaccttaaggaggagatttctagaaaaactgggccagattttctttgttctccatcattttaatgtggcaggctgttcagttttcttactcttacctatgtgatatttcttcgtaacgtgtccaaaaagaaaaaagacccaatcagtgtctcttgactttgttctttgatccctcagtttcttcttgatttcagcatgtgtcgggttcctaattttgggtatgagttagcaaatttaaccattgtgtttgtgccctacccaggggactccccagtttctgacttgaagtagactgagaagaatccacgaggtgctatctggccagatttaagtagattctatttccttggttctccctctccctgaggacctcttattttattgtcccctcttctaggttaattctcctttgatttgactttgttgagaaggaggttggacagtagattagcaaagttccaagtgcaaaattacagtgtgttagagtgtggggggaaaattagtcttatttttccctacatgggatacaacactgtgaattcaatcttcaactgaaggccctgcagttctcctaaaacatagttgtttgtttttctttaacaaagtttaagctagtgttaataaattaaaaaaaattgcttgtctgtctacttcagctttgttttatgcccatttcatattgttgtctgtgttgtaattcataacttttgataccatttctgatgtgtaaaattggttgtcttgtaaatatcttataaagagttcaattgtaaataaactattgtggctgtt

SEQ ID NO: 1173 - DNA, 4263 bp, Homo sapiens
atgaccatgagatccgcggtgttcaaggcggccgcggcccctgccggcggcaatcctgagcagcgactggactacgagcgggctgcggcgctgggcgggcccgaggacgagcctggggcggccgaagcccacttcctcccccggcaccgtaagctcaaggagccggggcccccgctggcctcctcccagggcgggagccccgcgccttccccggccggctgcggcggcaagggccggggcttgttactcccggccggggcggcccccgggcagcaggaagagagctggggcggttcggtgcccttgccctgtccgcccccggccaccaagcaagccggcattgggggggagcctgccgcagccggagccggctgcagcccccggcccaagtatcaggcggtgctgcccattcagacgggctctctcgtggcggcggccaaagagcctacgccctgggctggggacaagggtggggcggcctcccccgctgccaccgcctcggacccggcgggacccccaccactacctctgcccgggccgccacccctcgcgcccaccgccaccgccgggaccctggcggccagcgagggcagatggaagagtatgaggaagagccctctcgggggtggtggcggctcgggagcctccagtcaggccgcctgcctcaaacagatccttctgctgcaattggacctcatcgaacagcagcagcagcagctgcaggccaaggaaaaggagatcgaggagctgaagtcagagagagacacgctccttgctcggattgaacgtatggaaaggcggatgcagctggtaaagaaggataacgagaaagaaaggcacaagctgtttcagggctatgaaactgaagagagagaggaaacagagctatctgagaaaattaaactggagtgccagccggagctttccgagacatcccagactctgcctcccaagcccttctcatgtgggcggagtggaaagggacataaaaggaaatccccatttggaagtacagaaagaaagactcctgttaaaaagctggctcctgaattttcaaaagtcaaaacaaaaactcctaagcactctcctattaaagaggaaccctgtggttccttatctgaaactgtttgtaaacgtgaattgaggagccaagaaaccccagaaaagccccggtcttcagtggacaccccaccaagactctccactccccaaaagggacccagcacccatcccaaggagaaagccttctcaagtgagatagaagatttgccgtacctttccaccacagaaatgtatttgtgtcgttggcaccagcctcccccatcaccgttaccattacgggaatcctctccaaagaaggaggagactgtagcaaggtgtctgatgccatcaagtgttgcaggagaaacttcagtcttggctgttccttcttggagggaccactcagtagagcctctaagggacccaaatccttcagaccttttggagaacctggatgacagtgtgttttcgaagcggcatgcaaaactggagctggatgagaagagaaggaaaagatgggatattcagaggatcagggaacaaagaattttacagcgactgcagctcagaatgtataaaaagaaaggaattcaggaatctgagcctgaggttacctcatttttccctgagccagatgatgttgaaagtttgatgattacccccttcttgcctgttgtagcatttggacgaccattaccaaaattaactccacagaattttgagctaccctggttggatgagcgtagccgatgcagattggagatccagaagaagcaaacacctcaccggacgtgtaggaaatagctgtgctggcaagaaccctgtcttcagatagttgtagcatgccattcccgagagtggcagagacctgtatatgtgacctttgtcctcacatatgttatcactcgctgataataccctttcatacttccttgactttgttttcattactctgatttcacaaaaactctttcattcggctaattgtgagttatggagggtgattgggatttcttttcccttttttgggaaatgggctctcaagctaaagctataggatggcagattcagaagtttcaggggtctgtttctatacatttgcctatgttaaaggggtaaaagggctctcttcattagacatgtggaagatgaagcagccccttcctttagagctgtgcctgcatggcactcttctcaccctggtacaccctccttatagtgggtatagtgatttttaaccctaaaataaaacaaacaacctcaccatgagctttaggaccagaagaggaatgacaagtgaagcgatgaagcaagccatcttcacagagtagaaaagacatcggagagttggtagataactgtctgaaaagatagttgttcatttgaaactattctgtgatacagtcatgtgggaagggatgtttggctgtgattattttttcagttaatggataacaatttctttactgctcaaaaaccaaaatctttggaaaagaaagtggggatggttagtttcagaacaagttacagctgtaaacaaaagcacttagtatttgggatggcatgccaaaacctgtataaatgtccttgtatcacatcacttctcaagtattccttcattgggcttcatccttttagcagaactcttggtggtgggatagagacttagggagggtagggggagagtgtggaaataggtgcttcctttggctggcaaatgtctacatcttgaaacaaacagatgtacctaatgagcttctccattcactttgtaaaaataatttgtatgtgtaccatcttggtcctctcccctcccgttttgttaaaatatcaggatagcactcccaggccactttggtctcagtgtaagatccctattaactatctgaaaggaaaatagagccaagacctctggtctcaaatatataggaattgcctttctttagtcttcaggactattgtgtgaaaacaagtaggggtctaatctcctagaaggtaggggcttttatccttaaagagaatatgtccccagattattagcacttttagaggagaagccaaggtatgtagggtgtgtggctggcccatcagtggagcacgaagagagaatgggataccattgtgggaagagaagaaaagttcctcaggggcctcccactgctaaagttttttgtgagatgttgatctgtgcttcctggatttgacttttaaaggaattattctggcagcacatgtagtattcttggatgatcttgctgctcttatttctccttttgtgtgtgtgtgtgtgtgtgtgtggctatgggttttcatttgtaactccatctgcttaggagagtgggctctctataagggaacctgctgtaaacttcattgcagcaaggatgtagagagaaataggacttaattccactaggggctctcatctcacaccttaaggaggagatttctagaaaaactgggccagattttctttgttctccatcattttaatgtggcaggctgttcagttttcttactcttacctatgtgatatttcttcgtaacgtgtccaaaaagaaaaaagacccaatcagtgtctcttgactttgttctttgatccctcagtttcttcttgatttcagcatgtgtcgggttcctaattttgggtatgagttagcaaatttaaccattgtgtttgtgccctacccaggggactccccagtttctgacttgaagtagactgagaagaatccacgaggtgctatctggccagatttaagtagattctatttccttggttctccctctccctgaggacctcttattttattgtcccctcttctaggttaattctcctttgatttgactttgttgagaaggaggttggacagtagattagcaaagttccaagtgcaaaattacagtgtgttagagtgtggggggaaaattagtcttatttttccctacatgggatacaacactgtgaattcaatcttcaactgaaggccctgcagttctcctaaaacatagttgtttgtttttctttaacaaagtttaagctagtgttaataaattaaaaaaaattgcttgtctgtctacttcagctttgttttatgcccatttcatattgttgtctgtgttgtaattcataacttttgataccatttctgatgtgtaaaattggttgtcttgtaaatatcttataaagagttcaattgtaaataaactattgtggctgtt

SEQ ID NO: 1174 - DNA, 1401 bp, Homo sapiens
tgaccatgagatccgcggtgttcaaggcggccgcggcccctgccggcggcaatcctgagcagcgactggactacgagcgggctgcggcgctgggcgggcccgaggacgagcctggggcggccgaagcccacttcctcccccggcaccatccttctgctgcaattggacctcatcgaacagcagcagcagcagctgcaggccaaggaaaaggagatcgaggagctgaagtcagagagagacacgctccttgctcggattgaacgtatggaaaggcggatgcagctggtaaagaaggataacgagaaagaaaggcacaagctgtttcagggctatgaaactgaagagagagaggaaacagagctatctgagaaaattaaactggagtgccagccggagctttccgagacatcccagactctgcctcccaagcccttctcatgtgggcggagtggaaagggacataaaaggaaatccccatttggaagtacagaaagaaagactcctgttaaaaagctggctcctgaattttcaaaagtcaaaacaaaaactcctaagcactctcctattaaagaggaaccctgtggttccttatctgaaactgtttgtaaacgtgaattgaggagccaagaaaccccagaaaagccccggtcttcagtggacaccccaccaagactctccactccccaaaagggacccagcacccatcccaaggagaaagccttctcaagtgagatagaagatttgccgtacctttccaccacagaaatgtatttgtgtcgttggcaccagcctcccccatcaccgttaccattacgggaatcctctccaaagaaggaggagactgtagcaaggtgtctgatgccatcaagtgttgcaggagaaacttcagtcttggctgttccttcttggagggaccactcagtagagcctctaagggacccaaatccttcagaccttttggagaacctggatgacagtgtgttttcgaagcggcatgcaaaactggagctggatgagaagagaaggaaaagatgggatattcagaggatcagggaacaaagaattttacagcgactgcagctcagaatgtataaaaagaaaggaattcaggaatctgagcctgaggttacctcatttttccctgagccagatgatgttgaaagtttgatgattacccccttcttgcctgttgtagcatttggacgaccattaccaaaattaactccacagaattttgagctaccctggttggatgagcgtagccgatgcagattggagatccagaagaagcaaacacctcaccggacgtgtaggaaatagctgtgctggcaagaaccctgtcttcagatagttgtagcatgccattcccgagagtggcagagacctgtatatgtgaccttt

SEQ ID NO: 1175 - DNA, 4692 bp, Homo sapiens
gcacttcctccccggccttcccctccgggttgaggactcccgcccgcctcgccacctcggggaactgcgggctgcaacccacggggcggagagccagggcgcagtctgggccccgcgtccgatatggagagcgcggcggcggcgtccgccagccgcaacatcaaccttcgtcgccgccgcggcgtcttgcactagatccgggaagccgctgcccgaccgtcgtccttgccgtcgccgccgcctccgcgccctgtactgggatggagtaagaggccctgcagcccgggagaagcgtgccgcgcctcagacggggccggggcctgctcccgcgcctgccagctcgacttgaggaggcgcctccgtgtccggagatggagctcgagtgcaggccgcctgccgagccgcggggctagactgagctccgagtcccgccccgagcgcccaagccgccgcgttctgcgctctgtggtcgctccggacgaactcgaacgctggtttctctctcatatttttggtctggaagtctcagggacggaggggcgccaaggccccatgtgtgggaggattgtttcagctccacaaacttgcacggattttggttacttgtttggccaatggttcggctctgatttcttccgaattgttgcaaattcgccatcgttccctggctgcttactaagttggatccggaatttcttttcaaccgggagccattggtgtcgaagtgtctgcaatgaaccccgtgaatgctactgctctctacatttccgcgagccgcctagtgctcaactacgaccccggagaccccaaggcgtttactgagattaacaggctcttgccttacttccgacagtccctttcgtgctgtgtttgcggacatttgctacaagatcctattgcacccaccaactccacctgccaacattatgtctgcaaaacttgtaaaggcaagaaaatgatgatgaaaccttcctgtagctggtgcaaagactatgagcagtttgaggaaaacaagcagttaagcatcctagtgaactgctacaaaaaactatgcgagtatataacacagactacactggcacgggatataatagaagcagttgactgttcttctgatattttggctttgcttaatgatggatcattgttttgtgaggagacagaaaaaccctcagattcatcctttactttgtgtttgacacattcccctttaccttcaacctcagaacccacaactgatcctcaagctagtttatctccaatgtctgaaagcaccctcagcattgctattggcagttctgttatcaatggtttgcctacttataatgggctttcaatagatagatttggtataaatattccttcacctgaacattcaaatacgattgacgtatgtaatactgttgacataaaaactgaggatctgtctgacagcctgccacccgtttgtgacacagtagccactgacttatgttccacaggcattgatatctgcagtttcagtgaagatataaaacctggagactctctgttactgagtgttgaggaagtactccgcagcttagaaactgtttcaaatacagaggtctgttgccctaatttgcagccgaacttggaagccactgtatccaatggaccttttctgcagctttcttcccagtctcttagccataatgtttttatgtccaccagtcctgcacttcatgggttatcatgtacagcagcaactccgaagatagcaaaattgaatagaaaacgatccagatcagagagtgacagtgagaaagttcagccacttccaatttctaccattatccgaggcccaacactgggggcatctgctcctgtgacagtgaaacgggagagcaaaatttctcttcaacctatagcaactgttcccaatggaggcacaacacctaaaatcagcaaaactgtacttttatctactaaaagcatgaaaaagagtcatgaacatggatccaagaaatctcactctaaaaccaagccaggtattcttaaaaaagacaaagcagtaaaggaaaagattcctagtcatcattttatgccaggaagtcctaccaagactgtgtacaaaaaaccccaggaaaagaaagggtgtaaatgtgggcgtgctactcaaaatccaagtgttcttacatgccgaggccaacgctgcccttgctactctaaccgcaaagcctgcttagattgtatatgtcgtggctgccaaaactcctatatggccaatggggagaagaagctggaggcatttgccgtgccagaaaaggccttggagcagaccaggctcactttgggcattaacgtgactagcattgctgtgcgtaacgctagtaccagcaccagtgtaataaatgtcacagggtccccagtaacgacgtttttagctgccagtacacatgatgataaaagtttggatgaagctatagacatgagattcgactgttaaatcagtgggtcttttaaacctactcctggtagggaaatagctacagttttacggcagctatggttctgttggtttaacttgccggagctcctgcatatagatcacttgtatcaagtgttttcattgctaagttatatgtgttagtgtcggggaaatagtttgcagataatggaggagtaaccctacaactatatgtccttagttcttacagaacctcatagtttgagaacaaagctgatgcaactgatttatacaaaatgaactttggcaagaaaaataacattaacctcattgtttatggccatgctttgtgcataatcaaagtttatgattaaatgtaaggaagtggtatctagtcagtccataaagattgtgctaatttttttgtggaaaagtagccattagttcaggaaactcagtgctgccttcagatgtcattgatgtttctcctgttggaaagctgatgtgtccagctcaacctttgtgctgacatcataccatttctgatcatgaaatattggctactggtgtatgtagcagttcttaaatcagcagtattatgaaaaaaaattccccctcattagaatgtttaagaaatctttttaaaaagtaaaattctgtcagactacaaatgtttagctgttactcatttctagggaagaaattctaaatccctccttcactttgagcagtgttctaattggataaatgaaggagagtagttttattctgaaggtaattaaatttagactatgtagtatgtgacagaatttttttaaaattataaaaagattttatttagtaattgggatttacttaaaataattttggaataatgctcccagacttgcccagatttgtgtattgtacttattgccactggccgccactttgacttattttctctaatagtttatttgccacagtctttattttgaatatgctcctagtttttttttagggtgctgttcattatgaaggcttctttatagaggcctaataagaatgcctttttataaagcctgtgcatttaggtaggttgaagctaggaggattttctttagaatgctcttttgcatgtaaagcacaaagtatgtttcagtttaaatgcacttcttccggttaatttttatggggaagacaagtgagtcacaaacattctgttgaagggaaatctagtcagttgcttgaaagagcacagcccaaataaaacaaggactgactaggtgtaatgaaataacctgtgatttaaaagaagagctgcagctttgacagtgcttatttaaagaaaaatactgctggaaaatttccaatttctactacgttcaccatctctagtaagatctgacatatgctgaagttatgttttgatttggcacacagcatgttcaatgatggttactcgcctagtacaagacatggagaagaaacctttggacacagagcagatgacacctccttctgttttgtagtgtatcctggtgtcattttctgtgaatgtggtcaggtagagttgtttttgttgttgttgttgggcttttttttctttttttttttttggtctcttttggtggggtgggggtgggctaaagccataggaagaaaaatgtgatgtatgtgtccagtatgtactattttgtttttgttttgcaagaagagttgaactatttttgataacaagagtaaatggtggaaaatgcttcttagttgtcttgtctttatttgctttccaagatttggaattttatttaattcctttaagtgttagcagtgtcttatgaaacgtgtatttacctaacgtttgtaacagttttgtgttgaacccagatgccctgctatataaagttgtaaatctgttctttattcactaatgatcactgcaaaaatgattagaaatgagattgtacacatggatgaggatatattttgcaaatcgaccaaactttcctaatattatgatcttaaaattcatagagtactttattgcttcccaagtttgataatcttgtgggtttttttttttttttgatgcatgggaggttggcaatatagacaaagtggaaatcattagtatgtgagggccttgattgttatgtaatattgccaatgatgaattcaggttgtttttagcacaagtttctcttttttatgctggtattctcactgccacatttttggaaacctgtattacaccttaaatctatcaataaatgatagttttctaa

SEQ ID NO: 1176 - DNA, 2272 bp, Homo sapiens
aaactggtgttacgtgggagtggtgggctaagctgatgaacccacagctggagaacccggcgcggaactttgccccaggttcctccacaaatgctttgacggtttgacggttaacagcgagccggggaaggctgttggtactcgaagtgctttttagctggacatttgctacaagatcctattgcacccaccaactccacctgccaacattatgtctgcaaaacttgtaaaggcaagaaaatgatgatgaaaccttcctgtagctggtgcaaagactatgagcagtttgaggaaaacaagcagttaagcatcctagtgaactgctacaaaaaactatgcgagtatataacacagactacactggcacgggatataatagaagcagttgactgttcttctgatattttggctttgcttaatgatggatcattgttttgtgaggagacagaaaaaccctcagattcatcctttactttgtgtttgacacattcccctttaccttcaacctcagaacccacaactgatcctcaagctagtttatctccaatgtctgaaagcaccctcagcattgctattggcagttctgttatcaatggtttgcctacttataatgggctttcaatagatagatttggtataaatattccttcacctgaacattcaaatacgattgacgtatgtaatactgttgacataaaaactgaggatctgtctgacagcctgccacccgtttgtgacacagtagccactgacttatgttccacaggcattgatatctgcagtttcagtgaagatataaaacctggagactctctgttactgagtgttgaggaagtactccgcagcttagaaactgtttcaaatacagaggtctgttgccctaatttgcagccgaacttggaagccactgtatccaatggaccttttctgcagctttcttcccagtctcttagccataatgtttttatgtccaccagtcctgcacttcatgggttatcatgtacagcagcaactccgaagatagcaaaattgaatagaaaacgatccagatcagagagtgacagtgagaaagttcagccacttccaatttctaccattatccgaggcccaacactgggggcatctgctcctgtgacagtgaaacgggagagcaaaatttctcttcaacctatagcaactgttcccaatggaggcacaacacctaaaatcagcaaaactgtacttttatctactaaaagcatgaaaaagagtcatgaacatggatccaagaaatctcactctaaaaccaagccaggtattcttaaaaaagacaaagcagtaaaggaaaagattcctagtcatcattttatgccaggaagtcctaccaagactgtgtacaaaaaaccccaggaaaagaaagggtgtaaatgtgggcgtgctactcaaaatccaagtgttcttacatgccgaggccaacgctgcccttgctactctaaccgcaaagcctgcttagattgtatatgtcgtggctgccaaaactcctatatggccaatggggagaagaagctggaggcatttgccgtgccagaaaaggccttggagcagaccaggctcactttgggcattaacgtgactagcattgctgtgcgtaacgctagtaccagcaccagtgtaataaatgtcacagggtccccagtaacgacgtttttagctgccagtacacatgatgataaaagtttggatgaagctatagacatgagattcgactgttaaatcagtgggtcttttaaacctactcctggtagggaaatagctacagttttacggcagctatggttctgttggtttaacttgccggagctcctgcatatagatcacttgtatcaagtgttttcattgctaagttatatgtgttagtgtcggggaaatagtttgcagataatggaggagtaaccctacaactatatgtccttagttcttacagaacctcatagtttgagaacaaagctgatgcaactgatttatacaaaatgaactttggcaagaaaaataacattaacctcattgtttatggccatgctttgtgcataatcaaagtttatgattaaatgtaaggaagtggtatctagtcagtccataaagattgtgctaatttttttgtggaaaagtagccattagttcaggaaactcagtgctgccttcagatgtcattgatgtttctcctgttggaaagctgatgtgtccagctcaacctttgtgctgacatcataccatttctgatcatgaaatattg

SEQ ID NO: 1177 - DNA, 2343 bp, Homo sapiens
cggccccccccggccacggcgcaccgcctccccgcccccgcccgccctcccccaccgcgcgcgctccgcccgccccggagcctcgccctccgccacgatgagcaaatgagcgcgagcgagggcatgaaatttaaattccactcaggggagaaagtgctgtgcttcgagcctgaccccaccaaggcgcgagtgctgtacgatgccaagattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagaagacacctgtgcatagcagatcatcttcacctattcctctgactcctagcaaggaagggagtgctgtgtttgctggctttgaagggagaagaactaatgaaataaacgaggtcctctcctggaagcttgtgcctgacaattaccccccaggtgaccagccgcctccaccctcttacatttatggggcacaacatttgctgcgattgtttgtgaaacttccagaaatccttggaaagatgtccttttctgagaagaatctgaaggctttattgaagcactttgatctctttttgaggtttttagcagaataccacgatgacttcttcccagagtcggcttatgtcgctgcctgtgaggcacattacagcaccaagaacccccgggcaatttattaaaatgttgttggttctgtaagagcaactgctctgtctagtttggcgctctgggttccaggtgaataactaacaaggtggtgggtctttacccacagcgcaaacacaatgcccaccttggggctctgttgtttgagttgcccacatactgcagttattctgttaggaatgattccctgggtgcctgaaagtgctctgacacgacacttgttactttgcaggccatctgtgatggcaaggaaaaagcaactatgttcacagtgaaatattcgtggaataggttaggccatttcagtagacattgcagttagttagcaagaaccacattgtctctttatttgttagcattaaacaaatttttttttgcaaattggttttatttttttgatgaagccgagcaactctgtccaaaaaggtttagtttgtactcggaaaccacaaagtagtctcaaagtattttagagggaatcgatattgatggcaaaagaaaatttgcagctatgcatttgcttctaacggttccctctctgtgaaacattatttttggtgatctaaagaaagcattgcctttcttatttgagattttacagctatactttgttgtgtaatgttatggttccctttctgtaaaatgttatttttggtgatctaaataaagcctgtcttgtttgaaag

SEQ ID NO: 1178 - DNA, 3446 bp, Homo sapiens
agcctcgccctccgccacgatgagcaaatgagcgcgagcgagggcatgaaatttaaattccactcaggggagaaagtgctgtgcttcgagcctgaccccaccaaggcgcgagtgctgtacgatgccaagattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagagtaggttcattctcgggtgccccaggccggggagagccagcgtgtactttgtgtttagtcagtgccaggcatggtgctgaggttacatgtgtgtgtgtacagtgcgtgtgattcccatgtccaaagtgctgtcatgctgcctgctttctggagctgtagaaagttgaaacacctggcgcagattgcagcgcagctgtgttggaggcaggactgggctgtttcctcagcctttcttttttgccatcactctaccacttgtgagcaaattgagttatcagaattctatgtattgtgtagctaggcctaatgaagcattcaaaatgagcaatgctaatgggttgtttagctttttgttttctttgtactctgtctctgtagtctctccattctaaagtttaatttggaaaggtctgtcctgaattatcaaagtaagaatactcagatttccataagctcttctcacctcctcttagcccaactcaaactccatcagatcttctcaccttgattttgagctggaatgtttcaatgagcaaaataaattagacaaaagtttactttctttttttccaaaatacacacaggttgatttgctgtaatataaaacttagaagtaaaccactgctaattaatcattttaaactttcaaaaactgctaaaacaggtgccatgaatcaggtacaattactgtagaaactaacattagctattatacactaaccaggcatttttcccaaattaattacaatctggttgtttagcctatgctaattaagccctcttagtagtagtattcactttacattgaagacctcattcacaaatacagggtgctctgtgcttatatccttccacccttgactgccaaaaatgtgtgaaatggaaagttgatggcagcagggccgacgatgtcacctggtgcctcgcgggctcagtgagttaggaagtcagcagcaggggaggcagcttgcatgcctgtcccccggcacactgtgtggaggtggaaacagagctacgccagcaggcgccaagcacccaactccagagatggaagcctggtggccttcctttcacagagctcagctgctcgcaggctgtgaaatctaagacacccctcataaatatcaaaaacacctccaaagctaacgtcagggtaaaactacttggagtcgaatccccatgccccagtaggtgtatcttgtgtatgacctgtgccctgttcttccctcagcctcgcctgctgtgctgactccttcaggggtccttctaagcatcatcctgttggaactcccaaaagtcatcccagtgccattctgtgttcaggtgcccatttccttgtgtacatcctgtccctgccacatccataagctcctgagagaaaggtctgacttgttgattgtgtcaccccatcacagctcagtgttggtggcatagttccaggtgcgtgaaagtatttgctgattctttgaagattgggaaggctcagaagggcagagttgaagaaggcatacctttaagagaagccctttgaataatcaagtgctaaaacaaaatcaggtgcttttttaaaacagcttgattgagatataatccacataccttaaaattcacacatttaaagtttttagtgtctccagacacagtggttcatgcctgtgagactggggcaggaggatcacttgaggccaggagttcaagatcagcctgggcaatatagtgaaaccccatctcttaaagaaaaagttagccaggtgtgatgatgtgcacctatagtcccagctacttgggaggctgcagctgtggctgtggctgaagctggcggatcgcttgaggcccagagtctaagactgcagtgagctctcattgggccactgcagtcgagcctgggcgacacaaagagaccaccctgtctgatagataactaacaaaatagttttagttgggcaaaattaaagagttgggcaaccatcactgaaatcagtttcagacattttcaccactccaaaaaagaaaccccacatcgactagcagttactcatttgcttctccctatgtcccctgacaaccactaatctatttgtctctatagatttgccagtttggggcatttcatataaatggaatcatctgtatgtaagtggttaataaggattggttgattgaagattgaaaagggtcagctgggaaaatttttaaaaagactgtttttaaaaaggtgctacaaaataaagtgctatctttttctgtt

SEQ ID NO: 1179 - DNA, 1608 bp, Homo sapiens
aaattccactcaggggagaaagtgctgtgcttcgagcctgaccccaccaaggcgcgagtgctgtacgatgccaagattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagaagacacctgtgcatagcagatcatcttcacctattcctctgactcctagcaaggaagggagtgctgtgtttgctggctttgaagggagaagaactaatgaaataaacgaggtcctctcctggaagcttgtgcctgacaattaccccccaggtgaccagccgcctccaccctcttacatttatggggcacaacatttgctgcgattgtttgtgaaacttccagaaatccttggaaagatgtccttttctgagaagaatctgaaggctttattgaagcactttgatctctttttgaggtttttagcagaataccacgatgacttcttcccagagtcggcttatgtcgctgcctgtgaggcacattacagcaccaagaacccccgggcaatttattaaaatgttgttggttctgtaagagcaactgctctgtctagtttggcgctctgggttccaggtgaataactaacaaggtggtgggtctttacccacagcgcaaacacaatgcccaccttggggctctgttgtttgagttgcccacatactgcagt

SEQ ID NO: 1180 - DNA, 1071 bp, Homo sapiens
ccacttgggggaaaaaaatgaaaggaaaaatatttcaacccggctgtcggtctaaaagaggagagaatgctttctttaaaaaaggattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctga

SEQ ID NO: 1181 - DNA, 2377 bp, Homo sapiens
cagaagcctcacactgtctcacgctcagagaccaatcacggggtggttggacggatgtttcctattttgaaggcgtccacttgggggaaaaaaatgaaaggaaaaatatttcaacccggctgtcggtctaaaagaggagagaatgctttctttaaaaaagggtctgtgaattagttttcctgatctaacttctaattttctgtatgttctgccatttgtgggaaatatttcttcgtttcagattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagaagacacctgtgcatagcagatcatcttcacctattcctctgactcctagcaaggaagggagtgctgtgtttgctggctttgaagggagaagaactaatgaaataaacgaggtcctctcctggaagcttgtgcctgacaattaccccccaggtgaccagccgcctccaccctcttacatttatggggcacaacatttgctgcgattgtttgtgaaacttccagaaatccttggaaagatgtccttttctgagaagaatctgaaggctttattgaagcactttgatctctttttgaggtttttagcagaataccacgatgacttcttcccagagtcggcttatgtcgctgcctgtgaggcacattacagcaccaagaacccccgggcaatttattaaaatgttgttggttctgtaagagcaactgctctgtctagtttggcgctctgggttccaggtgaataactaacaaggtggtgggtctttacccacagcgcaaacacaatgcccaccttggggctctgttgtttgagttgcccacatactgcagttattctgttaggaatgattccctgggtgcctgaaagtgctctgacacgacacttgttactttgcaggccatctgtgatggcaaggaaaaagcaactatgttcacagtgaaatattcgtggaataggttaggccatttcagtagacattgcagttagttagcaagaaccacattgtctctttatttgttagcattaaacaaatttttttttgcaaattggttttatttttttgatgaagccgagcaactctgtccaaaaaggtttagtttgtactcggaaaccacaaagtagtctcaaagtattttagagggaatcgatattgatggcaaaagaaaatttgcagctatgcatttgcttctaacggttccctctctgtgaaacattatttttggtgatctaaagaaagcattgcctttcttatttgagattttacagctatactttgttgtgtaatgttatggttccctttctgtaaaatgttatttttggtgatctaaataaagcctgtcttgtttgaaag

SEQ ID NO: 1182 - DNA, 2005 bp, Homo sapiens
gctttgtcgcgttaccggggctaccgtttgcgcccccgactgcaacggtggccgctgagggaggaggcttctcgaatacggtttctgtcttcgcgttaaatgtctccttctgtgcggcctggtgccgggtgggctcctgtgggacgccctggccgtccgatccagattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggaggatgattgttactacattaacaggaggaaacggttagtgaaacttccatgccagaccaacatcataacgattttggaatcctatgtgaagcattttgctatcaatgcagccttttcagccaatgagaggcctcgtcaccatcacgttatgccacatgccaacatgaacgtgcattatatcccagcagaaaagaatgttgacctttgtaaggagatggtggatggattaagaataacctttgattacactctcccgttggttttactctatccatatgaacaagctcagtataaaaaggtgacttcgtctaaattttttcttccaattaaggaaagtgccacaagcactaacaggagccaggaggaactctctcccagtccgcctttgttgaatccatccacgccacagtccacagagagtcagccgaccaccggtgaaccagccacccccaaaaggcgcaaagctgagccagaagcattgcagtctctgaggcggtccacgcgccacagtgccaactgtgacaggctttctgagagcagcgcttcacctcagcccaagcgccggcagcaggacacatccgccagcatgcccaagctcttcctgcacctggaaaagaagacacctgtgcatagcagatcatcttcacctattcctctgactcctagcaaggaagggagtgctgtgtttgctggctttgaagggagaagaactaatgaaataaacgaggtcctctcctggaagcttgtgcctgacaattaccccccaggtgaccagccgcctccaccctcttacatttatggggcacaacatttgctgcgattgtttgtgaaacttccagaaatccttggaaagatgtccttttctgagaagaatctgaaggctttattgaagcactttgatctctttttgaggtttttagcagaataccacgatgacttcttcccagagtcggcttatgtcgctgcctgtgaggcacattacagcaccaagaacccccgggcaatttattaaaatgttgttggttctgtaagagcaactgctctgtctagtttggcgctctgggttccaggtgaataactaacaaggtggtgggtctttacccacagcgcaaacacaatgcccaccttggggctctgttgtttgagttgcccacatactgcagttattctgttaggaatgattccctgggtgcctgaaagtgctctgacacgacacttgttactttgcaggccatctgtgatggcaaggaaaaagcaactatgttcacagtgaaatattcgtggaataggttaggccatttcagtagacattgcagttagttagcaagaaccacattgtctctttatttgttagcattaaacaaatttttttttgcaaattggtttta

SEQ ID NO: 1183 - DNA, 560 bp, Homo sapiens
gcacgcgcggttgggagcctcgcccatgctttgtcgcgttaccggggctaccgtttgcgcccccgactgcaacggtggccgctgagggaggaggcttctcgaatacgattgttgatgttattgttgggaaagacgaaaaaggcagaaagatcccagaatatctgatccattttaatggttggaacagaagctgggatagatgggcagcagaagatcatgtgcttcgtgataccgatgaaaatcgtagattacagcgtaaattggcaagaaaagctgtagctcgcctgaggagcacaggaagaaagaagaagcgctgcaggttgcctggtgtggactctgtcttaaaaggcctccccactgaagaaaaagatgaaaatgatgaaaactcattaagcagttcctctgactgtagtgaaaacaaggatgaagaaataagtgaagaaagtgatattgaagaaaagactgaagtgaaagaagaaccagagcttcaaacaagaagggaaatggaagaaagaacaataactatagaaatccctgaagttctgaagaagcagctggag

SEQ ID NO: 1184 - DNA, 4853 bp, Homo sapiens
gcctccctgtggcggcggcttgttgttgtggaggccaaaatggcggctcaggcggcggcagcggcccaggcggcggcggcccaggctgcgcaggccgaggcggccgactcgtggtacctggcgcttctgggcttcgctgagcacttccgcacttccagcccgcccaaaatccgcctgtgcgtgcactgcctgcaggccgtgttccccttcaagccgccgcagcgcatcgaggcccgtacacacctgcagctgggctccgttctctatcaccacaccaagaacagcgagcaggcgcgcagccacctggagaaggcgggttcactttctcagcaaatcccgcagttcgaagatgttaaatttgaagcagcaagtctgttgtctgaattgtactgtcaagagaattccgttgatgcagcaaagccgctgctgcggaaggcgatccagatctcacagcagaccccatattggcactgccgcctgctcttccagctcgctcaactgcacacgcttgagaaggacctggtgtcggcctgtgacctcctgggtgtaggggccgagtacgcccgggtggtgggatctgaatacacacgggcgctgttcctcctcagcaaggggatgctgctgctgatggagcgaaagctgcaggaggtgcacccgctgctgaccctctgcgggcagatcgtggagaactggcaggggaaccccatccagaaggagtcgctgcgtgtcttcttcctggtgctccaggtcacccactatctggatgccgggcaggtgaagagcgtgaagccgtgtctgaagcagctgcagcagtgcatccagaccatctccacactgcacgatgatgagatcctgcccagcaaccccgctgacctcttccactggctgcccaaggagcacatgtgtgtgcttgtctacctggtgactgtgatgcactccatgcaggccggctacctggagaaggcgcagaagtacacggacaaggccctcatgcagctggagaagctcaagatgctggactgcagccccatcctgtcatccttccaagtgatcctgctggagcacatcatcatgtgccgccttgtcacgggtcacaaggccacggcgctgcaggagatctcccaggtctgccagctgtgccagcagtccccccggctcttctccaaccatgcagcacagctgcacacattgctgggcctgtactgtgtctctgtcaactgcatggacaacgcggaagcccagttcaccacggccctgcggctcaccaaccaccaggagctgtgggccttcatcgtcaccaacctggcgagtgtgtatatacgggaaggaaatagacaccaagaggtactctacagtctgctggagaggatcaacccggaccacagcttccctgtcagctcgcactgcctccgagcagccgccttctatgtgcgtgggctcttctccttcttccagggacgctacaacgaggccaagcgatttctgcgggaaactctgaagatgtccaatgctgaggacctgaaccggctcacagcctgctccctcgtgcttctgggccacatcttctatgtgctgggaaaccacagggagagtaacaacatggtggtgcctgccatgcagctcgccagcaagatcccggacatgtcggtacagctgtggtcgtcagcactgctgagagacctgaataaagcctgtgggaacgccatggatgcccatgaagccgcccagatgcaccagaacttctcgcagcagctgctccaggaccacattgaggcctgcagcctccccgaacacaacctcatcacgtggacagacggtccaccccccgtgcagttccaagctcagaatggacccaacaccagcctggccagcctcctgtgaggccttgatggggccatccagctccgcagggcctgcgcgtctccggcttccacccagacggcactcaagcctgcccccgaggcgtgcttccttcctgattgtctctagagcttccaagtcctgggaatgtgcggggccagtccctgccctcccaggaggggtggtagccgttcccacctcgcagcaggacccccagtgcagaggctcacaggtggcacacaggcgctgtctctccagagccatccttcagagtggacctcagtgccagtcctgcctcagcatctgggtcacgtcggccaggagtagggtgcaggcctccagcaggtcctaatcctgtgtgccagggcaggcagtgccccaggggcaccacgcctgactctccatcacccaggccttgatgccgagcgggagtagagtgtttcctctgctcaaggcaatttccagagcccggatgccagtttctggcctgaatttggagggaagaagtaatggcgctagtgtgggacgaagcacagatcccagcacttttcccagctttctctccagcatcagtccctgcagcagctggggcctctggtcaggaaccctcagggacccaggaactcagcttccaaacatctgcaccttgaccggactcgccatcccgccgtgggggtgcaggtgattgtaaacacgggtgtgcatgtggatgcacacgggtgtgcggtgaagatctgtggagatggagctgggagctgaggctcctgttgcaccagccaccttcccccatcttgtggctgctgaggggcaggaagcgggggagtgggctcgtctcctaaatttaagatcacctcctcagctagcttagagtgcgtggcacgggccccccgcccccgagatctggagcccagggactttcttcctggcagatctgtggccttccctgctcagcctcttggtccccccactccctccaccgcctcaccttccctgctgggtctctggggcacagtgtgaaacccgcaccctagccaggccccagggagcctccgctgggcccagacagcagcgtttggttttatccacttttcttggataatcaggaggtgccccagtggtcacagtgtggcattccgagttggggcgggtggtcgggtcaagatagcagcagcaggtgtcagggctcaagacaccaccccctccagcttctggggcccaggagcctctccctgctacagggggtgggggtcctgctcagcagggtaggtggtggttttaggtcttgtcaccctcactcagtggaactgcctctgggagctttggcgtctgtgactaaagggacgctggattgctcaggtcagctgcttggggctcccaggctgggtgtgccttagccacaggcagggctgtcaataacccccttcctcactggccaccacctgacatcagcaccagtgacaggctggtcagagggcggggctggtgagggtttgtcctaagaggaccaccgccatctctgggtctccagggggagagcctggccctgtcctttgctacccagggctgcccccaggcccatgaagccaataggagagcgtgtggcactggcccacaaactgtccctgtcctgtcttcctcccgagccatggcctctgctagctccaccttgaaggagccccccacatcctcccctacatcccagagatgccaccacttgtgtctccacaatgtgctcctgcccacccgggttccgcactgtccgacccctgcacaccactcatgtcaccacggcgtgcatcatgttcatccccatctatttatttaagcctttctttgcttgtagggcattttgtatgtagagcagttgaaaacagaacctcagaacttaacatctgtcctgatgttaaagtgcttttcatgaccaccctgttatctatgtatatgtaaagttaaggatgagatcttaagtttacaattaaaaactcagtactcaatatttaatattctactcgagctttatggaagccaaatcatgtgcatgtgtgtgtgtgcgtgtgtgcaagctttgaacctccttccacagccgcatcttctcatgacacaaagcttttgataagtactttcctgtgggtcgctcagcgcctcatagcatctcattcaattgcaagaatagaggccagacacggtggcgcatgcctgtagtcccagctaactgggaggctgaggcaggaggatcacttgagcccaggagattgaggctgcagtgagcatgatcgcgacactgcactccagcctgggtgacggtgagactttgtctcaaaaaaaaaaaaaaaaacaatggaaggcagacagcaagtccctgaggacacatcacacagtgtcctgtagctaagtgtctaggaaaaaacaaaaactccaaacccttcagtggatgaggacaaggtcgcagaaaggcattctgttgacagatgaacagccgaaagctggccagaccctcctgtatgcctctgcccttgtcctgtgggttgagggggtctgaccaggaggccacctacagcaggaagtgaggctgccatgtttccttgagacacagctgcctctccccagctctgtccctgtagtcacctgccggtgggcgaggatcctctccctgggataagcactcccagccccgtttatcagaaacacaggcaaggaaattggaactgccacccagcccagcatggtggctcaattggttggttgcgttgtcagttgtctcttcgttttgttaaggtttttaataagtacgtttggcataatgtcttttaatgggtttgtaatatttgtaacggttttagcagcctataacttttcagctggtgcttttacttagggaaaaaaacaatttgtaaatacagaacattgtttaaaagacataaccatagaacatagcttcctgtttgtggattttgtttcctatatattcaaagtaaaatgacttacaggagcca

SEQ ID NO: 1185 - DNA, 3839 bp, Homo sapiens
aaatataaaaattagccaggtgtggtggcagacacctgtaatcccagttacttgagaggctgaggcaggagaatagcctgaacccaggaggcagaggttgcagtgagccgagatcgcactactgcactccaacctgggcaacagagtgagactccatctcaaaaaaaaaaacccaaaaaactaatgggccatggcccaaaagcttgcacaccaaggggatagcgcacatggtctctggggatttggggggtcctttgacagtgattgttataccccaccctgccattaggaacactctacccccagtacccaccctcctgagagggcatgggggccctcagtaggctggaggtcctttacaacccagacacctgttggacagagtggaagagacgagtaacagacaagggtccctgtccacgatgggatctgggctgccctttgccctcatggtggacgtgtctgctggggctttgtaccccagtttggtcagacaggacatgggctcacccaccagctatggggtctctccattgctgctcagacgccaggtcccaggttgcagtcctgtgatggcagtacactctctcccggcagatctcccaggtctgccagctgtgccagcagtccccccggctcttctccaaccatgcagcacagctgcacacattgctggtgagtaaccctgtgacaacaccccgggagaatccagaatgttctcagtaagtaagtacctaaccagatccagaacattcccagtgaaggaccccctgacagcaccctaatcagaatccggaatgttcccataggtaatcatataaccttcccaggcacgatccggaatgctcccagtgagcatcttgtcccaccccacattggcttgggtctgaaaggtggggacagtgagcatattacctgccttgcagctggctcggtagagccattgtcatactcctccagggcagccgtgcaggccccgggcacaccacgtgtctctgatctgagccccctccccaggggccggccctgatgacaacaccaccttcttccagggcctgtactgtgtctctgtcaactgcatggacaacgcggaagcccagttcaccacggccctgcggctcaccaaccaccaggagctgtgggccttcatcgtcaccaacctggcgagtgtgtatatacgggaaggaaatagacaccaagaggtactctacagtctgctggagaggatcaacccggaccacagcttccctgtcagctcgcactgcctccgagcagccgccttctatgtgcgtgggctcttctccttcttccagggacgctacaacgaggccaagcgatttctgcgggaaactctgaagatgtccaatgctgaggacctgaaccggctcacagcctgctccctcgtgcttctgggccacatcttctatgtgctgggaaaccacagggacagataaagcaagatgtgtgtcttggcctgtaaagtttcacgtgatctgagggctccctcagcatggatgctgttaacaaacgtggtgcccgcccaccgcaacacacagacacataactgtgtggagagtaacaacatggtggtgcctgccatgcagctcgccagcaagatcccggacatgtcggtacagctgtggtcgtcagcactgctgagagacctgaataaagcctgtgggaacgccatggatgcccatgaagccgcccagatgcaccagaacttctcgcagcagctgctccaggaccacattgaggcctgcagcctccccgaacacaacctcatcacgtggacagacggtccaccccccgtgcagttccaagctcagaatggacccaacaccagcctggccagcctcctgtgaggccttgatggggccatccagctccgcagggcctgcgcgtctccggcttccacccagacggcactcaagcctgcccccgaggcgtgcttccttcctgattgtctctagagcttccaagtcctgggaatgtgcggggccagtccctgccctcccaggaggggtggtagccgttcccacctcgcagcaggacccccagtgcagaggctcacaggtggcacacaggcgctgtctctccagagccatccttcagagtggacctcagtgccagtcctgcctcagcatctgggtcacgtcggccaggagtagggtgcaggcctccagcaggtcctaatcctgtgtgccagggcaggcagtgccccaggggcaccacgcctgactctccatcacccaggccttgatgccgagcgggagtagagtgtttcctctgctcaaggcaatttccagagcccggatgccagtttctggcctgaatttggagggaagaagtaatggcgctagtgtgggacgaagcacagatcccagcacttttcccagctttctctccagcatcagtccctgcagcagctggggcctctggtcaggaaccctcagggacccaggaactcagcttccaaacatctgcaccttgaccggactcgccatcccgccgtgggggtgcaggtgattgtaaacacgggtgtgcatgtggatgcacacgggtgtgcggtgaagatctgtggagatggagctgggagctgaggctcctgttgcaccagccaccttcccccatcttgtggctgctgaggggcaggaagcgggggagtgggctcgtctcctaaatttaagatcacctcctcagctagcttagagtgcgtggcacgggccccccgcccccgagatctggagcccagggactttcttcctggcagatctgtggccttccctgctcagcctcttggtccccccactccctccaccgcctcaccttccctgctgggtctctggggcacagtgtgaaacccgcaccctagccaggccccagggagcctccgctgggcccagacagcagcgtttggttttatccacttttcttggataatcaggaggtgccccagtggtcacagtgtggcattccgagttggggcgggtggtcgggtcaagatagcagcagcaggtgtcagggctcaagacaccaccccctccagcttctggggcccaggagcctctccctgctacagggggtgggggtcctgctcagcagggtaggtggtggttttaggtcttgtcaccctcactcagtggaactgcctctgggagctttggcgtctgtgactaaagggacgctggattgctcaggtcagctgcttggggctcccaggctgggtgtgccttagccacaggcagggctgtcaataacccccttcctcactggccaccacctgacatcagcaccagtgacaggctggtcagagggcggggctggtgagggtttgtcctaagaggaccaccgccatctctgggtctccagggggagagcctggccctgtcctttgctacccagggctgcccccaggcccatgaagccaataggagagcgtgtggcactggcccacaaactgtccctgtcctgtcttcctcccgagccatggcctctgctagctccaccttgaaggagccccccacatcctcccctacatcccagagatgccaccacttgtgtctccacaatgtgctcctgcccacccgggttccgcactgtccgacccctgcacaccactcatgtcaccacggcgtgcatcatgttcatccccatctatttatttaagcctttctttgcttgtagggcattttgtatgtagagcagttgaaaacagaacctcagaacttaacatctgtcctgatgttaaagtgcttttcatgaccaccctgttatctatgtatatgtaaagttaaggatgagatcttaagtttacaattaaaaactcagtactcaat

SEQ ID NO: 1186 - DNA, 4870 bp, Homo sapiens
tcgcgcgcctgcttccgcctccctgtggcggcggcttgttgttgtggaggccaaaatggcggctcaggcggcggcagcggcccaggcggcggcggcccaggctgcgcaggccgaggcggccgactcgtggtacctggcgcttctgggcttcgctgagcacttccgcacttccagcccgcccaaaatccgcctgtgcgtgcactgcctgcaggccgtgttccccttcaagccgccgcagcgcatcgaggcccgtacacacctgcagctgggctccgttctctatcaccacaccaagaacagcgagcaggcgcgcagccacctggagaaggcgtggttgatatcacagcaaatcccgcagttcgaagatgttaaatttgaagcagcaagtctgttgtctgaattgtactgtcaagagaattccgttgatgcagcaaagccgctgctgcggaaggcgatccagatctcacagcagaccccatattggcactgccgcctgctcttccagctcgctcaactgcacacgcttgagaaggacctggtgtcggcctgtgacctcctgggtgtaggggccgagtacgcccgggtggtgggatctgaatacacacgggcgctgttcctcctcagcaaggggatgctgctgctgatggagcgaaagctgcaggaggtgcacccgctgctgaccctctgcgggcagatcgtggagaactggcaggggaaccccatccagaaggagtcgctgcgtgtcttcttcctggtgctccaggtcacccactatctggatgccgggcaggtgaagagcgtgaagccgtgtctgaagcagctgcagcagtgcatccagaccatctccacactgcacgatgatgagatcctgcccagcaaccccgctgacctcttccactggctgcccaaggagcacatgtgtgtgcttgtctacctggtgactgtgatgcactccatgcaggccggctacctggagaaggcgcagaagtacacggacaaggccctcatgcagctggagaagctcaagatgctggactgcagccccatcctgtcatccttccaagtgatcctgctggagcacatcatcatgtgccgccttgtcacgggtcacaaggccacggcgctgcaggagatctcccaggtctgccagctgtgccagcagtccccccggctcttctccaaccatgcagcacagctgcacacattgctgggcctgtactgtgtctctgtcaactgcatggacaacgcggaagcccagttcaccacggccctgcggctcaccaaccaccaggagctgtgggccttcatcgtcaccaacctggcgagtgtgtatatacgggaaggaaatagacaccaagaggtactctacagtctgctggagaggatcaacccggaccacagcttccctgtcagctcgcactgcctccgagcagccgccttctatgtgcgtgggctcttctccttcttccagggacgctacaacgaggccaagcgatttctgcgggaaactctgaagatgtccaatgctgaggacctgaaccggctcacagcctgctccctcgtgcttctgggccacatcttctatgtgctgggaaaccacagggagagtaacaacatggtggtgcctgccatgcagctcgccagcaagatcccggacatgtcggtacagctgtggtcgtcagcactgctgagagacctgaataaagcctgtgggaacgccatggatgcccatgaagccgcccagatgcaccagaacttctcgcagcagctgctccaggaccacattgaggcctgcagcctccccgaacacaacctcatcacgtggacagacggtccaccccccgtgcagttccaagctcagaatggacccaacaccagcctggccagcctcctgtgaggccttgatggggccatccagctccgcagggcctgcgcgtctccggcttccacccagacggcactcaagcctgcccccgaggcgtgcttccttcctgattgtctctagagcttccaagtcctgggaatgtgcggggccagtccctgccctcccaggaggggtggtagccgttcccacctcgcagcaggacccccagtgcagaggctcacaggtggcacacaggcgctgtctctccagagccatccttcagagtggacctcagtgccagtcctgcctcagcatctgggtcacgtcggccaggagtagggtgcaggcctccagcaggtcctaatcctgtgtgccagggcaggcagtgccccaggggcaccacgcctgactctccatcacccaggccttgatgccgagcgggagtagagtgtttcctctgctcaaggcaatttccagagcccggatgccagtttctggcctgaatttggagggaagaagtaatggcgctagtgtgggacgaagcacagatcccagcacttttcccagctttctctccagcatcagtccctgcagcagctggggcctctggtcaggaaccctcagggacccaggaactcagcttccaaacatctgcaccttgaccggactcgccatcccgccgtgggggtgcaggtgattgtaaacacgggtgtgcatgtggatgcacacgggtgtgcggtgaagatctgtggagatggagctgggagctgaggctcctgttgcaccagccaccttcccccatcttgtggctgctgaggggcaggaagcgggggagtgggctcgtctcctaaatttaagatcacctcctcagctagcttagagtgcgtggcacgggccccccgcccccgagatctggagcccagggactttcttcctggcagatctgtggccttccctgctcagcctcttggtccccccactccctccaccgcctcaccttccctgctgggtctctggggcacagtgtgaaacccgcaccctagccaggccccagggagcctccgctgggcccagacagcagcgtttggttttatccacttttcttggataatcaggaggtgccccagtggtcacagtgtggcattccgagttggggcgggtggtcgggtcaagatagcagcagcaggtgtcagggctcaagacaccaccccctccagcttctggggcccaggagcctctccctgctacagggggtgggggtcctgctcagcagggtaggtggtggttttaggtcttgtcaccctcactcagtggaactgcctctgggagctttggcgtctgtgactaaagggacgctggattgctcaggtcagctgcttggggctcccaggctgggtgtgccttagccacaggcagggctgtcaataacccccttcctcactggccaccacctgacatcagcaccagtgacaggctggtcagagggcggggctggtgagggtttgtcctaagaggaccaccgccatctctgggtctccagggggagagcctggccctgtcctttgctacccagggctgcccccaggcccatgaagccaataggagagcgtgtggcactggcccacaaactgtccctgtcctgtcttcctcccgagccatggcctctgctagctccaccttgaaggagccccccacatcctcccctacatcccagagatgccaccacttgtgtctccacaatgtgctcctgcccacccgggttccgcactgtccgacccctgcacaccactcatgtcaccacggcgtgcatcatgttcatccccatctatttatttaagcctttctttgcttgtagggcattttgtatgtagagcagttgaaaacagaacctcagaacttaacatctgtcctgatgttaaagtgcttttcatgaccaccctgttatctatgtatatgtaaagttaaggatgagatcttaagtttacaattaaaaactcagtactcaatatttaatattctactcgagctttatggaagccaaatcatgtgcatgtgtgtgtgtgcgtgtgtgcaagctttgaacctccttccacagccgcatcttctcatgacacaaagcttttgataagtactttcctgtgggtcgctcagcgcctcatagcatctcattcaattgcaagaatagaggccagacacggtggcgcatgcctgtagtcccagctaactgggaggctgaggcaggaggatcacttgagcccaggagattgaggctgcagtgagcatgatcgcgacactgcactccagcctgggtgacggtgagactttgtctcaaaaaaaaaaaaaaaaacaatggaaggcagacagcaagtccctgaggacacatcacacagtgtcctgtagctaagtgtctaggaaaaaacaaaaactccaaacccttcagtggatgaggacaaggtcgcagaaaggcattctgttgacagatgaacagccgaaagctggccagaccctcctgtatgcctctgcccttgtcctgtgggttgagggggtctgaccaggaggccacctacagcaggaagtgaggctgccatgtttccttgagacacagctgcctctccccagctctgtccctgtagtcacctgccggtgggcgaggatcctctccctgggataagcactcccagccccgtttatcagaaacacaggcaaggaaattggaactgccacccagcccagcatggtggctcaattggttggttgcgttgtcagttgtctcttcgttttgttaaggtttttaataagtacgtttggcataatgtcttttaatgggtttgtaatatttgtaacggttttagcagcctataacttttcagctggtgcttttacttagggaaaaaaacaatttgtaaatacagaacattgtttaaaagacataaccatagaacatagcttcctgtttgtggattttgtttcctatatattcaaagtaaaatgacttacaggagccac

SEQ ID NO: 1187 - DNA, 4071 bp, Homo sapiens
aagcctttgcagaggccagcgaatgggccctgcagctcaggccctggtgggccttggcctcagcactggggatgccactaccccgtcaaaacctgtagctggctccttctagaatgtgctatcaccctgccctcagcctctgagcacagtgagggctgtatgtccccactggacagtgcaagtggcctgggggtgtgtcagatggggaggttaaagtcacacagccccagaccgcagaatcaggactggaacccagacctcactggctctgatttgtgtagaaacccctggaagctgcctggagcagggcaaggagggttgagcagctggttcactgctgctcctggcccatgttttaggtgttgtgggggcatcttacagagctcttttgggaatccccctctgctccctgtgtccctgggcccttgtcgggtgacaagcggcgcccaagaactctcagaccaaggtcctggccttaagtgactccagatctcggggagacacagccagacacagccaagccagtcctgtgaggtcaggctggggacatccagaaaggtggcagccttgggggccgggatagtgttggtgcaggcagggcaaggttggctaggcaggggctgccacagagatgggcaccacagcagtcagagcacaagtgccggagcagacggctgaatggccacaatgggctcaggtgagggtccaggggcccagaagagcttgggatgccctgtcctgagcctgttaggctagagtgtccacaagagcgggacaccccccaggatcactcaagtcttcaaaaccagattctgtggggtaccccaagctggcattgggggaacctacccaggagcgctgaaggaggactctccttccccaggctgctttcagacagaggtccttggctttctacagggagcccagccaggctcacaataagccaggcctagcggaagagagcagtttttcttgctctgaggtttcaaaagggcttggtgaattttaaaaagctccaagacccacctggagctcactttcaaggtgcagctacagggcagtgtagagttgttgggctttgtgtctcaggaggagcatctctgcactctggagaagtatctggtggcgtcaaagccaggtctcaggagttggttttggggatgtgtccatcttggcttcccaagtgctccctgggctgccaggagccatcatctagggaattttccaggtcttacctgaaccccacatccaggcttacagggctttgagtcctcggtccagacagggtcagtccagcactgctggtcgcctgtgtagcacaggctcctgtctgccgtctccaggcccttgccatagcaacagggatgggcatttatgggccctgatggctcttactgagctcttcctgccacatcctgaggatgctagggctgcaactggggtggccctgtgcagtcacaaagcagggagtccggattggaggattcttacatgctggtgcccccagagcccctgcgtgtctgcgggggcctcccatgagagccaactcaattgtggaagacaaaccggaggggctgctgcccttctcagaacctgaaacctggaaccctatatgaatctgcatttctgatcagcccccattgtgggtctagggctaacggccatcagtgctttttctctgcttgaacaggtagaagcccccaaagttgtccattggccatgcccctgtgagggcatgagccagaagtgagggcagtttgtttttcagtgatacttcagagagggccatttgagatgggctctgaggagagtaacaacatggtggtgcctgccatgcagctcgccagcaagatcccggacatgtcggtacagctgtggtcgtcagcactgctgagagacctgaataaagcctgtgggaacgccatggatgcccatgaagccgcccagatgcaccagaacttctcgcagcagctgctccaggaccacattgaggcctgcagcctccccgaacacaacctcatcacgtggacagacggtccaccccccgtgcagttccaagctcagaatggacccaacaccagcctggccagcctcctgtgaggccttgatggggccatccagctccgcagggcctgcgcgtctccggcttccacccagacggcactcaagcctgcccccgaggcgtgcttccttcctgattgtctctagagcttccaagtcctgggaatgtgcggggccagtccctgccctcccaggaggggtggtagccgttcccacctcgcagcaggacccccagtgcagaggctcacaggtggcacacaggcgctgtctctccagagccatccttcagagtggacctcagtgccagtcctgcctcagcatctgggtcacgtcggccaggagtagggtgcaggcctccagcaggtcctaatcctgtgtgccagggcaggcagtgccccaggggcaccacgcctgactctccatcacccaggccttgatgccgagcgggagtagagtgtttcctctgctcaaggcaatttccagagcccggatgccagtttctggcctgaatttggagggaagaagtaatggcgctagtgtgggacgaagcacagatcccagcacttttcccagctttctctccagcatcagtccctgcagcagctggggcctctggtcaggaaccctcagggacccaggaactcagcttccaaacatctgcaccttgaccggactcgccatcccgccgtgggggtgcaggtgattgtaaacacgggtgtgcatgtggatgcacacgggtgtgcggtgaagatctgtggagatggagctgggagctgaggctcctgttgcaccagccaccttcccccatcttgtggctgctgaggggcaggaagcgggggagtgggctcgtctcctaaatttaagatcacctcctcagctagcttagagtgcgtggcacgggccccccgcccccgagatctggagcccagggactttcttcctggcagatctgtggccttccctgctcagcctcttggtccccccactccctccaccgcctcaccttccctgctgggtctctggggcacagtgtgaaacccgcaccctagccaggccccagggagcctccgctgggcccagacagcagcgtttggttttatccacttttcttggataatcaggaggtgccccagtggtcacagtgtggcattccgagttggggcgggtggtcgggtcaagatagcagcagcaggtgtcagggctcaagacaccaccccctccagcttctggggcccaggagcctctccctgctacagggggtgggggtcctgctcagcagggtaggtggtggttttaggtcttgtcaccctcactcagtggaactgcctctgggagctttggcgtctgtgactaaagggacgctggattgctcaggtcagctgcttggggctcccaggctgggtgtgccttagccacaggcagggctgtcaataacccccttcctcactggccaccacctgacatcagcaccagtgacaggctggtcagagggcggggctggtgagggtttgtcctaagaggaccaccgccatctctgggtctccagggggagagcctggccctgtcctttgctacccagggctgcccccaggcccatgaagccaataggagagcgtgtggcactggcccacaaactgtccctgtcctgtcttcctcccgagccatggcctctgctagctccaccttgaaggagccccccacatcctcccctacatcccagagatgccaccacttgtgtctccacaatgtgctcctgcccacccgggttccgcactgtccgacccctgcacaccactcatgtcaccacggcgtgcatcatgttcatccccatctatttatttaagcctttctttgcttgtagggcattttgtatgtagagcagttgaaaacagaacctcagaacttaacatctgtcctgatgttaaagtgcttttcatgaccaccctgttatctatgtatatgtaaagttaaggatgagatcttaagtttacaattaaaaactcagtactc

SEQ ID NO: 1188 - DNA, 2929 bp, Homo sapiens
tcttcccggaaaggcagacagcagccatacctattgggtagggctggccagctagctctgggagcagggcgggcactcagcgggtatcattgctgttaccgcagctcccccatttccagattacgaaactaaggtccggagactcgcctggggccctggggaggtgacaggagacggggtgctccatgtgcagtgggctgcctggggctgctgcctcaggatgggcattgggcgtcctgccccaatgagcgcctgtttgcctgagggctggccatgggctccctggagggctggcgagaagcctggcattgggctttcactgcccagccagccctgttctgccctatgagggcggctggcgcatgggctttgtgatcccaagacagggctcaggtccagtgacgtgccaggcacccagagatccaccagtgcagctgggacttgaccttagggctccatctgcaccgagtgggagggcctgggcagtgacagggcaaggcgggcccccatgctcatggtccacagtgcctcactcgcatgtcctctcctccccacagtggacagacggtccaccccccgtgcagttccaagctcagaatggacccaacaccagcctggccagcctcctgtgaggccttgatggggccatccagctccgcagggcctgcgcgtctccggcttccacccagacggcactcaagcctgcccccgaggcgtgcttccttcctgattgtctctagagcttccaagtcctgggaatgtgcggggccagtccctgccctcccaggaggggtggtagccgttcccacctcgcagcaggacccccagtgcagaggctcacaggtggcacacaggcgctgtctctccagagccatccttcagagtggacctcagtgccagtcctgcctcagcatctgggtcacgtcggccaggagtagggtgcaggcctccagcaggtcctaatcctgtgtgccagggcaggcagtgccccaggggcaccacgcctgactctccatcacccaggccttgatgccgagcgggagtagagtgtttcctctgctcaaggcaatttccagagcccggatgccagtttctggcctgaatttggagggaagaagtaatggcgctagtgtgggacgaagcacagatcccagcacttttcccagctttctctccagcatcagtccctgcagcagctggggcctctggtcaggaaccctcagggacccaggaactcagcttccaaacatctgcaccttgaccggactcgccatcccgccgtgggggtgcaggtgattgtaaacacgggtgtgcatgtggatgcacacgggtgtgcggtgaagatctgtggagatggagctgggagctgaggctcctgttgcaccagccaccttcccccatcttgtggctgctgaggggcaggaagcgggggagtgggctcgtctcctaaatttaagatcacctcctcagctagcttagagtgcgtggcacgggccccccgcccccgagatctggagcccagggactttcttcctggcagatctgtggccttccctgctcagcctcttggtccccccactccctccaccgcctcaccttccctgctgggtctctggggcacagtgtgaaacccgcaccctagccaggccccagggagcctccgctgggcccagacagcagcgtttggttttatccacttttcttggataatcaggaggtgccccagtggtcacagtgtggcattccgagttggggcgggtggtcgggtcaagatagcagcagcaggtgtcagggctcaagacaccaccccctccagcttctggggcccaggagcctctccctgctacagggggtgggggtcctgctcagcagggtaggtggtggttttaggtcttgtcaccctcactcagtggaactgcctctgggagctttggcgtctgtgactaaagggacgctggattgctcaggtcagctgcttggggctcccaggctgggtgtgccttagccacaggcagggctgtcaataacccccttcctcactggccaccacctgacatcagcaccagtgacaggctggtcagagggcggggctggtgagggtttgtcctaagaggaccaccgccatctctgggtctccagggggagagcctggccctgtcctttgctacccagggctgcccccaggcccatgaagccaataggagagcgtgtggcactggcccacaaactgtccctgtcctgtcttcctcccgagccatggcctctgctagctccaccttgaaggagccccccacatcctcccctacatcccagagatgccaccacttgtgtctccacaatgtgctcctgcccacccgggttccgcactgtccgacccctgcacaccactcatgtcaccacggcgtgcatcatgttcatccccatctatttatttaagcctttctttgcttgtagggcattttgtatgtagagcagttgaaaacagaacctcagaacttaacatctgtcctgatgttaaagtgcttttcatgaccaccctgttatctatgtatatgtaaagttaaggatgagatcttaagtttacaattaaaaactcagtactcaatatttaatattctactcgagctttatggaagccaaatcatgtgcatgtgtgtgtgtgcgtgtgtgcaagctttgaacctccttccacagccgcatcttctcatgacacaaagcttttgataagtactttcctgtgggtcgctcagcgcctcatagcatctcattcaattgcaagaatagaggccagacacggtggcgcatgcctgtagtcccagctaactgggaggctgaggcaggaggatcacttgagcccaggagattgaggctgcagtgagcatgatcgcgacactgcactccagcctgggtgacggtgagactttgtctc

SEQ ID NO: 1189 - DNA, 5587 bp, Homo sapiens
gagtcggggataaacactccgcggcggtggcggctgctgctctgctccgggttctgtcactgtgtcggcggtgcccagctcactggccccctccctctcttgtcgagcgtggttgccagagaggctccctcagccctgctccgcggggtccacagcgggctccacagcgggctccatagcgggctccacagcggtccggcggcggcagcgagcccgtgggcagtgggggttggtcccgtggctccggcccccggtgcagaatggcggcggcggttcggatgaacatccagatgctgctggaggcggccgactatctggagcggcgggagagagaagctgaacatggttatgcctccatgttaccatacaataacaaggacagagatgccttaaaacggaggaacaaatccaaaaagaataacagcagtagcagatcaactcacaatgaaatggagaagaatagacgggctcatcttcgcttgtgcctggagaagttgaaggggctggtgccacttggacccgaatcaagtcgacacactacgttgagtttattaacaaaagccaaattgcacataaagaaacttgaagattgtgacagaaaagccgttcaccaaatcgaccagcttcagcgagagcagcgacacctgaagaggcagctggagaagctgggcattgagaggatccggatggacagcatcggctccaccgtctcctcggagcgctccgactccgacagggaagaaatcgacgttgacgtggagagcacggactatctcacaggtgatctggactggagcagcagcagtgtgagcgactctgacgagcggggcagcatgcagagcctcggcagtgatgagggctattccagcaccagcatcaagagaataaagctgcaggacagtcacaaggcgtgtcttggtctctaagagagtgggcactgcggctgtctccttgaaggttctccctgttggttctgattaggtaacgtattggacctgcccacaactcccttgcacgtaaacttcagtgtcccaccttgaccaaaatcagctttgtaactgttttcaaggaggtgcttaggattgtgggtttctgattgcatccactagcttctctttttctcgccataaaaatttgtctctgagagactatacattccaatcaatttgaagcatccaagaattcttagaccgaataagcaatgtccacatctcagcaatccccctctttgctctcctcgtgtcctctcccagacctttcttccagttttctggcttactgtgttacttgcctaggaggaatgtccaagtgtgtcttgtacttaggaaactgaaggaaacaaacttttgaaattgagatcctgatctcagaactccaaagtaagctttgaaagcagcatttaagagcacttaaccatggacctcaccaccagtgaggaagtcaggaatacctctagaaaacacgcccttcacaccgcgcatgctcattcccccgacgcgccgcgtgtggatgggagcagtatttctcactttaaaatggacaccttgatagtgtgtctctggggttgcacagctcatcaaagttccaaattgtttgttctcacaaacaaaacggtacaatctatttttgtgcgatgttcttgggacctcgctgtgttctgctatctcgaggcacattctcccctccaactttgttaatgctacttgtctctggaacatttttttttcctacctcagagataaatgagatctccatttcccacttaacacagtgattatccttttttccccccccaaaatagtgacatttggtccaattataatctattttcctattgaactttcagcaataactgagctgtggcactagcagagctagtagccattatcagtgaaagaaaaagtccacatttctactctctgttgcaggtgaacaggagaggatggtacactgttactagaactcctctccttattgattatttttggacacacccagaaacttctttatggaggcttttgggttgatagtttaaaaggctgatttttctttttggttatgatttctcccttaagtggtctccgactttgtagcatttttatttaagctaaaacagagcacatgtatatgtacataagacacattaaatctataaatactatttattcattttatataaactaatgtaatggaaaacaaattcttatgactttgtggttttatagatgttctagaaactttgtatgtaggtatctacaaaattagttcattcccctgaatatttttgcattcatatttttgaggtcttgatgttttcagcctctggcgaatctttttcattgaatttgaaccatttgtaaaatctgtgatgctgaagcagagtgtgtcacaaagtgatgagaacattactaaaatccacggacgcactgcgacctaagggctcaacggctgactcggcagcgggcagccaccccacgctcccctgcggtcactcgcacaccacagcctgaagctcccccagcgcctgcacctcgcacacagctaaggtcaaagttcaaacgcactccacacggaagctcattctatacccgaagagcagtctcagaaagcaagattacttttgtgttttttaaaaaatgattctttaatgtatttttctaaacattctgattggaagtagtggattcctaaatgattccaaagtcacctgtaattcttctgtttttgttttgttctgtcttttcttcattttggctttgggtggggggaggggcaggtgacacaaaggattttttttttttttttttaatttttggaatcttttccaataaccagctaaagatttgcactgaaatacaacttgtatgccttttgcatttttaaagcctgcttcctggatttaagcagagtgatagtgttcaaagagccagttcagcctgtaacatatttgaaaaagatatgtctgcactttgaggtcccttttgaatgccattcactagacctctcaagcattttgtttcattgctacatccaagcgcctcacaagtccacaatgcgggacagcatcaaaagctcaagactttggaaaaagcttgtgggcttgcactgggggagggaagggaacaaaatttgtgtacttctttgtttaatttagaaataaggcatccaagagatgccattattttctgtgtttcaattgttgtgcctttgagttaaactgcatttttgtcttttggttgaaatctgaaatgtactgtcccaatataaaacagtaattatttgacctttgcactgtttgtctggtccttttcagtttgattgcatataaatgtggaacttgatagatctctatatttttaatgcacttgtgataaactggcagcagggttagacattactttcaaagcttgaggtagaccgagtcagcatgctagacaggcttctctctctaaccaaaactgtaatcttcaggaccagcaaactcagcccaaggcagctaatccccccaaccccatcctccgcgccccgtgcggctgatcggcagccctgattcgccaatttgtcctctctcattcactgatccaccagcctgactgctaagagctatagtctttttagttgttttgtctttttaagcaagatgaaaacctttctattagggattttggggttgggaggggatgggcagagatataaaccccagcctttaagactttgacaattgtacgtaaatacagatgtgtataaatataggcacatgcatatttttatgtgaaagttgattttaaaaaactaaaaaaatctaaactgcactcttattgataccatcataacgcaagtgggaaaaataagagtacgcagtctaatttaatttcatgcagtgggaaaatatatatgtgtgcttctgtaacatcctgaaaacatagctttccatcccctgttggctttgaatggtgggccgagcacccaggtcgtctgtattttggttttcttttgctaagcagagatcttgaattcttcaaggtgctgatagcaactgctggctcctttctgtagtcacacacctaatgctagtttagtgattcaaaatgcatcacatttttaggcaggacctagattttccctgtcaacctaagatgaaaataatttcagtgttgattcagaactgaacattaagtaggccctcgtcctgcagttggccacttgagtgttttgttttgtttttattttttaaggtgggcattttcctttaacctctactttttcaaaagcaacaaaggggcctcaacctgagtttcctatgggcctctcttctgcatccccaaagcggccaagagcaaatcctgggggataagaaaaaagtgtaaactaggtaggattgtgatgctcaaaataaccatctagcaatatcttggagcttgagaatagattttgtgggcttatttcttcttgcctcttccccatcctttcaagagagaacttatttttgaaaagtatctatatatacacacacacacacacacacacatattattatttaggtttttataccatactgtattggcgagaataccactatcattgtcctttacagtctatttcttcccccaagtcttggtctttttttattttctattttttcatgaaccacacaggagactttaacatcctggtcttttctgtttcttctttgtttccccaagtttgtctgtccccctttgccttccctgagtgttgaacatcaggtagtaaaaggctaaacgcaatttcttgcatgtcaatctattctttttctatgtttgactctgatgcagtgtgtttagcgtgtctagtagctggctactcctatttaaaaactcttcctggtagaagacaacccaaagacccttttcgatgaggtggtttctcattctacatcctctgatctctatagactgtaggatgctttgctttcaaagataactgggttagagggtggggtgtgcaataggtgatttatcatggtttttttcattatcaatattacatggatgattttctcagattcttctgaaagaagaaattgacaggcactgctagattcagctattgaatggctgaagagattgagtatttgaccttctctcaaaatcataaagtgagaattcataaggcacccaatgttaagatttatccagatttttacattttgatttcttctctctgtggggtggcaagttgagggagcattcttcattttagcttttacctgacaaccaaacttgcctttaccccatccctagaattggtgctcttggaatattgctgttaccatcatttttggggggccatcttcctaatgctacacacagcctgacaggggagcagcagatgaaagggtatgctattctgtttccagatgtttctttatgtaaatatgacgccaatgtaaatcctgtgtcaagatcatagagaatggtgctttttactacagttagcacatgcatttttagaaactactacatgttttagagaatctttgctgtgtatatgtaaactgtattgttcaactgttaacaaataataaattatttcattattaaagaaa

SEQ ID NO: 1190 - DNA, 812 bp, Homo sapiens
agagaggctccctcagccctgctccgcggggtccacagcgggctccacagcgggctccatagcgggctccacagcggtccggcggcggcagcgagcccgtgggcagtgggggttggtcccgtggctccggcccccggtgcagaatggcggcggcggttcggatgaacatccagatgctgctggaggcggccgactatctggagcggcgggagagagaagctgaacatggttatgcctccatgttaccatacaataacaaggacagagatgccttaaaacggaggaacaaatccaaaaagaataacagcagtagcagacgggctcatcttcgcttgtgcctggagaagttgaaggggctggtgccacttggacccgaatcaagtcgacacactacgttgagtttattaacaaaagccaaattgcacataaagaaacttgaagattgtgacagaaaagccgttcaccaaatcgaccagcttcagcgagagcagcgacacctgaagaggcagctggagaagctgggcattgagaggatccggatggacagcatcggctccaccgtctcctcggagcgctccgactccgacagggaagaaatcgacgttgacgtggagagcacggactatctcacaggtgatctggactggagcagcagcagtgtgagcgactctgacgagcggggcagcatgcagagcctcggcagtgatgagggctattccagcaccagcatcaagagaataaagctgcaggacagtcacaaggcgtgtcttggtctctaagagagtgggcactgcggctgtctccttgaaggt

SEQ ID NO: 1191 - DNA, 4056 bp, Homo sapiens
atcccagcccagctctgcatctgtcaacattctcggcccggcccgaggcgctcgacccgtccccattggccccagcccggcccggcgcccgcccccggggcgcgaacgccgcctcccattggctctgcgggccgccgctctcccttatgtgtcaatttgagggcctgaggcggagggtggcggccgagcgccggagtccgcggagtctggaagtgcggcggccgggcgcgcggggtgggcggcgagcggagccggccggagcgggccgggcagcggccgccgccgtcccggggcggacgggcgcgggcgggaggatggagctgaactccctgctgatcctgctggaggcggccgagtacctggagcgcagggatcgagaggccgagcacggctacgcctcggtgctgcccttcgacggcgacttcgccagggagaaaacaaaggcggccggcctggtgcgcaaggccccgaacaacaggtcttcacacaacgagctagaaaagcacagacgagccaaactcaggctgtaccttgagcagctcaagcaactggtgcccctgggccccgacagcacccgccacaccacgctgagcctcctgaagcgggccaaggtgcacatcaagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaagaagtggacatagagggcatggagtttggccctggtgagctggacagtgttggcagcagcagtgacgcggacgaccactacagcctgcagagtggcaccggcggcgacagtggcttcgggccccactgccggcggctgggccgccccgccctctcgtaggcccgtgccctctgctccttggcctgcctgcccgccagccacgcgtgtcagccctccagttctccttcagttgacgccagcctctccacaggcccactgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttcccagaaaaaaaaaaaaaaccatttttaaaaagaagaaagcctaaagactctcggcctagggacgtccgtgtgtgccgcctctgtttcctgtaccagatttttgtattctattttcctagctgttgttgcgtccttgtttgctgaggggtgggagccacccagcgtctcagggacctgtccctccgtcacgtcgtcaaagtgtgccttgtgtcttgtgtcaggccttgcccttcccaccagcatgtccctcgtggctcagggtgccccaggcctgcccagctagtgctgtcctcccatctcctgtgggcagcccctcccggcagccagggcttcctggaggcgatgcagccaggcccctgtgggtggcacggaggggctgtgacctggtccccagtgttgccctccccagtggctggcaggggcctgcttgctcactagagagatggattctcacctgtcacctgactcgagccccctgcttcctggcctaggcgagggttccaggtttcagacactggcagccaatgaagactgtgctcgctgggtggtgcaggcctggcaccaggaggcttgcacccgcctttccttcctgacgtcctctgtccttggggctggcccatagcagtgcctgccgtgcctctggtacatctgtagccaattcccatatcatggggaaaattcgtgtctattttcagtcgtacgcatagacgccccaggatggggggcccactgtggcggaagggggtccctggaaacaactctggcacagaacctgccctgcaggctgtagggggcatggtgcctggagctgaggggcatccgaacgcgttgcgggtggttgtgaggaggcctgtctgcatctccttccggccccactggggtccaggggtgcccagaaaggagcttcccctgcctgcctgagtctgtccccccaggcttcatttcaaacaccgtggcacctccgagcaaggcgggccgtgtgtaaaagcttgcttccccagccagcactgcagggccctgaggtggtcgtgtccctgccctcaattcttgaagcaccagctccctgccccaccctccagtgcctgaggcagctaggggcttctgctctcatctctgaccagcagaatccacccggtgaccagtggtggcccctcagcccaccctcccggcagctcagcctgtggctcttgaggccgtggttcccacgtggactgggaggcagtctcagccacccggggtgctgttcagctgcccctccctgccatcagcaggtgggtgaggggttgcccactgggtgggggcccgtgctaggagtcaccacatgctccaacctcccactgctccctgtcaggggcccaggctgccatcactggaggctgcagggaccaagaggccatcaccgtgtctatagagagcagacagaagcagaacagagcccggggctcctgagcctctgcgtgtgccctcccagcccacaccagtgctctcggccactgagcacccagactcaggcttgggttccccagccttattggaaggcagctcccgcataccaggataacccccgcaaaccacatagcagacccccgccatcctcgcagagtgggagaggctgcagcaaggctttgcctctgcagaccccatcttagtggcacggtgcttgggcctgtgtccccgggtggtggaaccctgtaccggtctgtggccctagggtccctgctctgtctgccccggcccgtgctgtccgctgggtgaggcaggctcccccgtgccctgcctccctctgtcagggaacctgggaccccctccccactgcctgcacagaggaccctgaccctcggccagcagggtggccccaggtccatgttgggcactagggcaggttccgtgccagagtcgggggccacacgagggcctggtgccggtgaggggggcgtgcgctagagggggaaaggggcccccggccacctgtccaccgtgtgggccgtgctgtgtccttatgtcattgtaatataaatacagatttttatatctca

SEQ ID NO: 1192 - DNA, 1483 bp, Homo sapiens
cgcggagtctggaagtgcggcggccgggcgcgcggggtgggcggcgagcggagccggccggagcgggccgggcagcggccgccgccgtcccggggcggacgggcgcgggcgggaggatggagctgaactccctgctgatcctgctggaggcggccgagtacctggagcgcagggatcgagaggccgagcacggctacgcctcggtgctgcccttcgacggcgacttcgccagggagaaaacaaaggcggccggcctggtgcgcaaggccccgaacaacaggcctcctcagtgagcaagcccggcccccgctgccgcttctctccaaaccaagtccctgacccgtggagaactctggggcgtgagctggggctcccccagcatggagaatccaaagctgacaaccagcgtcctggccaaggctgcccgaacactgcctctatgctgagcgtttcacacatgcagccagttcatcttcaccccaggctcagagaggtcttcacacaacgagccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttccc

SEQ ID NO: 1193 - DNA, 1885 bp, Homo sapiens
atcctggggccacccgagttaaaggggggaaatccgggggctgctgcacccgccaccggtctgggcccagccgggggccccctgtagtcgccgcagtcccggggagaggcacctgcccccagcccggggagggggcgccgcgggctcggggagcacggacaacccctacccatgaggccctgatggaaaacacaaaggatctgagtcggaagagacattagaggtcatccaaagcagccgtcccctctgcagcctctctgacaagtgactgaacattcttcacgatctgaaaggaaaagaagagattctttcgggatgtttgacggttatgatagctgcagtgaggacacaagcagcagctccagctccgaagagagtgaggaagaagtcgctcctttaccttctaatctcccgattatcaaaaacaatgggcaagtctacacatacccagatggtaaatctggcatggctacctgtgagatgtgtgggatggttggcgtccgagatgctttttactctaaaacaaagcgtttctgtagcgtttcatgttcaagaagttactcgtcaaactccaagaaggcaagcattttggccagacttcagggtaagcctccaacaaagaaagcaaaagttcttcagaaacaacctttagttgctaagctagccgcatatgctcagtatcaagctaccttgcaaaatcaagcaaagacaaaagcagcagtctccatggaaggtttcagctggggtaactacatcaatagcaatagctttatagcagctccggttacctgttttaaacatgcacctatggggacctgctggggtgatatctcagaaaatgtgagagtagaagttcccaatacagactgcagcctacctaccaaagtcttctggattgctggaattgtaaaattagcaggttacaatgcccttttaagatatgaaggatttgaaaatgactctggtctggacttctggtgcaatatatgtggttctgatatccatccagttggttggtgtgcagccagcggaaaacctcttgttcctcctagaactattcagcataaatatacaaactggaaagcttttctagtgaaacgacttactggtgccaaaacactgcctcctgatttctcccaaaaggtttcagagagtatgcagtatcctttcaaaccttgcatgagagtagaagtggttgacaagaggcatttgtgtcgaacacgagtagcagtggtggaaagtgtaattggaggaagattaagactagtgtatgaagaaagcgaagatagaacagatgacttctggtgccatatgcacagcccattaatacatcatattggttggtctcgaagcataggtcatcgattcaaaagatctgatattacaaagaaacaggatggacattttgatacaccaccacatttatttgctaaggtaaaagaagtagaccagagtggggaatggttcaaggaaggaatgaaattggaagctatagacccattaaatctttctacaatatgtgtcgcaaccattagaaaggttacacaaaacttccttttaaatggtttgactacctcagggaaactggctccattgcagcaccagtaaaactatttaataaggatgttccaaatcacggatttcgtgtaggaatgaaattagaagcagtagatctcatggagccacgtttaatatgtgtagccacagtaactcgaattattcatcgtctcttgaggatacattttgatggatgggaagaagagtatgatcagtgggtagactgtgagtcacctgacctctatcctgtagggtggtgtcagttaactggatatcaactacagcctccagcatcacagtcatcaagagaaaaccaatcagcttcatc

SEQ ID NO: 1194 - DNA, 5382 bp, Homo sapiens
ggagggagggctatgctaatgttgttgatatcctggggccacccgagttaaaggggggaaatccgggggctgctgcacccgccaccggtctgggcccagccgggggccccctgtagtcgccgcagtcccggggagaggcacctgcccccagcccggggagggggcgccgcgggctcggggagcacggacaacccctacccatgaggccctgatggaaaacacaaaggatctgagtcggaagagacattagaggtcatccaaagcagccgtcccctctgcagcctctctgacaagtgactgaacattcttcacgatctgaaaggaaaagaagagattctttcgggatgtttgacggttatgatagctgcagtgaggacacaagcagcagctccagctccgaagagagtgaggaagaagtcgctcctttaccttctaatctcccgattatcaaaaacaatgggcaagtctacacatacccagatggtaaatctggcatggctacctgtgagatgtgtgggatggttggcgtccgagatgctttttactctaaaacaaagcgtttctgtagcgtttcatgttcaagaagttactcgtcaaactccaagaaggcaagcattttggccagacttcagggtaagcctccaacaaagaaagcaaaagttcttcagaaacaacctttagttgctaagctagccgcatatgctcagtatcaagctaccttgcaaaatcaagcaaagacaaaagcagcagtctccatggaaggtttcagctggggtaactacatcaatagcaatagctttatagcagctccggttacctgttttaaacatgcacctatggggacctgctggggtgatatctcagaaaatgtgagagtagaagttcccaatacagactgcagcctacctaccaaagtcttctggattgctggaattgtaaaattagcaggttacaatgcccttttaagatatgaaggatttgaaaatgactctggtctggacttctggtgcaatatatgtggttctgatatccatccagttggttggtgtgcagccagcggaaaacctcttgttcctcctagaactattcagcataaatatacaaactggaaagcttttctagtgaaacgacttactggtgccaaaacactgcctcctgatttctcccaaaaggtttcagagagtatgcagtatcctttcaaaccttgcatgagagtagaagtggttgacaagaggcatttgtgtcgaacacgagtagcagtggtggaaagtgtaattggaggaagattaagactagtgtatgaagaaagcgaagatagaacagatgacttctggtgccatatgcacagcccattaatacatcatattggttggtctcgaagcataggtcatcgattcaaaagatctgatattacaaagaaacaggatggacattttgatacaccaccacatttatttgctaaggtaaaagaagtagaccagagtggggaatggttcaaggaaggaatgaaattggaagctatagacccattaaatctttctacaatatgtgtcgcaaccattagaaaggtgctagctgacggattcctgatgattgggatcgatggctcagaagcagcagacggatctgactggttctgttaccatgcaacctctccttctattttccctgtcggtttctgtgaaattaacatgattgaacttactccacccagaggttacacaaaacttccttttaaatggtttgactacctcagggaaactggctccattgcagcaccagtaaaactatttaataaggatgttccaaatcacggatttcgtgtaggaatgaaattagaagcagtagatctcatggagccacgtttaatatgtgtagccacagtaactcgaattattcatcgtctcttgaggatacattttgatggatgggaagaagagtatgatcagtgggtagactgtgagtcacctgacctctatcctgtagggtggtgtcagttaactggatatcaactacagcctccagcatcacagtcatcaagagaaaaccaatcagcttcatcaaaacagaagaaaaaggctaagtcccagcaatacaaaggacataagaaaatgacaacactgcagctgaaggaggagttgctggatggagaggattataatttccttcaaggagcgtctgatcaggaaagcaatggctctgccaacttctacatcaaacaagagccatgaggtggcttagaaactgagggcgggtggggaaggattttacacaggactgatttataatcaatccagctgtacagggggctactctactgggacattttgctaaacatagaagatttcagttccagatttttcaggtgggtgggggagctattttagtcgggggggcaggggggtgggaaattttcaatttataaagatggacaatttttgtgttgtatttgaagcttttgaaagaattttgtaatattttccaagtttggatttatgtgcattgttaacaagaactgaaattctaacttttttggtaacattaaagtttaggtagcaggattgaaggaaatgatttaagaaggatatagctgttaaatgcaaatgaactgtcattacaaatgaacctttttggtacctgttgggagattttgggatttttagaagttaggccagtcacatctccagcttcttttgctgcagaaatatgcaactgaactcctcatggaggggtcatcaccacaaaggtcatggaagggtcattatttctcttgttggcattttattgcagcccattttaaatgtttgtacagaaatatttttcattctgtgaaaatttatttggagttctgtatgaaactggaagaactctggatacttttatatgttctcttttaattaaaaaaatgattagaattatcctaacactaaagtgttaaactggaatggttgacaagatattcaggatctcagtctacacattgaggggttggggaaaatgtaatgttgtccttagtttattttcctttctaaaaaaaataccccacgaaagggattctgatcagttctctgccatttccctctatctgtgaaataacagcttcgtataaccacaaccaaaaacagatgttctgtattaggagaatcgaattgaaagttattcaaagccaaaataagtttagatttcaaaatcattccagctctgcttttatctatcctggatttggtagaaaactaatttgaaagagaatttaattttcttaaaattccatatatatatatatatatatatatatatatatatatatatatatatatatataaaattgtctttaattgtattcaggatttattttaataataaccgatttggaccattttgaacattccctgttttaaaattcatatgacttccttttaaaaaaaaaaaaaggatacaagggtaaactggtgaaaggtttgctctctgcattttctaactttctactgagttgtgactgaatgagagcgctctagcgtttaccagtgaggttcataaactaaactctcaggaattaattgcatctgttctagaagtgcttctgggtcttagcctggcctcttcagagtggtaatattgaccatctcctctggaatataggtagggctaattagaaattaatcaaaatgattaacctctacagtccttcagcctatggaatgctttaaaaaatgttaatggaaagccccaggagaccattttaggtaagacttttgtttgaattttaaaatgcatagaacgttaaaaaaaaccagcaatttattttctaaaatattgctctacttttgggaataatagcattggtaatacgcacaggtttacctcattctatgcaagaggggttaataacataaggttttataatagctactggaagtaaaatttgttactttatagtgtaagaatgtatggaatcgcatgtcaccatttcttaatactgactctttaggggcataaatgcagatcacatcaacgcaagttgattctcatgtgtcaaatatatgtgaattcagctgttaaattactggatatttatcttaacattgctgagagggacctactgtaaatgtgacatcctcacacttcccatatctttaactttgaaaaatcttcttgtaaacttaaagcctagaagtattccaaagcaagggttagagcagtctttattctcaggctcactgaattaaacccaggactaattccacagcacaggcacaagaagcctgttgtgtagtgtactctgccagtaccttggatttaggagctccatggggaactgactaaaccaggagagagaggatttggagctagtcagtcctggtaatctatgaaatgctcatttatacccaggtttcataagcttccaattctatagcaaacccaggctctgagtgttttagaatttcctaattcatgaagtgtttcttgtcttgatcccgtgaccaacagttgaaggttggtaaggacttttctacagtctgaacacaacctaaagccctctttcattgttcacacactaactcctactgccgacgaaccgaaaaataattaatgcagaggagatttatgtcttagccataactccagttgtacaactcaatcgccccattctcttttacggttcaaaatgtactgctgaccttgggtttgtttttgttttgttttgtttttcctgttaggatttatttggggacttttggtagtttaaactctttaaccttttccttgccgtgtatgaggaaagctaaagctgttatcaacttcttattctacgatactaacacgggttttcagtgtttgtttgtttttattattattattaattttgcgtgatgtgaataccctctcccatcaatatttgtattatggtgctatatattggtaatgatcctttaatattgggaagggattttaaaaatactgtgattaaactgggtttcttcctttgattttcatattttaaataaagccacagtcatttatacaaaagaaaagcatctgtccctgggcaaatcttttgaggacagaggtcaaagtaaactgcataaggtttttacatcatttctgtatgtatttgatatatagatcaatatctgtacaaatttaatcttttattttcttggtaactcgtgatcattgagaaagtgtttgaaactttctcatgaagtgtatatataatggcgtgaaaaattcctttggaaaaatttatgttcctttcatttttaccaaattgcaaattttcagcatggatgtgaaaagcattaaaattataactttgtgtacaagatgaaaataattcactaaatttgcccttttttacacaaaataaaatgttaaagttaa

SEQ ID NO: 1195 - DNA, 5099 bp, Homo sapiens
tctcttacttcaaagactgaacattcttcacgatctgaaaggaaaagaagagattctttcgggatgtttgacggttatgatagctgcagtgaggacacaagcagcagctccagctccgaagagagtgaggaagaagtcgctcctttaccttctaatctcccgattatcaaaaacaatgggcaagtctacacatacccagatggtaaatctggcatggctacctgtgagatgtgtgggatggttggcgtccgagatgctttttactctaaaacaaagcgtttctgtagcgtttcatgttcaagaagttactcgtcaaactccaagaaggcaagcattttggccagacttcagggtaagcctccaacaaagaaagcaaaagttcttcagaaacaacctttagttgctaagctagccgcatatgctcagtatcaagctaccttgcaaaatcaagcaaagacaaaagcagcagtctccatggaaggtttcagctggggtaactacatcaatagcaatagctttatagcagctccggttacctgttttaaacatgcacctatggggacctgctggggtgatatctcagaaaatgtgagagtagaagttcccaatacagactgcagcctacctaccaaagtcttctggattgctggaattgtaaaattagcaggttacaatgcccttttaagatatgaaggatttgaaaatgactctggtctggacttctggtgcaatatatgtggttctgatatccatccagttggttggtgtgcagccagcggaaaacctcttgttcctcctagaactattcagcataaatatacaaactggaaagcttttctagtgaaacgacttactggtgccaaaacactgcctcctgatttctcccaaaaggtttcagagagtatgcagtatcctttcaaaccttgcatgagagtagaagtggttgacaagaggcatttgtgtcgaacacgagtagcagtggtggaaagtgtaattggaggaagattaagactagtgtatgaagaaagcgaagatagaacagatgacttctggtgccatatgcacagcccattaatacatcatattggttggtctcgaagcataggtcatcgattcaaaagatctgatattacaaagaaacaggatggacattttgatacaccaccacatttatttgctaaggtaaaagaagtagaccagagtggggaatggttcaaggaaggaatgaaattggaagctatagacccattaaatctttctacaatatgtgtcgcaaccattagaaaggtgctagctgacggattcctgatgattgggatcgatggctcagaagcagcagacggatctgactggttctgttaccatgcaacctctccttctattttccctgtcggtttctgtgaaattaacatgattgaacttactccacccagaggttacacaaaacttccttttaaatggtttgactacctcagggaaactggctccattgcagcaccagtaaaactatttaataaggatgttccaaatcacggatttcgtgtaggaatgaaattagaagcagtagatctcatggagccacgtttaatatgtgtagccacagtaactcgaattattcatcgtctcttgaggatacattttgatggatgggaagaagagtatgatcagtgggtagactgtgagtcacctgacctctatcctgtagggtggtgtcagttaactggatatcaactacagcctccagcatcacagtcatcaagagaaaaccaatcagcttcatcaaaacagaagaaaaaggctaagtcccagcaatacaaaggacataagaaaatgacaacactgcagctgaaggaggagttgctggatggagaggattataatttccttcaaggagcgtctgatcaggaaagcaatggctctgccaacttctacatcaaacaagagccatgaggtggcttagaaactgagggcgggtggggaaggattttacacaggactgatttataatcaatccagctgtacagggggctactctactgggacattttgctaaacatagaagatttcagttccagatttttcaggtgggtgggggagctattttagtcgggggggcaggggggtgggaaattttcaatttataaagatggacaatttttgtgttgtatttgaagcttttgaaagaattttgtaatattttccaagtttggatttatgtgcattgttaacaagaactgaaattctaacttttttggtaacattaaagtttaggtagcaggattgaaggaaatgatttaagaaggatatagctgttaaatgcaaatgaactgtcattacaaatgaacctttttggtacctgttgggagattttgggatttttagaagttaggccagtcacatctccagcttcttttgctgcagaaatatgcaactgaactcctcatggaggggtcatcaccacaaaggtcatggaagggtcattatttctcttgttggcattttattgcagcccattttaaatgtttgtacagaaatatttttcattctgtgaaaatttatttggagttctgtatgaaactggaagaactctggatacttttatatgttctcttttaattaaaaaaatgattagaattatcctaacactaaagtgttaaactggaatggttgacaagatattcaggatctcagtctacacattgaggggttggggaaaatgtaatgttgtccttagtttattttcctttctaaaaaaaataccccacgaaagggattctgatcagttctctgccatttccctctatctgtgaaataacagcttcgtataaccacaaccaaaaacagatgttctgtattaggagaatcgaattgaaagttattcaaagccaaaataagtttagatttcaaaatcattccagctctgcttttatctatcctggatttggtagaaaactaatttgaaagagaatttaattttcttaaaattccatatatatatatatatatatatatatatatatatatatatatatatatatataaaattgtctttaattgtattcaggatttattttaataataaccgatttggaccattttgaacattccctgttttaaaattcatatgacttccttttaaaaaaaaaaaaaggatacaagggtaaactggtgaaaggtttgctctctgcattttctaactttctactgagttgtgactgaatgagagcgctctagcgtttaccagtgaggttcataaactaaactctcaggaattaattgcatctgttctagaagtgcttctgggtcttagcctggcctcttcagagtggtaatattgaccatctcctctggaatataggtagggctaattagaaattaatcaaaatgattaacctctacagtccttcagcctatggaatgctttaaaaaatgttaatggaaagccccaggagaccattttaggtaagacttttgtttgaattttaaaatgcatagaacgttaaaaaaaaccagcaatttattttctaaaatattgctctacttttgggaataatagcattggtaatacgcacaggtttacctcattctatgcaagaggggttaataacataaggttttataatagctactggaagtaaaatttgttactttatagtgtaagaatgtatggaatcgcatgtcaccatttcttaatactgactctttaggggcataaatgcagatcacatcaacgcaagttgattctcatgtgtcaaatatatgtgaattcagctgttaaattactggatatttatcttaacattgctgagagggacctactgtaaatgtgacatcctcacacttcccatatctttaactttgaaaaatcttcttgtaaacttaaagcctagaagtattccaaagcaagggttagagcagtctttattctcaggctcactgaattaaacccaggactaattccacagcacaggcacaagaagcctgttgtgtagtgtactctgccagtaccttggatttaggagctccatggggaactgactaaaccaggagagagaggatttggagctagtcagtcctggtaatctatgaaatgctcatttatacccaggtttcataagcttccaattctatagcaaacccaggctctgagtgttttagaatttcctaattcatgaagtgtttcttgtcttgatcccgtgaccaacagttgaaggttggtaaggacttttctacagtctgaacacaacctaaagccctctttcattgttcacacactaactcctactgccgacgaaccgaaaaataattaatgcagaggagatttatgtcttagccataactccagttgtacaactcaatcgccccattctcttttacggttcaaaatgtactgctgaccttgggtttgtttttgttttgttttgtttttcctgttaggatttatttggggacttttggtagtttaaactctttaaccttttccttgccgtgtatgaggaaagctaaagctgttatcaacttcttattctacgatactaacacgggttttcagtgtttgtttgtttttattattattattaattttgcgtgatgtgaataccctctcccatcaatatttgtattatggtgctatatattggtaatgatcctttaatattgggaagggattttaaaaatactgtgattaaactgggtttcttcctttgattttcatattttaaataaagccacagtcatttatacaaaagaaaagcatctgtccctgggcaaatcttttgaggacagaggtcaaagtaaactgcataaggtttttacatcatttctgtatgtatttgatatatagatcaatatctgtacaaatttaatcttttattttcttggtaactcgtgatcattgagaaagtgtttgaaactttctcatgaagtgtatatataatggcgtgaaaaattcctttggaaaaatttatgttcctttcatttttaccaaattgcaaattttcagcatggatgtgaaaagcattaaaattataactttgtgtacaagatgaaaataattcactaaatttgcccttttttacacaaaataaaatgttaaagtt

SEQ ID NO: 1196 - DNA, 5382 bp, Homo sapiens; identical to SEQ ID NO: 1194

SEQ ID NO: 1197 - DNA, 18413 bp, Homo sapiens
cgcctttcctgcgggcgtagttgctggctgctcgggcactgggacctcggcggcttggggacgctggccgcgaagtagggagcgcaggtggccgctcggggtgagggccctgggtcatggagcacttcttgctggaggtggcagccgcgccgctgcggttaatcgcagccaagaacgagaagagccgcagtgagttgggcaggttcttggccaagcaggtgtggacacctcaagatcgccagtgtgtcctgagtaccttagcacagttgcttttggataaggactgtactgtgctggttggtcgccagcttcgccctctccttttggatttgctggaaaggaatgccgaagccattaaagctggaggccaaatcaaccatgatctgcatgaacggctatgtgtgtcgatgagcaaactcattggtaaccatcctgatgtcctcccgtttgccctgagatatttcaaggacacatccccagtctttcaaagacttttcctagagagttcagatgctaatccagtacgctatggacgtaggaggatgaagctccgggacctaatggaagcagccttcaagtttctgcagcaggagcagtctgtgttccgggagctctgggactggagtgtgtgtgtccctctcctcagaagccatgacaccttggttcgctggtatacagccaattgtcttgctttggttacctgtatgaatgaagagcacaagttatcatttcttaagaagatatttaatagtgatgaattgatccatttcaggttgaggttattagaagaggcccagttgcaggacttggagaaggccttggttttggccaatccagaagtctccctttggcgtaagcagaaggagctgcagtacttacagggacatcttgtttcgtctgacctctcccctagggtgacagctgtttgtggtgtggtgctgcctgggcagctgccagcccctggagagctgggtggtaataggagttcttcacgtgaacaggagctggcccttaggtcttatgtgctggttgagtctgtctgcaaaagtcttcagaccctggctatggcggttgcttctcagaatgctgtgttgttggaaggaccaataggatgtggcaaaacttccttagttgaatatttagctgcagtgacaggtagaacaaagcctcctcagcttctcaaagtccagcttggagatcagactgacagtaagatgcttttggggatgtatcgctgcacagatgttcctggagagtttgtgtggcagcctggcaccctgacacaggcagccacaatgggccactggatccttctggaggatattgactatgcccccttagacgtggtttctgtgctgatccctctcttggagaatggagagctcttgattcctggccgaggtgactgtctgaaagtggcacctggatttcagttttttgcaaccaggagactcttgagctgtggaggaaattggtatcgaccgctaaacagtcatgctactttgctagacaaatattggaccaaaattcacctggataacctggataagagagaactgaatgaggttcttcagagcagatatcctagcctattggcagtggttgatcacctgcttgacatttatatccaacttactggagagaaacatcactcttggagtgatagttctgttggatgtgaacaggcacctgaagaagtttcagaagccagaagagaaaacaaaagaccaacccttgagggaagagaattatctctaagggatctgctgaattggtgtaataggattgcccatagctttgacagttcatctttatcagcatcattaaatatttttcaagaggctctagactgtttcacagcaatgctttctgagcatacaagcaaactgaaaatggcagaagttattggaagcaaattgaacatttctagaaaaaaggctgaattcttttgtcaactttataaaccagaaattgtgatcaatgagctagatttgcaagtgggtcgagtgcggcttctacggaaacaaagtgaggctgttcacctacagagggagaagttcactttcgctgctacacggccgtcctctgttctcatcgagcagcttgcagtgtgtgtcagcaaaggggagcctgtgttgctggtgggagagaccgggactggcaaaacctctaccatccaatacttggctcacattacaggccaccgtttgagggttgtcaatatgaatcaacaaagtgatactgcagacttgcttggaggttataaaccggtggaccataagcttatttggctacccttacgggaggcatttgaggaactctttgctcagacattttccaagaaacaaaactttacgttcttggggcacattcagacctgttacagacagaaacggtggcatgatctcctgagactaatgcagcatgtacacaagtctgctgttaacaaggatggaaaagacagtgaaactgggttactcataaaagagaaatgggaagcatttggtcttagactcaaccatgcccaacaacagatgaaaatgactgaaaataccttattgttcgcatttgtagagggtacattagctcaggctgtaaagaaaggagagtggatcttgttggatgagattaacttggctgctccagaaatactagaatgtctgagtggtttgcttgaaggatcttctggatccctggtgttgctggatcgaggagacacagagccactggttcggcatcctgacttccgtttatttgcctgtatgaatccagcaactgatgtaggcaaaagaaatctcccaccaggaataagaaacaggttcacagaactttatgtagaagaattagaaagcaaagaagacttacaggttcttattgtagattatctgaaaggattgagtgtgaacaagaatacagtgcaaggaatcataaacttctacacagctttgcggaaagagtctgggaccaaactggtggatggcactggccatagacctcactacagccttcggactctgtgccgggccctgcgatttgcagcctccaatccatgtggcaacattcagcgctcactctatgagggtttttgtttgggtttcttaacacagcttgacagggcatcacacccaatagttcagaagctcatctgtcaacacattgtccctggcaatgtcaagagtctgctgaagcagcctattccagagccaaaaggaggtcggcttatccaggttgaaggctactggattgcggtgggagacaaggagcctacaatagatgagacgtacattctgacatcttctgtgaagctgaacctgagagatatagtccgagttgtctctgcaggaacctatccagtgctgattcagggagagacatcagttggtaaaacaagcctgatccagtggctggctgcagctactggcaaccactgtgtgcgtattaataatcacgaacacacggatattcaggagtacattggttgttacacgtctgactcctcagggaagcttgtctttaaggaaggtgttcttattgatgccatgagaaaaggctattggattattttagatgaattaaatttggcccctactgatgtgttagaggcgctgaataggctgttggatgataaccgtgaattgctagtaacagaaacacaggaagttgttaaagcacaccctcggtttatgctttttgccacccaaaatcccccaggactttatggaggcagaaaggtcctttctagagccttcaggaatcggtttgtggaattgcactttgatgagttacctagctccgagttggaaacaatcttgcacaagcggtgtagtttgccaccctcctattgcagcaagttggttaaagtcatgctggatcttcagtcctatcgcagaagttcttcagtgtttgctggaaagcagggcttcatcacccttcgtgatctgttccgatgggctgaaagatacagattggctgagccgaccgagaaggagtatgactggctacagcatttagccaatgatggttatatgcttctggcaggtcgagtcaggaagcaggaggaaattgatgtgattcaagaagtccttgagaaacatttcaagaaaaaattgtgtcctcaatctcttttctccaaagaaaatgttctaaaattgctgggtaaattgtctactcagatatccacattggagtgtaactttggccatatcgtgtggactgagggcatgcggagactcgcgatgctagtgggaagggcattggaatttggtgaacctgtgctgctggttggagacactgggtgtgggaaaactactatctgtcaggtatttgcagccttggcaaatcagaaattatactctgtcagctgccacttacacatggagacatcagacttcctgggtggcctgcggccagtgagacaaaagccaaacgacaaggaagaaattgacacatcaagactctttgagtggcatgatgggcctctggttcaggccatgaaggaggacggctttttcctcttggatgagatctcattggccgatgactctgtcttggaaagactcaacagtgtccttgaagtagaaaagtctctggtattagctgaaaaaggcagtccagaggacaaggatagtgaaatagagctgttgactgctgggaaaaaatttcgtattctagcaaccatgaaccctgggggtgactttggaaaaaaggagctgtctcctgccttaagaaaccggtttacagaaatatggtgccctcaaagcacaagccgtgaagatttaattcagatcatcagtcataatcttcgtccaggattgtgtctgggcagaatagatcctaaagggtctgacatacctgaagtgatgctggatttcattgactggctgacccaccaagagtttggcagaaagtgtgtggtcagtatcagagatatcctgtcctgggttaacttcatgaacaaaatgggggaggaagctgctttgaaaaggccagagatcatctccactgtgacatcttttgtccatgctgcatgcctggtgtacatagatggaataggttcaggggtaacttcctctgggtttggtacagcccttttggcacgaaaagaatgtctgaaatttctaatcaagaggcttgccaagatagtacgacttacagaatatcagaaaaatgagttgaagatttatgacagaatgaaggccaaagaattcactggaatagataacctttggggaattcatccattttttataccaaggggacctgtcctacacaggaataatattgcagactatgcactcagtgcagggaccactgctatgaatgcacagaggctcttaagagctaccaaactgaagaagcccattctcctggagggttcccctggtgttggcaagacaagtttggtgggagcattagcaaaggcttcaggaaatacccttgttagaatcaacttatcagagcaaacggacatcacagacctgtttggagcagatctacctgttgaaggtggcaagggaggagagtttgcctggcgtgatggccccttactggcagctttgaaggcaggccattgggtggtgttggatgagcttaacctggcttctcagtctgtattggaaggactcaatgcttgttttgaccaccgaggagaaatctatgtgcctgagttaggaatgagctttcaagtgcagcatgaaaagacgaagatttttgggtgtcagaatccctttagacaaggaggtgggaggaaaggcttgcccaggtctttccttaacagattcactcaggtcttcgttgatccccttacagtaattgacatggagttcattgccagtactttgtttccagccattgagaaaaatattgttaagaaaatggttgctttcaataaccaaattgatcatgaagtgactgttgagaagaaatgggggcaaaaaggaggaccctgggaattcaacctccgggaccttttccgctggtgtcagttgatgctggttgaccagtcccctgggtgttatgatcctggtcagcatgtgtttttggtctatggtgaaagaatgagaaccgaagaggacaaaaaaaaggtcattgctgtattcaaggatgtgtttggttcaaattccaacccatacatgggaaccagactatttcgtatcactccctatgatgttcagttgggctactcagtcctttcccgtgggagctgtgttcctcacccgtcccgccatcccctgttgctcctgcaccagtcattccaacccctggagtcaatcatgaagtgtgtgcagatgagctggatggtcatcctggtcgggccagcctctgtgggcaagaccagcctggtccagcttctggcacaccttactggccacacattaaagatcatggctatgaacagtgcaatggatactactgagctgctgggtggatttgagcaggttgatcttatacgaccttggaggaggctgctagagaaggtggagggaactgtaagggcactgttaagggatagcctccttatcagtgctgatgatgcagaagtagtgctgcgagcctggagtcattttcttctgacatataagcctaagtgtcttggagaaggtggtaaagctatcacgatggagattgtcaacaaactagaagcagtgttattgcttatgcagcgactcaacaataaaatcaactcatactgcaaggcagagtttgccaaacttgttgaagagttccgaagctttggtgtgaagcttacgcagttggccagtggccatagccatggcacatttgaatgggttgacagcatgttggttcaggccctgaagtctggagactggcttctgatggacaatgttaacttctgcaacccatcagtgttggatcgtttgaatgctttgcttgaacccggaggtgtcctcactattagtgagagaggaatgatagatggatccactcccacgataacaccaaatcccaatttcagacttttcctctcgatggatcctgttcatggagatatatcccgagctatgaggaatcgtggacttgaaatctacatttcaggggaaggggatgcaagcaccccagacaacctggatttgaaagttctgctgcacagccttggattggtggggaacagtgtatgtgacatcctcttggctttacacacagagacccggagcactgttgtaggttctccaacatcttctgtatcaactctaatccagacagccatactaattgtccagtacctgcagcgagggctgagtttagacagagccttttctgaagcatgctgggaagtatatgtctgttcccagcattcaccagcaaaccggaagcttgtacaggctttactggagaaacatgtttcttctttgcgagcacatgaaacctggggagactccattcttggcatgggactgtggccagattctgtgccctcagctctctttgctactgaagattcacacctgtctacagtccgaagagatggacagatcttagtatattgtctcaacaggatgagcatgaaaaccagcagctggacaaggagtcagccttttaccttgcaagacttagagaaaattatgcagtcccccagccctgagaacctgaaattcaatgcagtcgaagtgaatacttactggatcgatgaaccagatgttttggtcatggctgttaaattgctcatagaaagagcaaccaatcaggattggatgctcagagttaaatggctttatcatttagccaagaatataccgcaggggcttgagtccatacaaattcatttggaagccagtgctgcatctctcaggaatttttactcacattccctctcaggtgcagtcagtaatgttttcaaaatattacaaccaaatacaacagatgaatttgtgatccctctggatccccgatggaatatgcaggctctggacatgattagaaatttgatggactttgacccacaaacggaccagcctgaccagctctttgcccttttagaatcagctgcaaacaagacaatcatatatcttgaccgggaaaaacgggtttttactgaagcaaatttggtttctgttggtagcaaaaagctaagagagagtgttttgagaatgtcctttgaattccatcaagatccagaaagctatcacactctgccccatgaaattgtggtcaatcttgctgctttttttgaactttgtgatgcactagtcctgctctgggtacagtcctcccagggaatggtgtctgatgccagtgccaatgagatcttaggttctctgcggtggcgggaccggttctggactgtggccgacacagtaaaagtagatgccccaggtctggcccttcttgccctccattggcactgggttttaaaacatctggtccaccagatcccccgacttctgatgaattatgaagacaaatattacaaagaagttcagactgtctcagaacatattcagaattgtctggggagccagactggtggcttcgctggtataaagaagttgcagaagttcctgggacgaccgtttccttttaaggacaagctggtggtggagtgtttttcacaactgaaggtccttaacaaagtccttgccatcagggagcagatgtctgcccttggggagagtggatggcaggaagacattaaccgtctccaagtggttgcttctcagtggacattaaagaaaagtctcctgcaagcctggggactgatcctcagagcaaatattttggaagatgtcagcctagatgaattgaagaattttgtgcatgctcagtgtttagaactgaaagccaaaggactctcacttggttttctggagaaaaagcatgatgaagcttcctccctgtcccatccagacttgacctccgtaatccacctcaccaggagtgttcagttgtggcctgcaatggagtacctggctatgctttggcggtacaaagtgacagctgattttatggcacaagcttgtctcagaagatgcagcaaaaatcaacaaccccagataaatgaggagataagtcacctcatctcattttgtctttatcacacacctgttacacctcaagagcttcgagatctgtggtccttgctgcatcatcagaaggtgtctcctgaagaaattacatctttgtggtccgagttatttaattccatgtttatgtctttctggagcagtactgtgaccacaaatccagagtactggctaatgtggaaccctttgcctggtatgcagcagagggaggcacccaagtctgttttggactccacattgaagggccccggcaatctcaatagacccatattctctaagtgctgctttgaagtcttaaccagcagctggagagcaagtccctgggatgtgagtggcctccccattctttcctcctctcacgtgaccctaggagagtgggttgagagaactcagcagctccaggacatcagttcgatgctttggactaacatggctatctcttcagtagcagaattcagacgcacggattcccaactccaggggcaggtgctgttccggcacctggcaggcctagcagagctgctcccagagtcccggcggcaggagtacatgcagaactgtgagcagctgctgcttgggagcagccaggccttccagcatgtgggccagacacttggggacatggctggtcaggaggtgctgcccaaggaactgctctgccagttgctcacctccctgcaccactttgttggtgaaggggagagtaagaggagcctgcctgagccagcccagcgtgggagcctctgggtgagcctcggcttgctccagattcagacatggcttccccaggcacgctttgaccctgcggtgaagagggagtacaagctcaattacgtcaaggaagagttacaccaactgcagtgtgaatggaagacccggaacctgtcatcccagctgcagactggaagagacctggaagatgaagtcgttgtcagctactctcatcctcacgtcaggctgcttcgccaaaggatggatcggctggataatttaacctgtcacctgttgaagaaacaggcctttagaccccagctgcctgcctacgagtccctggttcaggagatccaccactacgtcaccagcatcgccaaggcccctgctgttcaggatctgctcacacggcttctgcaggccctccacatagatgggccacggtctgcccaagtagcccagagccttctaaaggaggaggcctcttggcagcagtcacaccaccagttccggaagcggctgtcagaggagtacaccttctatccagatgccgtgagcccactgcaggcatccatattgcagttacaacatggcatgaggctggtggcctctgagctccacacctcactccacagcagtatggttggtgcagacaggctggggaccctggccacagccttgctggctttcccatcggtgggccccaccttcccgacttactatgctcatgcagacactttgtgctcggtgaagtctgaggaggttctacgaggccttgggaagctaatcctcaagcgctcaggaggaaaggagctggaaggcaagggccagaaagcctgtcccactcgggagcagctgctgatgaatgctctcctttacctgcgctcccacgtgttatgcaagggagagttggaccagagggccctgcagctcttcagacatgtgtgtcaggaaatcatcagtgagtgggatgagcaggaacgcatagcccaagagaaggctgagcaggaaagcggcctgtatagatacaggagcaggaactctaggacagccctgagtgaagaggaggaggaagaacgggagttcagaaaacagttccccctgcatgaaaaggactttgcagatattttggtgcagccaacgttggaggagaacaaaggaacttcagatgggcaagaagaggaagcaggcacaaacccagctctcctctcccagaattcaatgcaggcagtaatgctgatacaccagcaattgtgtctcaactttgctcgatccctctggtatcaacagactctgccgccacatgaagcaaagcattacctcagcctgtttctgtcttgctatcagactggggcatcgcttgtgacacacttctaccccctgatgggagttgaactgaatgaccgactcttgggcagccaacttttggcctgtaccctctcccataacactctttttggggaggcaccctcagacctgatggtgaaacctgatgggccctatgacttctaccagcatcccaatgttccagaagcacggcagtgtcaacctgtgcttcaaggtttctcagaggctgtcagtcacttgctacaggactggccagaacacccagcgcttgaacagctcctggttgtaatggacagaattcgtagtttcccactttccagtcccatctcaaagttcctgaatggcttagagatccttctggcaaaggcacaggattgggaggaaaatgcaagtcgagctttgtctttgcggaaacatcttgatttgatcagtcagatgatcattcggtggcgtaaactggagctgaactgctggtccatgagtttggataatactatgaagcgccacaccgagaaatccaccaagcactggttctccatctatcagatgcttgagaagcacatgcaggaacaaacagaagaacaggaagatgacaaacagatgaccttgatgttgctggtcagcacattacaagcatttattgaaggatcctcgctgggagagttccatgtgcgacttcagatgttactggttttccattgtcatgtcttgctgatgccacaggttgaaggaaaggattcactttgcagtgttctatggaatttgtaccattattacaagcaattctttgaccgggtccaggccaaaattgtggaacttcgttcccccctagaaaaagaacttaaagaatttgttaagatttccaagtggaatgatgtcagcttctggtccattaagcaatctgtagaaaagacacacaggacactctttaaattcatgaagaaatttgaagcagtcctgagtgaaccctgccggtcatccctggtggagagtgacaaggaagaacagcctgactttttgcccaggccaacagatggagctgcaagtgaactgtcttccattcagaatctgaacagggcactgagggagaccctgttagcccaaccagcagctgggcaggccacaattccagagtggtgtcagggcgctgctccttccggcttggaaggggagcttctgcgtcgcttgccaaagctcaggaaacgcatgaggaagatgtgcctgacgttcatgaaggagagccccctgcctcgccttgtggagggccttgatcagttcacaggtgaagtgatttcctctgtgagtgagctgcagagcttaaaggtggaaccctctgcagagaaggagaagcagcggtcagaagccaagcacattctcatgcaaaaacagcgagctttgtcagacctctttaaacaccttgcaaaaattggtttgtcgtatcgcaaaggtcttgcttgggcccgttcaaaaaaccctcaagagatgcttcatcttcacccattagatctccagagcgcattgtccatcgtcagcagcactcaggaggctgattctaggctgcttacagaaatctcgtcttcatgggatggatgccagaagtatttttatcgctctcttgcacggcatgccaggcttaacgcagcactagcaactcctgccaaggaaatgggcatgggcaacgtggagaggtgcagagggttctcagcacatttgatgaagatgctcgtccgacagcggcgctccctgaccacgctcagtgagcagtggatcatcctcaggaacctcctcagctgtgtgcaagagattcacagcaggctgatggggccccaggcctaccccgtggccttcccccctcaggatggcgtgcagcagtggacagagcgcctgcagcacctggccatgcagtgccagatcctgcttgagcagctctcctggctcctccagtgctgccccagtgtagggccagctccaggccatggcaatgtccaggtactggggcagcctcctggcccctgcctggaaggaccagaacttagcaagggacaactttgtggagtagtgctggacctaattccttccaatctgagctacccatctccaatacctggaagtcagctgccctctggttgccggatgcggaaacaggatcacctttggcaacagtcaactacgagattaacagagatgctaaaaaccattaaaacagtgaaagctgacgtcgacaaaattagacagcagtcttgtgagactctctttcattcttggaaagattttgaagtttgctcttctgcgctgagttgcttgtcccaggtgtcagttcatttgcagggcctagagtccttgttcattcttccagggatggaggttgagcaaagagactcacaaatggcactagttgaaagtctggaatatgtaagaggagaaattagtaaagccatggctgactttactacctggaagacccatctgcttacttcagatagccaaggaggaaatcaaatgttggacgaaggatttgtggaagatttttcagagcaaatggaaattgccatccgagccatcctctgtgccatccagaacttagaagaaagaaagaatgaaaaagcagaggagaacactgaccaagcaagcccacaagaagattatgcaggctttgagagactgcaatcaggacatctaacaaaactcttagaggatgacttctgggccgatgtgagcactttgcacgtgcagaaaataatttctgccatctccgagctgttggagaggctgaaatcgtacggtgaggatggcacagcagcaaagcacctgttcttcagccaatcctgttccttgctggtgcgcctggtgccggtcctctccagctactcagacctcgtcctcttcttcctgaccatgtctttagcaactcaccgtagtactgcaaagctgctctctgtgcttgcccaggtctttacagagcttgcccagaagggattttgcttgcccaaagaatttatggaagattcagctggagagggagcaactgagttccatgactatgagggaggtggaattggagaaggcgagggcatgaaggatgtgagtgaccagatcggaaatgaagaacaggtggaagatacatttcagaagggtcaagaaaaagacaaagaggatcctgattcaaaatctgatattaagggcgaggataatgccattgagatgtcggaagattttgatgggaaaatgcatgatggggagcttgaagaacaagaagaggatgatgagaaatcagatagtgagggcggagacctggataaacacatgggcgatctcaatggtgaggaagctgacaaactagatgagaggctttggggtgatgatgatgaggaggaagatgaggaggaagaagacaataaaactgaagaaacaggaccaggaatggatgaggaagattctgaacttgttgctaaagatgacaacttggatagtggcaattcaaacaaagataaaagccagcaagataagaaggaagaaaaggaagaagcagaagctgatgatggtggacaaggtgaagacaaaattaatgaacaaatagatgagagggactatgatgaaaatgaggtggacccttaccatggcaatcaggaaaaggtgccagaacccgaggctttggaccttccagatgacttgaacctcgacagtgaagacaagaatggtggtgaggacaccgacaatgaagaaggagaagaagagaatcctttggagataaaagaaaaaccagaagaagcaggtcatgaagctgaggaaagaggagagaccgagaccgaccagaacgaaagtcagagtccacaggagcctgaggaaggccccagtgaagatgacaaggcagaaggggaagaggaaatggacacaggagctgatgaccaagatggagatgctgctcagcatcctgaagaacactctgaggagcagcagcagtctgtggaggaaaaagacaaggaagccgatgaagaaggtggagagaatggccctgctgaccaaggtttccagccccaggaggaagaagaacgggaggactctgatacagaggagcaggtgccagaggctttggagaggaaggagcatgcctcctgtgggcagactggtgtggagaacatgcagaacacacaggccatggagctggctggggccgcacctgagaaggagcaggggaaagaggaacacggaagtggagctgcagatgcaaaccaggcagaaggccatgaatcgaatttcattgcccagttggcctcccagaagcacaccaggaaaaacacacagagttttaagaggaaacctgggcaggctgacaatgaacgttccatgggtgatcacaatgagcgtgtgcacaagaggctgaggactgtggatacggacagccatgccgagcaggggccagctcagcagccccaggcccaggtggaggatgcagatgcattcgagcacattaaacaaggcagtgacgcatacgatgcacagacctatgatgtggccagcaaagaacagcaacagtctgcaaaagactctggcaaagatcaggaagaggaggagatagaggacacccttatggacacagaggagcaggaggagttcaaagcagcagacgtggagcagctgaagccagaggaaatcaagtcgggcaccacagcacccttgggctttgatgagatggaagtggagatccaaactgttaaaacagaggaagaccaagaccccagaacagacaaagcccataaggagacagaaaatgagaaaccagaaagaagccgagagtctaccattcatacagctcatcaattcctcatggacacgatcttccagccctttttaaaagatgtcaatgagctaagacaggagctggagagacagctggaaatgtggcagccacgtgaatctggaaacccagaggaggagaaggttgcagctgagatgtggcagagttacctgatcttaacagcgcctctttcacaacggttatgtgaagagcttcgtctcatattagagcctacccaggcagccaagctgaaaggagactatcgaactgggaaacgactaaacatacggaaagtcattccatacattgctagtcaatttcggaaagacaagatttggcttcgaaggaccaagcccagtaaacgccagtatcagatttgtttggctatcgatgactcttctagtatggtagacaatcataccaagcagcttgcatttgaatctttggctgtgattggaaatgctctaaccctcctggaagtgggtcagattgcagtgtgtagttttggagaatctgtaaagctgttacacccatttcatgagcagttcagtgattactctgggtcccagattctacgtctctgcaaattccaacaaaagaaaaccaagattgctcagtttctagagtctgttgccaacatgtttgcagctgctcagcagctctcgcagaacatcagttcagaaactgcacaactcctcctggtagtctctgatgggcgaggccttttccttgagggcaaagaaagagtcctggcagcagttcaggctgcccggaatgcaaatatctttgtcatctttgttgtattggacaatcccagttcacgggattctatcttggacattaaagtaccgatatttaaaggacctggagagatgcctgaaatccgatcctacatggaagagttcccattcccatactatatcattcttcgagatgtaaacgcacttcctgagacactcagcgatgccctcagacagtggtttgagttggtgacagcctctgaccacccatagaacagaaagaagagtccaaagtgagacttaactgtggtcagaaggtcacattgcttacccaggtgctcccttttggacaactacaaaaaattttattgtaatatttttattttacaacgtgatcttacagcctacagaatgctctctggctcccggctttgcctgggctgaggtttttataccaaacctggaagcagcagcaggtgcctgaactcgtaactagagaagagttatccttcttccctgccttggaagccctggcctgggaggaggtcataccccaccgttggagcccagctgcctgttttcttttgcaggggatctgggcacctgtgccttgaggagatgctgccaggagcatgggactctgacagtcctttgtataaaggactaaagggagctgcccttttgaccctgttctaagctctgccttgccaagcccatagtgtgtgcccaaaagctgtcaagtggccaagacagctcgtttctggagagtatgagggtgtgttttcttattgtgaaaggaactaccttctcttagagggtaggaagaatgtggtgtgtgtgtgttctcataaagcaactggacattataggtgcccaggtcatctataaaaacgatccttgggctgtgtaaaaatgaagtggcttttcagtatcctctttcacacttgctgcttcgggagactatgcaatgatgggaaggtgattgcccctttatttcattcagtgccatggtccctgttgttgtagtaatttatttgtttagttcatttttttttttcttaacagtcaaggggaagagtgattcctcacactgctttcaagctggactgagccagtctcattctgggaaagaaacgctgtgtccagaactcagcagctccatctattttttccagtcgaaagaaactgatctttaggcagtttttacttggccagaaagcagtgctgaatacttgaaactgtgtgctctgttctacttaatgttctgtcagaatgttcttttgtaggcagtatgtcatgatgtaatcatctatctccttgtctgtttccaagttacactgtgaagtctgcgacccttttgaggtggtcatcaaagacacagattccttgtttaaccaagtgtcccaaagcatgtacctgaagttatatcattttttattctaaaaagctatgcagcttatattctgaaaactattaaaacatataccactgttgttgatgtaatttgtgactcttcttaatggaagatgacaggattgtaaaaggtatgctaggggactgatcttctctgctggatcagtcagtcagctgttactagttgatgctgtgctaacatgatcccctcctacttccatgttgctcttactacaaaggttatcatttgcatttatgtccatggtaggctgagctataatatgctggctttgcagcagaatgaaaaggatgagttggtgtagccttataaggaggcttataaaaattaattatcctccataaatg

SEQ ID NO: 1198 - DNA, 17400 bp, Homo sapiens
cgcctttcctgcgggcgtagttgctggctgctcgggcactgggacctcggcggcttggggacgctggccgcgaagtagggagcgcaggtggccgctcggggtgagggccctgggtcatggagcacttcttgctggaggtggcagccgcgccgctgcggttaatcgcagccaagaacgagaagagccgcagtgagttgggcaggttcttggccaagcaggtgtggacacctcaagatcgccagtgtgtcctgagtaccttagcacagttgcttttggataaggactgtactgtgctggttggtcgccagcttcgccctctccttttggatttgctggaaaggaatgccgaagccattaaagctggaggccaaatcaaccatgatctgcatgaacggctatgtgtgtcgatgagcaaactcattggtaaccatcctgatgtcctcccgtttgccctgagatatttcaaggacacatccccagtctttcaaagacttttcctagagagttcagatgctaatccagtacgctatggacgtaggaggatgaagctccgggacctaatggaagcagccttcaagtttctgcagcaggagcagtctgtgttccgggagctctgggactggagtgtgtgtgtccctctcctcagaagccatgacaccttggttcgctggtatacagccaattgtcttgctttggttacctgtatgaatgaagagcacaagttatcatttcttaagaagatatttaatagtgatgaattgatccatttcaggttgaggttattagaagaggcccagttgcaggacttggagaaggccttggttttggccaatccagaagtctccctttggcgtaagcagaaggagctgcagtacttacagggacatcttgtttcgtctgacctctcccctagggtgacagctgtttgtggtgtggtgctgcctgggcagctgccagcccctggagagctgggtggtaataggagttcttcacgtgaacaggagctggcccttaggtcttatgtgctggttgagtctgtctgcaaaagtcttcagaccctggctatggcggttgcttctcagaatgctgtgttgttggaaggaccaataggatgtggcaaaacttccttagttgaatatttagctgcagtgacaggtagaacaaagcctcctcagcttctcaaagtccagcttggagatcagactgacagtaagatgcttttggggatgtatcgctgcacagatgttcctggagagtttgtgtggcagcctggcaccctgacacaggcagccacaatgggccactggatccttctggaggatattgactatgcccccttagacgtggtttctgtgctgatccctctcttggagaatggagagctcttgattcctggccgaggtgactgtctgaaagtggcacctggatttcagttttttgcaaccaggagactcttgagctgtggaggaaattggtatcgaccgctaaacagtcatgctactttgctagacaaatattggaccaaaattcacctggataacctggataagagagaactgaatgaggttcttcagagcagatatcctagcctattggcagtggttgatcacctgcttgacatttatatccaacttactggagagaaacatcactcttggagtgatagttctgttggatgtgaacaggcacctgaagaagtttcagaagccagaagagaaaacaaaagaccaacccttgagggaagagaattatctctaagggatctgctgaattggtgtaataggattgcccatagctttgacagttcatctttatcagcatcattaaatatttttcaagaggctctagactgtttcacagcaatgctttctgagcatacaagcaaactgaaaatggcagaagttattggaagcaaattgaacatttctagaaaaaaggctgaattcttttgtcaactttataaaccagaaattgtgatcaatgagctagatttgcaagtgggtcgagtgcggcttctacggaaacaaagtgaggctgttcacctacagagggagaagttcactttcgctgctacacggccgtcctctgttctcatcgagcagcttgcagtgtgtgtcagcaaaggggagcctgtgttgctggtgggagagaccgggactggcaaaacctctaccatccaatacttggctcacattacaggccaccgtttgagggttgtcaatatgaatcaacaaagtgatactgcagacttgcttggaggttataaaccggtggaccataagcttatttggctacccttacgggaggcatttgaggaactctttgctcagacattttccaagaaacaaaactttacgttcttggggcacattcagacctgttacagacagaaacggtggcatgatctcctgagactaatgcagcatgtacacaagtctgctgttaacaaggatggaaaagacagtgaaactgggttactcataaaagagaaatgggaagcatttggtcttagactcaaccatgcccaacaacagatgaaaatgactgaaaataccttattgttcgcatttgtagagggtacattagctcaggctgtaaagaaaggagagtggatcttgttggatgagattaacttggctgctccagaaatactagaatgtctgagtggtttgcttgaaggatcttctggatccctggtgttgctggatcgaggagacacagagccactggttcggcatcctgacttccgtttatttgcctgtatgaatccagcaactgatgtaggcaaaagaaatctcccaccaggaataagaaacaggttcacagaactttatgtagaagaattagaaagcaaagaagacttacaggttcttattgtagattatctgaaaggattgagtgtgaacaagaatacagtgcaaggaatcataaacttctacacagctttgcggaaagagtctgggaccaaactggtggatggcactggccatagacctcactacagccttcggactctgtgccgggccctgcgatttgcagcctccaatccatgtggcaacattcagcgctcactctatgagggtttttgtttgggtttcttaacacagcttgacagggcatcacacccaatagttcagaagctcatctgtcaacacattgtccctggcaatgtcaagagtctgctgaagcagcctattccagagccaaaaggaggtcggcttatccaggttgaaggctactggattgcggtgggagacaaggagcctacaatagatgagacgtacattctgacatcttctgtgaagctgaacctgagagatatagtccgagttgtctctgcaggaacctatccagtgctgattcagggagagacatcagttggtaaaacaagcctgatccagtggctggctgcagctactggcaaccactgtgtgcgtattaataatcacgaacacacggatattcaggagtacattggttgttacacgtctgactcctcagggaagcttgtctttaaggaaggtgttcttattgatgccatgagaaaaggctattggattattttagatgaattaaatttggcccctactgatgtgttagaggcgctgaataggctgttggatgataaccgtgaattgctagtaacagaaacacaggaagttgttaaagcacaccctcggtttatgctttttgccacccaaaatcccccaggactttatggaggcagaaaggtcctttctagagccttcaggaatcggtttgtggaattgcactttgatgagttacctagctccgagttggaaacaatcttgcacaagcggtgtagtttgccaccctcctattgcagcaagttggttaaagtcatgctggatcttcagtcctatcgcagaagttcttcagtgtttgctggaaagcagggcttcatcacccttcgtgatctgttccgatgggctgaaagatacagattggctgagccgaccgagaaggagtatgactggctacagcatttagccaatgatggttatatgcttctggcaggtcgagtcaggaagcaggaggaaattgatgtgattcaagaagtccttgagaaacatttcaagaaaaaattgtgtcctcaatctcttttctccaaagaaaatgttctaaaattgctgggtaaattgtctactcagatatccacattggagtgtaactttggccatatcgtgtggactgagggcatgcggagactcgcgatgctagtgggaagggcattggaatttggtgaacctgtgctgctggttggagacactgggtgtgggaaaactactatctgtcaggtatttgcagccttggcaaatcagaaattatactctgtcagctgccacttacacatggagacatcagacttcctgggtggcctgcggccagtgagacaaaagccaaacgacaaggaagaaattgacacatcaagactctttgagtggcatgatgggcctctggttcaggccatgaaggaggacggctttttcctcttggatgagatctcattggccgatgactctgtcttggaaagactcaacagtgtccttgaagtagaaaagtctctggtattagctgaaaaaggcagtccagaggacaaggatagtgaaatagagctgttgactgctgggaaaaaatttcgtattctagcaaccatgaaccctgggggtgactttggaaaaaaggagctgtctcctgccttaagaaaccggtttacagaaatatggtgccctcaaagcacaagccgtgaagatttaattcagatcatcagtcataatcttcgtccaggattgtgtctgggcagaatagatcctaaagggtctgacatacctgaagtgatgctggatttcattgactggctgacccaccaagagtttggcagaaagtgtgtggtcagtatcagagatatcctgtcctgggttaacttcatgaacaaaatgggggaggaagctgctttgaaaaggccagagatcatctccactgtgacatcttttgtccatgctgcatgcctggtgtacatagatggaataggttcaggggtaacttcctctgggtttggtacagcccttttggcacgaaaagaatgtctgaaatttctaatcaagaggcttgccaagatagtacgacttacagaatatcagaaaaatgagttgaagatttatgacagaatgaaggccaaagaattcactggaatagataacctttggggaattcatccattttttataccaaggggacctgtcctacacaggaataatattgcagactatgcactcagtgcagggaccactgctatgaatgcacagaggctcttaagagctaccaaactgaagaagcccattctcctggagggttcccctggtgttggcaagacaagtttggtgggagcattagcaaaggcttcaggaaatacccttgttagaatcaacttatcagagcaaacggacatcacagacctgtttggagcagatctacctgttgaaggtggcaagggaggagagtttgcctggcgtgatggccccttactggcagctttgaaggcaggccattgggtggtgttggatgagcttaacctggcttctcagtctgtattggaaggactcaatgcttgttttgaccaccgaggagaaatctatgtgcctgagttaggaatgagctttcaagtgcagcatgaaaagacgaagatttttgggtgtcagaatccctttagacaaggaggtgggaggaaaggcttgcccaggtctttccttaacagattcactcaggtcttcgttgatccccttacagtaattgacatggagttcattgccagtactttgtttccagccattgagaaaaatattgttaagaaaatggttgctttcaataaccaaattgatcatgaagtgactgttgagaagaaatgggggcaaaaaggaggaccctgggaattcaacctccgggaccttttccgctggtgtcagttgatgctggttgaccagtcccctgggtgttatgatcctggtcagcatgtgtttttggtctatggtgaaagaatgagaaccgaagaggacaaaaaaaaggtcattgctgtattcaaggatgtgtttggttcaaattccaacccatacatgggaaccagactatttcgtatcactccctatgatgttcagttgggctactcagtcctttcccgtgggagctgtgttcctcacccgtcccgccatcccctgttgctcctgcaccagtcattccaacccctggagtcaatcatgaagtgtgtgcagatgagctggatggtcatcctggtcgggccagcctctgtgggcaagaccagcctggtccagcttctggcacaccttactggccacacattaaagatcatggctatgaacagtgcaatggatactactgagctgctgggtggatttgagcaggttgatcttatacgaccttggaggaggctgctagagaaggtggagggaactgtaagggcactgttaagggatagcctccttatcagtgctgatgatgcagaagtagtgctgcgagcctggagtcattttcttctgacatataagcctaagtgtcttggagaaggtggtaaagctatcacgatggagattgtcaacaaactagaagcagtgttattgcttatgcagcgactcaacaataaaatcaactcatactgcaaggcagagtttgccaaacttgttgaagagttccgaagctttggtgtgaagcttacgcagttggccagtggccatagccatggcacatttgaatgggttgacagcatgttggttcaggccctgaagtctggagactggcttctgatggacaatgttaacttctgcaacccatcagtgttggatcgtttgaatgctttgcttgaacccggaggtgtcctcactattagtgagagaggaatgatagatggatccactcccacgataacaccaaatcccaatttcagacttttcctctcgatggatcctgttcatggagatatatcccgagctatgaggaatcgtggacttgaaatctacatttcaggggaaggggatgcaagcaccccagacaacctggatttgaaagttctgctgcacagccttggattggtggggaacagtgtatgtgacatcctcttggctttacacacagagacccggagcactgttgtaggttctccaacatcttctgtatcaactctaatccagacagccatactaattgtccagtacctgcagcgagggctgagtttagacagagccttttctgaagcatgctgggaagtatatgtctgttcccagcattcaccagcaaaccggaagcttgtacaggctttactggagaaacatgtttcttctttgcgagcacatgaaacctggggagactccattcttggcatgggactgtggccagattctgtgccctcagctctctttgctactgaagattcacacctgtctacagtccgaagagatggacagatcttagtatattgtctcaacaggatgagcatgaaaaccagcagctggacaaggagtcagccttttaccttgcaagacttagagaaaattatgcagtcccccagccctgagaacctgaaattcaatgcagtcgaagtgaatacttactggatcgatgaaccagatgttttggtcatggctgttaaattgctcatagaaagagcaaccaatcaggattggatgctcagagttaaatggctttatcatttagccaagaatataccgcaggggcttgagtccatacaaattcatttggaagccagtgctgcatctctcaggaatttttactcacattccctctcaggtgcagtcagtaatgttttcaaaatattacaaccaaatacaacagatgaatttgtgatccctctggatccccgatggaatatgcaggctctggacatgattagaaatttgatggactttgacccacaaacggaccagcctgaccagctctttgcccttttagaatcagctgcaaacaagacaatcatatatcttgaccgggaaaaacgggtttttactgaagcaaatttggtttctgttggtagcaaaaagctaagagagagtgttttgagaatgtcctttgaattccatcaagatccagaaagctatcacactctgccccatgaaattgtggtcaatcttgctgctttttttgaactttgtgatgcactagtcctgctctgggtacagtcctcccagggaatggtgtctgatgccagtgccaatgagatcttaggttctctgcggtggcgggaccggttctggactgtggccgacacagtaaaagtagatgccccaggtctggcccttcttgccctccattggcactgggttttaaaacatctggtccaccagatcccccgacttctgatgaattatgaagacaaatattacaaagaagttcagactgtctcagaacatattcagaattgtctggggagccagactggtggcttcgctggtataaagaagttgcagaagttcctgggacgaccgtttccttttaaggacaagctggtggtggagtgtttttcacaactgaaggtccttaacaaagtccttgccatcagggagcagatgtctgcccttggggagagtggatggcaggaagacattaaccgtctccaagtggttgcttctcagtggacattaaagaaaagtctcctgcaagcctggggactgatcctcagagcaaatattttggaagatgtcagcctagatgaattgaagaattttgtgcatgctcagtgtttagaactgaaagccaaaggactctcacttggttttctggagaaaaagcatgatgaagcttcctccctgtcccatccagacttgacctccgtaatccacctcaccaggagtgttcagttgtggcctgcaatggagtacctggctatgctttggcggtacaaagtgacagctgattttatggcacaagcttgtctcagaagatgcagcaaaaatcaacaaccccagataaatgaggagataagtcacctcatctcattttgtctttatcacacacctgttacacctcaagagcttcgagatctgtggtccttgctgcatcatcagaaggtgtctcctgaagaaattacatctttgtggtccgagttatttaattccatgtttatgtctttctggagcagtactgtgaccacaaatccagagtactggctaatgtggaaccctttgcctggtatgcagcagagggaggcacccaagtctgttttggactccacattgaagggccccggcaatctcaatagacccatattctctaagtgctgctttgaagtcttaaccagcagctggagagcaagtccctgggatgtgagtggcctccccattctttcctcctctcacgtgaccctaggagagtgggttgagagaactcagcagctccaggacatcagttcgatgctttggactaacatggctatctcttcagtagcagaattcagacgcacggattcccaactccaggggcaggtgctgttccggcacctggcaggcctagcagagctgctcccagagtcccggcggcaggagtacatgcagaactgtgagcagctgctgcttgggagcagccaggccttccagcatgtgggccagacacttggggacatggctggtcaggaggtgctgcccaaggaactgctctgccagttgctcacctccctgcaccactttgttggtgaaggggagagtaagaggagcctgcctgagccagcccagcgtgggagcctctgggtgagcctcggcttgctccagattcagacatggcttccccaggcacgctttgaccctgcggtgaagagggagtacaagctcaattacgtcaaggaagagttacaccaactgcagtgtgaatggaagacccggaacctgtcatcccagctgcagactggaagagacctggaagatgaagtcgttgtcagctactctcatcctcacgttaggctgcttcgccaaaggatggatcggctggataatttaacctgtcacctgttgaagaaacaggcctttagaccccagctgcctgcctacgagtccctggttcaggagatccaccactacgtcaccagcatcgccaaggcccctgctgttcaggatctgctcacacggcttctgcaggccctccacatagatgggccacggtctgcccaagtagcccagagccttctaaaggaggaggcctcttggcagcagtcacaccaccagttccggaagcggctgtcagaggagtacaccttctatccagatgccgtgagcccactgcaggcatccatattgcagttacaacatggcatgaggctggtggcctctgagctccacacctcactccacagcagtatggttggtgcagacaggctggggaccctggccacagccttgctggctttcccatcggtgggccccaccttcccgacttactatgctcatgcagacactttgtgctcggtgaagtctgaggaggttctacgaggccttgggaagctaatcctcaagcgctcaggaggaaaggagctggaaggcaagggccagaaagcctgtcccactcgggagcagctgctgatgaatgctctcctttacctgcgctcccacgtgttatgcaagggagagttggaccagagggccctgcagctcttcagacatgtgtgtcaggaaatcatcagtgagtgggatgagcaggaacgcatagcccaagagaaggctgagcaggaaagcggcctgtatagatacaggagcaggaactctaggacagccctgagtgaagaggaggaggaagaacgggagttcagaaaacagttccccctgcatgaaaaggactttgcagatattttggtgcagccaacgttggaggagaacaaaggaacttcagatgggcaagaagaggaagcaggcacaaacccagctctcctctcccagaattcaatgcaggcagtaatgctgatacaccagcaattgtgtctcaactttgctcgatccctctggtatcaacagactctgccgccacatgaagcaaagcattacctcagcctgtttctgtcttgctatcagactggggcatcgcttgtgacacacttctaccccctgatgggagttgaactgaatgaccgactcttgggcagccaacttttggcctgtaccctctcccataacactctttttggggaggcaccctcagacctgatggtgaaacctgatgggccctatgacttctaccagcatcccaatgttccagaagcacggcagtgtcaacctgtgcttcaaggtttctcagaggctgtcagtcacttgctacaggactggccagaacacccagcgcttgaacagctcctggttgtaatggacagaattcgtagtttcccactttccagtcccatctcaaagttcctgaatggcttagagatccttctggcaaaggcacaggattgggaggaaaatgcaagtcgagctttgtctttgcggaaacatcttgatttgatcagtcagatgatcattcggtggcgtaaactggagctgaactgctggtccatgagtttggataatactatgaagcgccacaccgagaaatccaccaagcactggttctccatctatcagatgcttgagaagcacatgcaggaacaaacagaagaacaggaagatgacaaacagatgaccttgatgttgctggtcagcacattacaagcatttattgaaggatcctcgctgggagagttccatgtgcgacttcagatgttactggttttccattgtcatgtcttgctgatgccacaggttgaaggaaaggattcactttgcagtgttctatggaatttgtaccattattacaagcaattctttgaccgggtccaggccaaaattgtggaacttcgttcccccctagaaaaagaacttaaagaatttgttaagatttccaagtggaatgatgtcagcttctggtccattaagcaatctgtagaaaagacacacaggacactctttaaattcatgaagaaatttgaagcagtcctgagtgaaccctgccggtcatccctggtggagagtgacaaggaagaacagcctgactttttgcccaggccaacagatggagctgcaagtgaactgtcttccattcagaatctgaacagggcactgagggagaccctgttagcccaaccagcagctgggcaggccacaattccagagtggtgtcagggcgctgctccttccggcttggaaggggagcttctgcgtcgcttgccaaagctcaggaaacgcatgaggaagatgtgcctgacgttcatgaaggagagccccctgcctcgccttgtggagggccttgatcagttcacaggtgaagtgatttcctctgtgagtgagctgcagagcttaaaggtggaaccctctgcagagaaggagaagcagcggtcagaagccaagcacattctcatgcaaaaacagcgagctttgtcagacctctttaaacaccttgcaaaaattggtttgtcgtatcgcaaaggtcttgcttgggcccgttcaaaaaaccctcaagagatgcttcatcttcacccattagatctccagagcgcattgtccatcgtcagcagcactcaggaggctgattctaggctgcttacagaaatctcgtcttcatgggatggatgccagaagtatttttatcgctctcttgcacggcatgccaggcttaacgcagcactagcaactcctgccaaggaaatgggcatgggcaacgtggagaggtgcagagggttctcagcacatttgatgaagatgctcgtccgacagcggcgctccctgaccacgctcagtgagcagtggatcatcctcaggaacctcctcagctgtgtgcaagagattcacagcaggctgatggggccccaggcctaccccgtggccttcccccctcaggatggcgtgcagcagtggacagagcgcctgcagcacctggccatgcagtgccagatcctgcttgagcagctctcctggctcctccagtgctgccccagtgtagggccagctccaggccatggcaatgtccaggtactggggcagcctcctggcccctgcctggaaggaccagaacttagcaagggacaactttgtggagtagtgctggacctaattccttccaatctgagctacccatctccaatacctggaagtcagctgccctctggttgccggatgcggaaacaggatcacctttggcaacagtcaactacgagattaacagagatgctaaaaaccattaaaacagtgaaagctgacgtcgacaaaattagacagcagtcttgtgagactctctttcattcttggaaagattttgaagtttgctcttctgcgctgagttgcttgtcccaggtgtcagttcatttgcagggcctagagtccttgttcattcttccagggatggaggttgagcaaagagactcacaaatggcactagttgaaagtctggaatatgtaagaggagaaattagtaaagccatggctgactttactacctggaagacccatctgcttacttcagatagccaaggaggaaatcaaatgttggacgaaggatttgtggaagatttttcagagcaaatggaaattgccatccgagccatcctctgtgccatccagaacttagaagaaagaaagaatgaaaaagcagaggagaacactgaccaagcaagcccacaagaagattatgcaggctttgagagactgcaatcaggacatctaacaaaactcttagaggatgacttctgggccgatgtgagcactttgcacgtgcagaaaataatttctgccatctccgagctgttggagaggctgaaatcgtacggtgaggatggcacagcagcaaagcacctgttcttcagccaatcctgttccttgctggtgcgcctggtgccggtcctctccagctactcagacctcgtcctcttcttcctgaccatgtctttagcaactcaccgtagtactgcaaagctgctctctgtgcttgcccaggtctttacagagcttgcccagaagggattttgcttgcccaaagaatttatggaagattcagctggagagggagcaactgagttccatgactatgagggaggtggaattggagaaggcgagggcatgaaggatgtgagtgaccagatcggaaatgaagaacaggtggaagatacatttcagaagggtcaagaaaaagacaaagaggatcctgattcaaaatctgatattaagggcgaggataatgccattgagatgtcggaagattttgatgggaaaatgcatgatggggagcttgaagaacaagaagaggatgatgagaaatcagatagtgagggcggagacctggataaacacatgggcgatctcaatggtgaggaagctgacaaactagatgagaggctttggggtgatgatgatgaggaggaagatgaggaggaagaagacaataaaactgaagaaacaggaccaggaatggatgaggaagattctgaacttgttgctaaagatgacaacttggatagtggcaattcaaacaaagataaaagccagcaagataagaaggaagaaaaggaagaagcagaagctgatgatggtggacaaggtgaagacaaaattaatgaacaaatagatgagagggactatgatgaaaatgaggtggacccttaccatggcaatcaggaaaaggtgccagaacccgaggctttggaccttccagatgacttgaacctcgacagtgaagacaagaatggtggtgaggacaccgacaatgaagaaggagaagaagagaatcctttggagataaaagaaaaaccagaagaagcaggtcatgaagctgaggaaagaggagagaccgagaccgaccagaacgaaagtcagagtccacaggagcctgaggaaggccccagtgaagatgacaaggcagaaggggaagaggaaatggacacaggagctgatgaccaagatggagatgctgctcagcatcctgaagaacactctgaggagcagcagcagtctgtggaggaaaaagacaaggaagccgatgaagaaggtggagagaatggccctgctgaccaaggtttccagccccaggaggaagaagaacgggaggactctgatacagaggagcaggtgccagaggctttggagaggaaggagcatgcctcctgtgggcagactggtgtggagaacatgcagaacacacaggccatggagctggctggggccgcacctgagaaggagcaggggaaagaggaacacggaagtggagctgcagatgcaaaccaggcagaaggccatgaatcgaatttcattgcccagttggcctcccagaagcacaccaggaaaaacacacagagttttaagaggaaacctgggcaggctgacaatgaacgttccatgggtgatcacaatgagcgtgtgcacaagaggctgaggactgtggatacggacagccatgccgagcaggggccagctcagcagccccaggcccaggtggaggatgcagatgcattcgagcacattaaacaaggcagtgacgcatacgatgcacagacctatgatgtggccagcaaagaacagcaacagtctgcaaaagactctggcaaagatcaggaagaggaggagatagaggacacccttatggacacagaggagcaggaggagttcaaagcagcagacgtggagcagctgaagccagaggaaatcaagtcgggcaccacagcacccttgggctttgatgagatggaagtggagatccaaactgttaaaacagaggaagaccaagaccccagaacagacaaagcccataaggagacagaaaatgagaaaccagaaagaagccgagagtctaccattcatacagctcatcaattcctcatggacacgatcttccagccctttttaaaagatgtcaatgagctaagacaggagctggagagacagctggaaatgtggcagccacgtgaatctggaaacccagaggaggagaaggttgcagctgagatgtggcagagttacctgatcttaacagcgcctctttcacaacggttatgtgaagagcttcgtctcatattagagcctacccaggcagccaagctgaaaggagactatcgaactgggaaacgactaaacatacggaaagtcattccatacattgctagtcaatttcggaaagacaagatttggcttcgaaggaccaagcccagtaaacgccagtatcagatttgtttggctatcgatgactcttctagtatggtagacaatcataccaagcagcttgcatttgaatctttggctgtgattggaaatgctctaaccctcctggaagtgggtcagattgcagtgtgtagttttggagaatctgtaaagctgttacacccatttcatgagcagttcagtgattactctgggtcccagattctacgtctctgcaaattccaacaaaagaaaaccaagattgctcagtttctagagtctgttgccaacatgtttgcagctgctcagcagctctcgcagaacatcagttcagaaactgcacaactcctcctggtagtctctgatgggcgaggccttttccttgagggcaaagaaagagtcctggcagcagttcaggctgcccggaatgcaaatatctttgtcatctttgttgtattggacaatcccagttcacgggattctatcttggacattaaagtaccgatatttaaaggacctggagagatgcctgaaatccgatcctacatggaagagttcccattcccatactatatcattcttcgagatgtaaacgcacttcctgagacactcagcgatgccctcagacagtggtttgagttggtgacagcctctgaccacccatagaacagaaagaagagtccaaagtgagacttaactgtggtcagaaggtcacattgcttacccaggtgctcccttttggacaactacaaaaaattttattgtaatatttttattttacaacgtgatcttacagcctacagaatgctctctggctcccggctttgcctgggctgaggtttttataccaaacctggaagcagcagcaggtgcctgaactcgtaactagagaagagttatccttcttccctgccttggaagccctggcctgggaggaggtcataccccaccgttggagcccagctgcctgttttcttttgcaggggatctgggcacctgtgccttgaggagatgctgccaggagcatgggactctgacagtcctttgtataaaggactaaagggagctgcccttttgaccctgttctaagctctgccttgccaagcccatagtgtgtgcccaaaagctgtcaagtggccaagacagctcgtttctggag

SEQ ID NO: 1199 - DNA, 3654 bp, Homo sapiens
ttcctgcgggcgtagttgctggctgctcgggcactgggacctcggcggcttggggacgctggccgcgaagtagggagcgcaggtggccgctcggggtgagggccctgggtcatggagcacttcttgctggaggtggcagccgcgccgctgcggttaatcgcagccaagaacgagaagagccgcagtgagttgggcaggttcttggccaagcaggtgtggacacctcaagatcgccagtgtgtcctgagtaccttagcacagttgcttttggataaggactgtactgtgctggttggtcgccagcttcgccctctccttttggatttgctggaaaggaatgccgaagccattaaagctggaggccaaatcaaccatgatctgcatgaacggctatgtgtgtcgatgagcaaactcattggtaaccatcctgatgtcctcccgtttgccctgagatatttcaaggacacatccccagtctttcaaagacttttcctagagagttcagatgctaatccagtacgctatggacgtaggaggatgaagctccgggacctaatggaagcagccttcaagtttctgcagcaggagcagtctgtgttccgggagctctgggactggagtgtgtgtgtccctctcctcagaagccatgacaccttggttcgctggtatacagccaattgtcttgctttggttacctgtatgaatgaagagcacaagttatcatttcttaagaagatatttaatagtgatgaattgatccatttcaggttgaggttattagaagaggcccagttgcaggacttggagaaggccttggttttggccaatccagaagtctccctttggcgtaagcagaaggagctgcagtacttacagggacatcttgtttcgtctgacctctcccctagggtgacagctgtttgtggtgtggtgctgcctgggcagctgccagcccctggagagctgggtggtaataggagttcttcacgtgaacaggagctggcccttaggtcttatgtgctggttgagtctgtctgcaaaagtcttcagaccctggctatggcggttgcttctcagaatgctgtgttgttggaaggaccaataggatgtggcaaaacttccttagttgaatatttagctgcagtgacaggtagaacaaagcctcctcagcttctcaaagtccagcttggagatcagactgacagtaagatgcttttggggatgtatcgctgcacagatgttcctggagagtttgtgtggcagcctggcaccctgacacaggcagccacaatgggccactggatccttctggaggatattgactatgcccccttagacgtggttcttcagagcagatatcctagcctattggcagtggttgatcacctgcttgacatttatatccaacttactggagagaaacatcactcttggagtgatagttctgttggatgtgaacaggcacctgaagaagtttcagaagccagaagagaaaacaaaagaccaacccttgagggaagagaattatctctaagggatctgctgaattggtgtaataggattgcccatagctttgacagttcatctttatcagcatcattaaatatttttcaagaggctctagactgtttcacagcaatgctttctgagcatacaagcaaactgaaaatggcagaagttattggaagcaaattgaacatttctagaaaaaaggctgaattcttttgtcaactttataaaccagaaattgtgatcaatgagctagatttgcaagtgggtcgagtgcggcttctacggaaacaaagtgaggctgttcacctacagagggagaagttcactttcgctgctacacggccgtcctctgttctcatcgagcagcttgcagtgtgtgtcagcaaaggggagcctgtgttgctggtgggagagaccgggactggcaaaacctctaccatccaatacttggctcacattacaggccaccgtttgagggttgtcaatatgaatcaacaaagtgatactgcagacttgcttggaggttataaaccggtggaccataagcttatttggctacccttacgggaggcatttgaggaactctttgctcagacattttccaagaaacaaaactttacgttcttggggcacattcagacctgttacagacagaaacggtggcatgatctcctgagactaatgcagcatgtacacaagtctgctgttaacaaggatggaaaagacagtgaaactgggttactcataaaagagaaatgggaagcatttggtcttagactcaaccatgcccaacaacagatgaaaatgactgaaaataccttattgttcgcatttgtagagggtacattagctcaggctgtaaagaaaggagagtggatcttgttggatgagattaacttggctgctccagaaatactagaatgtctgagtggtttgcttgaaggatcttctggatccctggtgttgctggatcgaggagacacagagccactggttcggcatcctgacttccgtttatttgcctgtatgaatccagcaactgatgtaggcaaaagaaatctcccaccaggaataagaaacaggttcacagaactttatgtagaagaattagaaagcaaagaagacttacaggttcttattgtagattatctgaaaggattgagtgtgaacaagaatacagtgcaaggaatcataaacttctacacagctttgcggaaagagtctgggaccaaactggtggatggcactggccatagacctcactacagccttcggactctgtgccgggccctgcgatttgcagcctccaatccatgtggcaacattcagcgctcactctatgagggtttttgtttgggtttcttaacacagcttgacagggcatcacacccaatagttcagaagctcatctgtcaacacattgtccctggcaatgtcaagagtctgctgaagcagcctattccagagccaaaaggaggtcggcttatccaggttgaaggctactggattgcggtgggagacaaggagcctacaatagatgagacgtacattctgacatcttctgtgaagctgaacctgagagatatagtccgagttgtctctgcaggaacctatccagtgctgattcagggagagacatcagttggtaaaacaagcctgatccagtggctggctgcagctactggcaaccactgtgtgcgtattaataatcacgaacacacggatattcaggagtacattggttgttacacgtctgactcctcagggaagcttgtctttaaggaaggtgttcttattgatgccatgagaaaaggctattggattattttagatgaattaaatttggcccctactgatgtgttagaggcgctgaataggctgttggatgataaccgtgaattgctagtaacagaaacacaggaagttgttaaagcacaccctcggtttatgctttttgccacccaaaatcccccaggactttatggaggcagaaaggtcctttctagagccttcaggaatcggtttgtggaattgcactttgatgagttacctagctccgagttggaaacaatcttgcacaagcggtgtagtttgccaccctcctattgcagcaagttggttaaagtcatgctggatcttcag

SEQ ID NO: 1200 - DNA, 4900 bp, Homo sapiens
ccttgccaagtaacagctttgctgtccaacatcgtgtgctgcttcgcgagaaagtcacattcggaccctttggctagattgcttattcatagggcttcttgactaaagcccttggagcactgggtttttcttgaagtatatgatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaagcaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaattccaactgcctgatcagagaacttggatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgctgagcagaatgccttataaacctgcagggtcactcatctaaagtctagtgaccttaaactgaatgatttaaaaaagaaaagaaagaaaaaagaaactatttattctcgatattttgttttgcacagcaaaggcagctgctgacttctggaagatcaatcaatgcgacttaaagtgattcagtgaaaacaaaaaacttggtgggctgaaggcatcttccagtttaccccaccttagggtatgggtgggtgagaagggcagttgagatggcagcattgatatgaatgaacactccatagaaactgaattctcttttgtacaagatcacctgacatgattgggaacagttgcttttaattacagatttaatttttttcttcgttaaagttttatgtaatttaaccctttgaagacagaagtagttggatgaaatgcacagtcaattattatagaaactgataacagggagtacttgttcccccttttgccttcttaagtacattgtttaaaactagggaaaaagggtatgtgtatattgtaaactatggatgttaacactcaaagaggttaagtcagtgaagtaacctattcatcaccagtaccgctgtaccactaataaattgtttgccaaatccttgtaataacatcttaattttagacaatcatgtcactgtttttaatgtttatttttttgtgtgtgttgcgtgtatcatgtatttatttgttggcaaactattgtttgttgattaaaatagcactgttccagtcagccactactttatgacgtctgaggcacacccctttccgaatttcaaggaccaaggtgacccgacctgtgtatgagagtgccaaatggtgtttggcttttcttaacattcctttttgtttgtttgttttgttttccttcttaatgaactaaatacgaatagatgcaacttagtttttgtaatactgaaatcgattcaattgtataaacgattataatttctttcatggaagcatgattcttctgattaaaaactgtactccatattttatgctggttgtctgcaagcttgtgcgatgttatgttcatgttaatcctatttgtaaaatgaagtgttcccaaccttatgttaaaagagagaagtaaataacagactgtattcagttattttgccctttattgaggaaccagatttgttttctttttgtttgtaatctcattttgaaataatcagcaagttgaggtactttcttcaaatgctttgtacaatataaactgttatgcctttcagtgcattactatgggaggagcaactaaaaaataaagacttacaaaaaggagtattttt

SEQ ID NO: 1201 - DNA, 4835 bp, Homo sapiens
ccttgccaagtaacagctttgctgtccaacatcgtgtgctgcttcgcgagaaagtcacattcggaccctttggctagattatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaattccaactgcctgatcagagaacttggatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgctgagcagaatgccttataaacctgcagggtcactcatctaaagtctagtgaccttaaactgaatgatttaaaaaagaaaagaaagaaaaaagaaactatttattctcgatattttgttttgcacagcaaaggcagctgctgacttctggaagatcaatcaatgcgacttaaagtgattcagtgaaaacaaaaaacttggtgggctgaaggcatcttccagtttaccccaccttagggtatgggtgggtgagaagggcagttgagatggcagcattgatatgaatgaacactccatagaaactgaattctcttttgtacaagatcacctgacatgattgggaacagttgcttttaattacagatttaatttttttcttcgttaaagttttatgtaatttaaccctttgaagacagaagtagttggatgaaatgcacagtcaattattatagaaactgataacagggagtacttgttcccccttttgccttcttaagtacattgtttaaaactagggaaaaagggtatgtgtatattgtaaactatggatgttaacactcaaagaggttaagtcagtgaagtaacctattcatcaccagtaccgctgtaccactaataaattgtttgccaaatccttgtaataacatcttaattttagacaatcatgtcactgtttttaatgtttatttttttgtgtgtgttgcgtgtatcatgtatttatttgttggcaaactattgtttgttgattaaaatagcactgttccagtcagccactactttatgacgtctgaggcacacccctttccgaatttcaaggaccaaggtgacccgacctgtgtatgagagtgccaaatggtgtttggcttttcttaacattcctttttgtttgtttgttttgttttccttcttaatgaactaaatacgaatagatgcaacttagtttttgtaatactgaaatcgattcaattgtataaacgattataatttctttcatggaagcatgattcttctgattaaaaactgtactccatattttatgctggttgtctgcaagcttgtgcgatgttatgttcatgttaatcctatttgtaaaatgaagtgttcccaaccttatgttaaaagagagaagtaaataacagactgtattcagttattttgccctttattgaggaaccagatttgttttctttttgtttgtaatctcattttgaaataatcagcaagttgaggtactttcttcaaatgctttgtacaatataaactgttatgcctttcagtgcattactatgggaggagcaactaaaaaataaagacttacaaaaaggagtattttt

SEQ ID NO: 1202 - DNA, 3508 bp, Homo sapiens
tttgctgtccaacatcgtgtgctgcttcgcgagaaagtcacattcggaccctttggctagattgcttattcatagggcttcttgactaaagcccttggagcactgggtttttcttgaagtatatgatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaagcaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaattccaactgcctgatcagagaacttggatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtcca

SEQ ID NO: 1203 - DNA, 3374 bp, Homo sapiens
aacatgttgttggaaaggaagctaataagttaaacctttgagagatgccaaaaaaagagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaaatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggaggaaagtaaagcttaaaaggttaagcaacttgctcaagatcacacagctaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgct

SEQ ID NO: 1204 - DNA, 1792 bp, Homo sapiens
tttgctgtccaacatcgtgtgctgcttcgcgagaaagtcacattcggaccctttggctagattgtggggatttttttttttttccttttgctgttggttttttgaaagggcctttctctaaagtctacctaaacggtttttttttaagctatctttggaggttgacagcttttaaaaacacaggagtgtgttatatgaaatgactgaagatgtgtcgttactttattttattcgagatttccgacacgattaagacatttgggagacaaatgcagttctgctagcaaatcaaaagtgaataattcacccagggggcaaacgtttctggagaaagctaagcttttgtcttggggcaagaatattgagaggaagaatgttaatatgatggtgaaatctttgaataatcgtataacagattagtaaaaagacattctttggaaatgaacctttttaaaaattaattttgctgttgacagtggcaatgctaataatgttaacacggaataaaattacacctacaatttttatgtgcagtgtatgtaatacttaactccctgcccctgtgaaagggtatgcttgaaagctaaggggatggatgcttcttgactttgaaattaacaagttttccacgtctctctgcaaatatgaaatggaattagtattgcatttcactggctttattctatgtcctttattaaatatttctttggtgtgtcaggagaactgccttttctttttctttttttcttttttttcttttttttgccagtcaaggaaacaaacaacaaaagatcaaccagaaaccaaacagactgaacaaaccaacaaaacccagcaacaaactccaactttttactatttaaaaatgtgcattgctattatttatgtaccttctcaacatctgggatggggggaaatctcaagttgccatttgagttactcagcactgagagttgaagaaacatcttaaagtttgtaattttattgataacaaatttttagaatttgtcctcttaatagaaaggatgtttaagtgtacacttctgtcgttgttagtgtgaagaggcatccttgaaaaagaagagtttgatttctctctgtgtgtgtgtgtgtgtgtgtgtgtgtgtgtgtgtgtgtgtgtgtgtttaataatatccctatcttatgttcgatttttcttttttaaattttgggacgacttattgcccttcaatttcctcatggccaaaggcttattcatagggcttcttgactaaagcccttggagcactgggtttttcttgaagtatatgatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaa

SEQ ID NO: 1205 - DNA, 5732 bp, Homo sapiens
cacacacacacacacacaccacacttgtgctttcaagacatcgaaacggaggctatttccctggggaaagaaatcctgcctggcgagatctccccattggttgtttacccggagaaatctacatgtttaagggggatggtgcatccataatcagtctgtccctataggacttgggtcttggcgacctttttgtgacctctcccgccagaggaggctgctgtcactttaaaaatttaaaagaggagcccgtctggcttccgatcagatcactctgggcggcgggagatagctccctttctccctcgccccgggttctttctggatggccgagcagatcctctttaaagagacagttcatgaaatagaaacccggcggctgagcttggagttgcgaaaggggacgatcccgtgagggtccaggacccgcgaaggcgctgcggaggatctgaaagggggatagagctcccctcgcctccccaggccccccaccttttcaaactctcctcctcctgcttgttttcccccattggaactgggaaggagaagtagaagttttagtgggtttcagataactttcattacacatcgggctgataagagcaagagaaagtgagaaaagagggaggtgatgtgaaccagaaggaatagctccgagctcatttaggaagggggaaaaagccaaaacacaccaaacccgggtcacccagacgaaagaagacttcatttcttgtattaaaaatacactgttggcggacaataaatccgaaacgcgtggtcctggagagcagatcctagagacggacaaagttgtcagagacccatttggaaatcgagacgcgaggcttttaaaaaattattattattatttttaaacatctctaaatgttgctcgggatcgtttgaaaggattttcgtgcaggagcgttgggggctgctgattattttattttgtttattttgattcttctgtgaatgcctattattgctgagttgaggccatagaaatctaaagatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaaatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgctgagcagaatgccttataaacctgcagggtcactcatctaaagtctagtgaccttaaactgaatgatttaaaaaagaaaagaaagaaaaaagaaactatttattctcgatattttgttttgcacagcaaaggcagctgctgacttctggaagatcaatcaatgcgacttaaagtgattcagtgaaaacaaaaaacttggtgggctgaaggcatcttccagtttaccccaccttagggtatgggtgggtgagaagggcagttgagatggcagcattgatatgaatgaacactccatagaaactgaattctcttttgtacaagatcacctgacatgattgggaacagttgcttttaattacagatttaatttttttcttcgttaaagttttatgtaatttaaccctttgaagacagaagtagttggatgaaatgcacagtcaattattatagaaactgataacagggagtacttgttcccccttttgccttcttaagtacattgtttaaaactagggaaaaagggtatgtgtatattgtaaactatggatgttaacactcaaagaggttaagtcagtgaagtaacctattcatcaccagtaccgctgtaccactaataaattgtttgccaaatccttgtaataacatcttaattttagacaatcatgtcactgtttttaatgtttatttttttgtgtgtgttgcgtgtatcatgtatttatttgttggcaaactattgtttgttgattaaaatagcactgttccagtcagccactactttatgacgtctgaggcacacccctttccgaatttcaaggaccaaggtgacccgacctgtgtatgagagtgccaaatggtgtttggcttttcttaacattcctttttgtttgtttgttttgttttccttcttaatgaactaaatacgaatagatgcaacttagtttttgtaatactgaaatcgattcaattgtataaacgattataatttctttcatggaagcatgattcttctgattaaaaactgtactccatattttatgctggttgtctgcaagcttgtgcgatgttatgttcatgttaatcctatttgtaaaatgaagtgttcccaaccttatgttaaaagagagaagtaaataacagactgtattcagttattttgccctttattgaggaaccagatttgttttctttttgtttgtaatctcattttgaaataatcagcaagttgaggtactttcttcaaatgctttgtacaatataaactgttatgcctttcagtgcattactatgggaggagcaactaaaaaataaagacttacaaaaagga

SEQ ID NO: 1206 - DNA, 468 bp, Homo sapiens
gtggtttgctagggtgctttgaggattcagagaagggaaagttcttcgttaaacattacacaggatatatgtgacgcagctagccttgcattaagaaaatttgatttgtgaagtaggatttggaaaagatttgtgaactggcttgagagtcacagctttccatttgtcaccagagggctggttttcaatatataaaacaggaaatcacacttcttttgataaaaaagaaaaagaaaaagatgtttgttaaggtgtttgtacaggtatcttagtgtatatcttgccctttgttaatatatatacatctctctctttcctgattccatccacctttattttgtctttaaagatattctatagagtagttgcagacattgcgccgggagaggagcttctgctgttcatgaagagcgaagactatccccatgaaactatggcgccggatatccacgaagaacggcaatatcg

SEQ ID NO: 1207 - DNA, 3691 bp, Homo sapiens
aaagtttgtcacttcggacagtttcctgccggggcaccgtttctacgggcgccccccgcccccagccttctttcctcctcgcccgcagtctcgcggagccctgctgcttatctacgttgctaagccgggcgatttccttgttcctcctgcgaaacggtgcggtctggacacgtctccggggtgggtcgtccggccttcgatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaattccaactgcctgatcagagaacttggatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgctgagcagaatgccttataaacctgcagggtcactcatctaaagtctagtgaccttaaactgaatgattt

SEQ ID NO: 1208 - DNA, 3593 bp, Homo sapiens
ccttgccaagtaacagctttgctgtccaacatcgtgtgctgcttcgcgagaaagtcacattcggaccctttggctagattatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaagcaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaattccaactgcctgatcagagaacttggatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgctgagcagaatgccttataaacctgcagggtcactcatctaaagtctagtgaccttaaactgaatgatttaaaaaagaaaagaaagaa

SEQ ID NO: 1209 - DNA, 580 bp, Homo sapiens
cttgttcctcctgcgaaacggtgcggtctggacacgtctccggggtgggtcgtccggccttcgatcttagacgaattttacaatgtgaagttctgcatagatgccagtcaaccagatgttggaagctggctcaagtacattagattcgctggctgttatgatcagcacaaccttgttgcatgccagataaatgatcaggaaagaagctaagcagaaaatactcctcattaagttatttttcaaatttagcacaattttgtgctccggtcttgttatagaaaaataaacaattggactttagagccacctactggaataaagagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatct

SEQ ID NO: 1210 - DNA, 379 bp, Homo sapiens
agagcattcaaaaaagtctccatgcctcagtgtattaatctagaaaaggagagcagcaacataatggcaggctgaccacctaggaatagcatgagaacacgaagatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagct

SEQ ID NO: 1211 - DNA, 638 bp, Homo sapiens
ttatctacgttgctaagccgggcgatttccttgttcctcctgcgaaacggtgcggtctggacacgtctccgggatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatg

SEQ ID NO: 1212 - DNA, 1533 bp, Homo sapiens
tttgctgtccaacatcgtgtgctgcttcgcgagaaagtcacattcggaccctttggctagattgtggggatttttttttttttccttttgctgttggttttttgaaagggcctttctctaaagtctacctaaacggtttttttttaagctatctttggaggttgacagcttttaaaaacacaggagtgtgttatatgaaatgactgaagatgtgtcgttactttattttattcgagatttccgacacgattaagacatttgggagacaaatgcagttctgctagcaaatcaaaagtgaataattcacccagggggcaaacgtttctggagaaagctaagcttttgtcttggggcaagaatattgagaggaagaatgttaatatgatggtgaaatctttgaataatcgtataacagattagtaaaaagacattctttggaaatgaacctttttaaaaattaattttgctgttgacagtggcaatgctaataatgttaacacggaataaaattacacctacaatttttatgtgcagtgtatgtaatacttaactccctgcccctgtgaaagggtatgcttgaaagctaaggggatggatgcttcttgactttgaaattaacaagttttccacgtctctctgcaaatatgaaatggaattagtattgcatttcactggctttattctatgtcctttattaaatatttctttggtgtgtcaggagaactgccttttctttttctttttttcttttttttcttttttttgccagtcaaggaaacaaacaacaaaagatcaaccagaaaccaaacagactgaacaaaccaacaaaacccagcaacaaactccaactttttactatttaaaaatgtgcattgctattatttatgtaccttctcaacatctgggatggggggaaatctcaagttgccatttgagttactcagcactgagagttgaagaaacatcttaaagcttattcatagggcttcttgactaaagcccttggagcactgggtttttcttgaagtatatgatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaa

SEQ ID NO: 1213 - DNA, 3939 bp, Homo sapiens
agagagagggagggagcgagagggagagcaaaagaaggaaaggatccaagaaaaaaaagccccaaccacacaccagcggctgcaggactgggcacagcatgagatccaaaggcagggcaaggaaactggccacaaataatgagtgtgtatatggcaactaccctgaaatacctttggaagaaatgccagatgcagatggagtagccagcactccctccctcaatattcaagagccatgctctcctgccacatccagtgaagcattcactccaaaggagggttctccttacaaagcccccatctacatccctgatgatatccccattcctgctgagtttgaacttcgagagtcaaatatgcctggggcaggactaggaatatggaccaaaaggaagatcgaagtaggtgaaaagtttgggccttatgtgggagagcagaggtcaaacctgaaagaccccagttatggatgggagatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaaatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgctgagcagaatgccttataaacctgcagggtcactcatctaaagtctagtgaccttaaactgaatgattta

SEQ ID NO: 1214 - DNA, 1097 bp, Homo sapiens
tttgctgtccaacatcgtgtgctgcttcgcgagaaagtcacattcggaccctttggctagattgtggggatttttttttttttccttttgctgttggttttttgaaagggcctttctctaaagtctacctaaacggtttttttttaagctatctttggaggttgacagcttttaaaaacacaggagtgtgttatatgaaatgactgaagatgtgtcgttactttattttattcgagatttccgacacgattaagacatttgggagacaaatgcagttctgctagcaaatcaaaagtgaataattcacccagggggcaaacgtttctggagaaagctaagcttttgtcttggggcaagaatattgagaggaagaatgttaatatgatggtgaaatctttgaataatcgtataacagattagtaaaaagacattctttggaaatgaacctttttaaaaattaattttgctgttgacagtggcaatgctaataatgttaacacggaataaaattacacctacaatttttatgtgcagtgcttattcatagggcttcttgactaaagcccttggagcactgggtttttcttgaagtatatgatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaa

SEQ ID NO: 1215 - DNA, 2875 bp, Homo sapiens
ggccccacgcctcaggcgactggttgttaccgaggaagatggcggcgccagacccgaggcgctagggaagatcgcaccgcggacgcccgctgagcttggcgcacgggccgaccaggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaagtcgggcgcctccagcttcggggagaagttctcccgagtcaagttctcaccgtcgctcacgctgttcggcggcaagcccatggagggctggatcgcggtgacggtcagcggcctggtcaccgtgtccctgctgaagcccagcgggcaggtgctgacgtccaccgagagcctgtgccggctgcgcggccgcgtggccctggccgacatcgccttcaccggcggcggcaacatcgtggtggccacggcggacggcagcagcgcgtcgcccgtgcagttctacaaggtgtgcgtgagcgtggtgagcgagaagtgccgtatcgacacggagatcctgccctccctgttcatgcgctgcaccaccgacctcaaccgcaaggacaagtttcccgccatcacccacctcaagttcctggcccgggacatgtcggagcaggtgcttttgtgcgcgtccagccagaccagcagcatcgtggagtgctggtccctgcgcaaggagggactccccgtgaacaacatcttccagcagatctcccccgtggttggcgacaaacagcccacaattctcaaatggcggatcctatcggccaccaacgatctggaccgtgtgtcggccgtggcgctgcccaagctgcccatctcgctcaccaacaccgacctcaaggtggccagcgacacacagttctaccctggcctcgggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccaggtcgcgatgagggcccagcgagcgagccggacgaggcgctggtggatgaatgctgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctgtgcggtgggctctggtggcgggtgcccctcagctacccctgagcccagctgcccctcagctactcctcagctacccctcagctgcccctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgccc

SEQ ID NO: 1216 - DNA, 3125 bp, Homo sapiens
ggccccacgcctcaggcgactggttgttaccgaggaagatggcggcgccagacccgaggcgctagggaagatcgcaccgcggacgcccgctgagcttggcgcacgggccgaccaggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaagtcgggcgcctccagcttcggggagaagttctcccgagtcaagttctcaccgtcgctcacgctgttcggcggcaagcccatggagggctggatcgcggtgacggtcagcggcctggtcaccgtgtccctgctgaagcccagcgggcaggtgctgacgtccaccgagagcctgtgccggctgcgcggccgcgtggccctggccgacatcgccttcaccggcggcggcaacatcgtggtggccacggcggacggcagcagcgcgtcgcccgtgcagttctacaaggtgtgcgtgagcgtggtgagcgagaagtgccgtatcgacacggagatcctgccctccctgttcatgcgctgcaccaccgacctcaaccgcaaggacaagtttcccgccatcacccacctcaagttcctggcccgggacatgtcggagcaggtgcttttgtgcgcgtccagccagaccagcagcatcgtggagtgctggtccctgcgcaaggagggactccccgtgaacaacatcttccagcagatctcccccgtggttggcgacaaacagcccacaattctcaaatggcggatcctatcggccaccaacgatctggaccgtgtgtcggccgtggcgctgcccaagctgcccatctcgctcaccaacaccgacctcaaggtggccagcgacacacagttctaccctggcctcgggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagggttccctgctgaggccgggccacagctttctgcgggacggcacctcgctgggcatgcttcgggaattgatggtggtcatccgcatctggggccttctgaagcccagctgcctgcccgtgtatacggccacctcggatacccaggacagcatgtccctgctcttccgcctgctcaccaagctctggatctgctttcctagcacaggtccatgctctgtgtgggtgcttttgggatggcagccacttccaggtcgcgatgagggcccagcgagcgagccggacgaggcgctggtggatgaatgctgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctgtgcggtgggctctggtggcgggtgcccctcagctacccctgagcccagctgcccctcagctactcctcagctacccctcagctgcccctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgccc

SEQ ID NO: 1217 - DNA, 2922 bp, Homo sapiens
cagaagtctttgggaggcggccccacgcctcaggcgactggttgttaccgaggaagatggcggcgccagacccgaggcgctagggaagatcgcaccgcggacgcccgctgagcttggcgcacgggccgaccaggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaagtcgggcgcctccagcttcggggagaagttctcccgagtcaagttctcaccgtcgctcacgctgttcggcggcaagcccatggagggctggatcgcggtgacggtcagcggcctggtcaccgtgtccctgctgaagcccagcgggcaggtgctgacgtccaccgagagcctgtgccggctgcgcggccgcgtggccctggccgacatcgccttcaccggcggcggcaacatcgtggtggccacggcggacggcagcagcgcgtcgcccgtgcagttctacaaggtgtgcgtgagcgtggtgagcgagaagtgccgtatcgacacggagatcctgccctccctgttcatgcgctgcaccaccgacctcaaccgcaaggacaagtttcccgccatcacccacctcaagttcctggcccgggacatgtcggagcaggtgcttttgtgcgcgtccagccagaccagcagcatcgtggagtgctggtccctgcgcaaggagggactccccgtgaacaacatcttccagcagatctcccccgtggttggcgacaaacagcccacaattctcaaatggcggatcctatcggccaccaacgatctggaccgtgtgtcggccgtggcgctgcccaagctgcccatctcgctcaccaacaccgacctcaaggtggccagcgacacacagttctaccctggcctcgggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagggttccctgctgaggccgggccacagctttctgcgggacggcacctcgctgggcatgcttcgggaattgatggtggtcatccgcatctggggccttctgaagcccagctgcctgcccgtgtatacggccacctcggatacccaggacagcatgtccctgctcttccgcctgctcaccaagctctggatctgctgtcgcgatgagggcccagcgagcgagccggacgaggcgctggtggatgaatgctgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgccc

SEQ ID NO: 1218 - DNA, 3068 bp, Homo sapiens
ggccccacgcctcaggcgactggttgttaccgaggaagatggcggcgccagacccgaggcgctagggaagatcgcaccgcggacgcccgctgagcttggcgcacgggccgaccaggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaagtcgggcgcctccagcttcggggagaagttctcccgagtcaagttctcaccgtcgctcacgctgttcggcggcaagcccatggagggctggatcgcggtgacggtcagcggcctggtcaccgtgtccctgctgaagcccagcgggcaggtgctgacgtccaccgagagcctgtgccggctgcgcggccgcgtggccctggccgacatcgccttcaccggcggcggcaacatcgtggtggccacggcggacggcagcagcgcgtcgcccgtgcagttctacaaggtgtgcgtgagcgtggtgagcgagaagtgccgtatcgacacggagatcctgccctccctgttcatgcgctgcaccaccgacctcaaccgcaaggacaagtttcccgccatcacccacctcaagttcctggcccgggacatgtcggagcaggtgcttttgtgcgcgtccagccagaccagcagcatcgtggagtgctggtccctgcgcaaggagggactccccgtgaacaacatcttccagcagatctcccccgtggttggcgacaaacagcccacaattctcaaatggcggatcctatcggccaccaacgatctggaccgtgtgtcggccgtggcgctgcccaagctgcccatctcgctcaccaacaccgacctcaaggtggccagcgacacacagttctaccctggcctcgggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagggttccctgctgaggccgggccacagctttctgcgggacggcacctcgctgggcatgcttcgggaattgatggtggtcatccgcatctggggccttctgaagcccagctgcctgcccgtgtatacggccacctcggatacccaggacagcatgtccctgctcttccgcctgctcaccaagctctggatctgctgtcgcgatgagggcccagcgagcgagccggacgaggcgctggtggatgaatgctgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctgtgcggtgggctctggtggcgggtgcccctcagctacccctgagcccagctgcccctcagctactcctcagctacccctcagctgcccctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgccc

SEQ ID NO: 1219 - DNA, 2122 bp, Homo sapiens
ggccccacgcctcaggcgactggttgttaccgaggaagatggcggcgccagacccgaggcgctagggaagatcgcaccgcggacgcccgctgagcttggcgcacgggccgaccaggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaagtcgggcgcctccagcttcggggagaagttctcccgagtcaagttctcaccgtcgctcacgctgttcggcggcaagcccatggagggctggatcgcggtgacggtcagcggcctggtcaccgtgtccctgctgaagcccagcgggcaggtgctgacgtccaccgagagcctgtgccggctgcgcggccgcgtggccctggccgacatcgccttcaccggcggcggcaacatcgtggtggccacggcggacggcagcagcgcgtcgcccgtgcagttctacaaggtgtgcgtgagcgtggtgagcgagaagtgccgtatcgacacggagatcctgccctccctgttcatgcgctgcaccaccgacctcaaccgcaaggacaagtttcccgccatcacccacctcaagttcctggcccgggacatgtcggagcaggtgcttttgtgcgcgtccagccagaccagcagcatcgtggagtgctggtccctgcgcaaggagggactccccgtgaacaacatcttccagcagatctcccccgtggttggcgacaaacagcccacaattctcaaatggcggatcctatcggccaccaacgatctggaccgtgtgtcggccgtggcgctgcccaagctgcccatctcgctcaccaacaccgacctcaaggtggccagcgacacacagttctaccctggcctcgggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagccctgccccacctcggagccctgccccacctcggagccctgccccacctcggagccctcccccacctcggagccctcccccacc

SEQ ID NO: 1220 - DNA, 2861 bp, Homo sapiens
ggccccacgcctcaggcgactggttgttaccgaggaagatggcggcgccagacccgaggcgctagggaagatcgcaccgcggacgcccgctgagcttggcgcacgggccgaccaggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaagtcgggcgcctccagcttcggggagaagttctcccgagtcaagttctcaccgtcgctcacgctgttcggcggcaagcccatggagggctggatcgcggtgacggtcagcggcctggtcaccgtgtccctgctgaagcccagcgggcaggtgctgacgtccaccgagagcctgtgccggctgcgcggccgcgtggccctggccgacatcgccttcaccggcggcggcaacatcgtggtggccacggcggacggcagcagcgcgtcgcccgtgcagttctacaaggtgtgcgtgagcgtggtgagcgagaagtgccgtatcgacacggagatcctgccctccctgttcatgcgctgcaccaccgacctcaaccgcaaggacaagtttcccgccatcacccacctcaagttcctggcccgggacatgtcggagcaggtgcttttgtgcgcgtccagccagaccagcagcatcgtggagtgctggtccctgcgcaaggagggactccccgtgaacaacatcttccagcagatctcccccgtggttggcgacaaacagcccacaattctcaaatggcggatcctatcggccaccaacgatctggaccgtgtgtcggccgtggcgctgcccaagctgcccatctcgctcaccaacaccgacctcaaggtggccagcgacacacagttctaccctggcctcgggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagggttccctgctgaggccgggccacagctttctgcgggacggcacctcgctgggcatgcttcgggaattgatggtggtcatccgcatctggggccttctgaagcccagctgcctgcccgtgtatacggccacctcggatacccaggacagcatgtccctgctcttccgcctgctcaccaagctctggatctgctgtcgcgatgagggcccagcgagcgagccggacgaggcgctggtggatgaatgctgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctgtgcggtgggctctggtggcgggtgcccctcagctacccctgagcccagctgcccctcagctactcctcagctacccctcagctgcccctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgccc

SEQ ID NO: 1221 - DNA, 2636 bp, Homo sapiens
ggccccacgcctcaggcgactggttgttaccgaggaagatggcggcgccagacccgaggcgctagggaagatcgcaccgcggacgcccgctgagcttggcgcacgggccgaccaggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaaggtgcttttgtgcgcgtccagccagaccagcagcatcgtggagtgctggtccctgcgcaaggagggactccccgtgaacaacatcttccagcagatctcccccgtggttggcgacaaacagcccacaattctcaaatggcggatcctatcggccaccaacgatctggaccgtgtgtcggccgtggcgctgcccaagctgcccatctcgctcaccaacaccgacctcaaggtggccagcgacacacagttctaccctggcctcgggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagggttccctgctgaggccgggccacagctttctgcgggacggcacctcgctgggcatgcttcgggaattgatggtggtcatccgcatctggggccttctgaagcccagctgcctgcccgtgtatacggccacctcggatacccaggacagcatgtccctgctcttccgcctgctcaccaagctctggatctgctgtcgcgatgagggcccagcgagcgagccggacgaggcgctggtggatgaatgctgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctgtgcggtgggctctggtggcgggtgcccctcagctacccctgagcccagctgcccctcagctactcctcagctacccctcagctgcccctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgccc

SEQ ID NO: 1222 - DNA, 2345 bp, Homo sapiens
ggccccacgcctcaggcgactggttgttaccgaggaagatggcggcgccagacccgaggcgctagggaagatcgcaccgcggacgcccgctgagcttggcgcacgggccgaccaggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatgggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagggttccctgctgaggccgggccacagctttctgcgggacggcacctcgctgggcatgcttcgggaattgatggtggtcatccgcatctggggccttctgaagcccagctgcctgcccgtgtatacggccacctcggatacccaggacagcatgtccctgctcttccgcctgctcaccaagctctggatctgctgtcgcgatgagggcccagcgagcgagccggacgaggcgctggtggatgaatgctgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctgtgcggtgggctctggtggcgggtgcccctcagctacccctgagcccagctgcccctcagctactcctcagctacccctcagctgcccctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgccc

SEQ ID NO: 1223 - DNA, 2351 bp, Homo sapiens
ggccccacgcctcaggcgactggttgttaccgaggaagatggcggcgccagacccgaggcgctagggaagatcgcaccgcggacgcccgctgagcttggcgcacgggccgaccaggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagggttccctgctgaggccgggccacagctttctgcgggacggcacctcgctgggcatgcttcgggaattgatggtggtcatccgcatctggggccttctgaagcccagctgcctgcccgtgtatacggccacctcggatacccaggacagcatgtccctgctcttccgcctgctcaccaagctctggatctgctgtcgcgatgagggcccagcgagcgagccggacgaggcgctggtggatgaatgctgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctgtgcggtgggctctggtggcgggtgcccctcagctacccctgagcccagctgcccctcagctactcctcagctacccctcagctgcccctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgccc

SEQ ID NO: 1224 - DNA, 2222 bp, Homo sapiens
ggccccacgcctcaggcgactggttgttaccgaggaagatggcggcgccagacccgaggcgctagggaagatcgcaccgcggacgcccgctgagcttggcgcacgggccgaccaggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaagtcgggcgcctccagcttcggggagaagttctcccgagtcaagttctcaccgtcgctcacgctgttcggcggcaagcccatggagggctggatcgcggtgacggtcagcggcctggtcaccgtgtccctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagggttccctgctgaggccgggccacagctttctgcgggacggcacctcgctgggcatgcttcgggaattgatggtggtcatccgcatctggggccttctgaagcccagctgcctgcccgtgtatacggccacctcggatacccaggacagcatgtccctgctcttccgcctgctcaccaagctctggatctgctgtcgcgatgagggcccagcgagcgagccggacgaggcgctggtggatgaatgctgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctgtgcggtgggctctggtggcgggtgcccctcagctacccctgagcccagctgcccctcagctactcctcagctacccctcagctgcccctgagcccggctgctgcaagagccaccgctcgccctggactctcctcggcgcggttaacctcagcccgccctgcagggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgccc

SEQ ID NO: 1225 - DNA, 1437 bp, Homo sapiens
aaaaatcgaggcggggctgagaggctgcggcggctgactaggttttcggaccgcggcgcggcggggaagagagactgcggcgggagggccaggccgtgggagagacgcgggaaagtgcgggtcgcagaggcacttgaccaccccgccctaggccgacccggcggacgcggcgtctggtgtgcgggcgctggggcgggtcccaggtctccccgctgcgctgcttgaggctcagccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccagctcaagcctttgcgaagctaatgacctgcctctgtgcgaagcttacgggaggctggacctcgacacagactctgctgatggcctctcggcccctctgctggcgtccccggagcccagtgctggccccctacaggtggcagcccctgcccactcccatgctggtggccctggccccactgagcacgcctgagcctccggggccacgcttcgttctcaggaacaaaacctgaggcagccctttggatgccctcacagccttgcttctctcagcctaggttcccatttggggacttcaggaccccagagccactaggacttccttgggaagcccgttagcccagggtgggtcccaccaggacagtagggaaacagttgtttccctagccatttccgaatagcccatcattccgagtcatcatctctgtttgctgccttcctggccagccaggtggaagaaagtttccaagctaggtctggcccgttggggatctcagcagtggggcaggagggtgcctgatttcggggagtcctgacccgagcctgttgtcagagttgggaggggctctgagcagtgttgggcaggccgggtctcccatcccgaggccagcgttcctgtgcagagccccatccactggttcttgccctgagccacatatgtctgtgccatgggctgagtgccacgacaggcccgtgtgacagctgctgcccacgcatgtggaagctaggtgggactcattcctaattctgccgttgtaatgagacttgattaaaacaccgccacttttttgca

SEQ ID NO: 1226 - DNA, 3872 bp, Homo sapiens
aaaaatcgaggcggggctgagaggctgcggcggctgactaggttttcggaccgcggcgcggcggggaagagagactgcggcgggagggccaggccgtgggagagacgcgggaaagtgcgggtcgcagaggcacttgaccaccccgccctaggccgacccggcggacgcggcgtctggtgtgcgggcgctggggcgggtcccaggtctccccgctgcgctgcttgaggctcagccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccaggtataaatagcgctggactccccatgcagagcgggagcctgcctacctgggcctggccagcaggcagggctgccttctgctttttcaaattcttgctggtcttagcagtggagccatgcctgggtttcagagcagagctcctggccagagcgtttgaccgacagacaattcacatccatatgccagggccctgggcctttcccacagtgcaatgtgatgaaaaccacaggactcacgccagtcggataggccgagtctggagaagggaggcgcctggctgtatcccccgcaggccctcttccgagagccttcctcctcgggcagtgcgttctggggctgtgctgctcctgttaccttctgaatccatatgtagagatttcagccaaggctgggccagccttttttgggcagtcaggtccacacctatgtccagggcaccagggatgcaattccatgtggatgtcaccaaaccccagtgtggaggcagggacagtcatgggaatgtgggggatgaagcccaggcagggaatggccttgaaagccattggagctccaattcgtgacccactcagccttatccacggagctggagccaacctacgtgccaggccccatgctgggtcccagggatgcagaagggtcaaaacccatcatcctgacccttgtggggctccgtaagaagctgaaaccttcgaccgtttgagctggaggggccctgagaaatcagagtctacgtatcatttacttagggggaaacttaggctggagacagggaggccttccactctgccccattagcttagaaaatcaagattcagtccagcagatgcagagtccatgtccatcttgtgccttctcctggacaaacctttccttcctggtggtggatttaaaatactcctttctgcccattggccatgctgggagccacagctatccagagccagcatgacctggggcttggtttccctgccctgggctcagtggcactgctgagctgcagcagtcctagagttttccagggggttctgagggaatctttggtccccagtactcattaactcagcagacatgaggcagcatttcctccacactagggtggctgagaggggtcctggggtgtttcagacccttctgggcatctccttccacagctgttcagtttgtcggtctctttgaggcagccaccgtccctgagggcccctgcacagagcagctgtgggcctgtaattcagcctgcctgccttgccttggggcagggagagagggaacctgctcacggccctgcagcagagcagggcgcaaacccaggacatctgtgccaggcttcccatgccctcccccaacagtccctcagcttcacccagcggggcttccaggccagcctgtgtcccctcccgcaggcctcctgtccacaccagcgccccctggggggcctcacacagcccctgtggcagaagcagttgccctcctctgtacattgcctttaagcgaccaggtcctggccgagtttcctctgccccttcttgctggtcccccaaagggcgctccgctccctgccctgccctgccctgccctgttccgcatgagctgcgcctctgtgctcgcctgccccctctctgcttgttagttgctctttctggctctgcctctcctttgctttcctcgggatgccactctgtgcccaggacggttctgagactgaacactgagggcaggagcaagggaggaagccaggggcgaggcaggccgcgggaaagccagggcccctgcctgcaggttagaaagaggcgagcgtggattgtcacagctgcgggcatgggaagggctagctgagctcttcacctgcatcctggctgccgtgaggattccccgtgttagaggtggggacgcctgctggaggccgcctggctgatgtagggctatcgggaagtgccagggcctgtgttcccaactgtcgcccccttcaggctaagtctcaggcagggacagacccagaaagaacacagtctgccctcagagagctctttgcagtgtagtgacactggggtttctgcagtcagggaggagggagggtggccaggctgacagctttttgcaagaggagggggaccagcaccagctgggaggcataggctaggacaggcccacgtggaggctgggcaggaagggcctgctgaggtcacacagctgttggtggttgggccagggcggcttcctcctttcagaatgctagggtggctctcaccactggccgcctctccttgccaggcctgccaactcaggggacagatggagcaggagtggagaaagggaaaggcaggtctggggtgtggtcgtgttttcttaactctgcttctgtcttgctctcccctcccctggctttcctctctgcctgctcctgtctctccctggggtttctggtggtggaaaagctcaagcctttgcgaagctaatgacctgcctctgtgcgaagcttacgggaggctggacctcgacacagactctgctgatggcctctcggcccctctgctggcgtccccggagcccagtgctggccccctacaggtggcagcccctgcccactcccatgctggtggccctggccccactgagcacgcctgagcctccggggccacgcttcgttctcaggaacaaaacctgaggcagccctttggatgccctcacagccttgcttctctcagcctaggttcccatttggggacttcaggaccccagagccactaggacttccttgggaagcccgttagcccagggtgggtcccaccaggacagtagggaaacagttgtttccctagccatttccgaatagcccatcattccgagtcatcatctctgtttgctgccttcctggccagccaggtggaagaaagtttccaagctaggtctggcccgttggggatctcagcagtggggcaggagggtgcctgatttcggggagtcctgacccgagcctgttgtcagagttgggaggggctctgagcagtgttgggcaggccgggtctcccatcccgaggccagcgttcctgtgcagagccccatccactggttcttgccctgagccacatatgtctgtgccatgggctgagtgccacgacaggcccgtgtgacagctgctgcccacgcatgtggaagctaggtgggactcattcctaattctgccgttgtaatgagacttgattaaaacaccgccacttttttgca

SEQ ID NO: 1227 - DNA, 987 bp, Homo sapiens
aaaaatcgaggcggggctgagaggctgcggcggctgactaggttttcggaccgcggcgcggcggggaagagagactgcggcgggagggccaggccgtgggagagacgcgggaaagtgcgggtcgcagaggcacttgaccaccccgccctaggccgacccggcggacgcggcgtctggtcccaggtctccccgctgcgctgcttgaggctcagccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccaggtataaatagcgctggactccccatgcagagcgggagcctgcctacctgggcctggccagcaggcagggctgccttctgctttttcaaattcttgctggtcttagcagtggagccatgcctgggtttcagagcagagctcctggccagagcgtttgaccgacagacaattcacatccatatgccagggccctgggcctttcccacagtgcaatgtgatgaaaaccacaggactcacgccagtcggataggccgagtctggagaagggaggcgcctggctgtatcccccgcaggccctcttccgagagccttcctcctcgggcagtgcgttctggggctgtgctgctcctgttaccttctgaatccatatgtagagatt

SEQ ID NO: 1228 - DNA, 560 bp, Homo sapiens
gtgggagagacgcgggaaagtgcgggtcgcagaggcacttgaccaccccgccctaggccgacccggcggacgcggcgtctggtgtgcgggcgctggggcgggtatgagggtcccaggtctccccgctgcgctgcttgaggctcagccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccag

SEQ ID NO: 1229 - DNA, 561 bp, Homo sapiens
attcctataaagctaaaaatcgaggcggggctgagaggctgcggcggctgactaggttttcggaccgcggcgcggcggggaagagagactgcggcgggagggccaggccgtgggagagacgcgggaaagtgcgggtcgcagaggcacttgaccaccccgccctaggccgacccggcggacgcggcgtctggtcccaggtctccccgctgcgctgcttgaggctcagccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggag

SEQ ID NO: 1230 - DNA, 3891 bp, Homo sapiens
acaaacaatgcgagtgcgtccaggagtccgctcggtcgtgcgccagactccgaacctagggggccccgggccctccctgagcaccgcgcgcaaaggcccggccccagggccaggcaactccagcgccgaggccgtccagtgcggctggagggcagaggccgagaggcgcggcgcggaacttgagccccttgtcccggcgcaccggggaaccatgaggtcccaggtctccccgctgcgctgcttgaggctcagccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccaggtataaatagcgctggactccccatgcagagcgggagcctgcctacctgggcctggccagcaggcagggctgccttctgctttttcaaattcttgctggtcttagcagtggagccatgcctgggtttcagagcagagctcctggccagagcgtttgaccgacagacaattcacatccatatgccagggccctgggcctttcccacagtgcaatgtgatgaaaaccacaggactcacgccagtcggataggccgagtctggagaagggaggcgcctggctgtatcccccgcaggccctcttccgagagccttcctcctcgggcagtgcgttctggggctgtgctgctcctgttaccttctgaatccatatgtagagatttcagccaaggctgggccagccttttttgggcagtcaggtccacacctatgtccagggcaccagggatgcaattccatgtggatgtcaccaaaccccagtgtggaggcagggacagtcatgggaatgtgggggatgaagcccaggcagggaatggccttgaaagccattggagctccaattcgtgacccactcagccttatccacggagctggagccaacctacgtgccaggccccatgctgggtcccagggatgcagaagggtcaaaacccatcatcctgacccttgtggggctccgtaagaagctgaaaccttcgaccgtttgagctggaggggccctgagaaatcagagtctacgtatcatttacttagggggaaacttaggctggagacagggaggccttccactctgccccattagcttagaaaatcaagattcagtccagcagatgcagagtccatgtccatcttgtgccttctcctggacaaacctttccttcctggtggtggatttaaaatactcctttctgcccattggccatgctgggagccacagctatccagagccagcatgacctggggcttggtttccctgccctgggctcagtggcactgctgagctgcagcagtcctagagttttccagggggttctgagggaatctttggtccccagtactcattaactcagcagacatgaggcagcatttcctccacactagggtggctgagaggggtcctggggtgtttcagacccttctgggcatctccttccacagctgttcagtttgtcggtctctttgaggcagccaccgtccctgagggcccctgcacagagcagctgtgggcctgtaattcagcctgcctgccttgccttggggcagggagagagggaacctgctcacggccctgcagcagagcagggcgcaaacccaggacatctgtgccaggcttcccatgccctcccccaacagtccctcagcttcacccagcggggcttccaggccagcctgtgtcccctcccgcaggcctcctgtccacaccagcgccccctggggggcctcacacagcccctgtggcagaagcagttgccctcctctgtacattgcctttaagcgaccaggtcctggccgagtttcctctgccccttcttgctggtcccccaaagggcgctccgctccctgccctgccctgccctgccctgttccgcatgagctgcgcctctgtgctcgcctgccccctctctgcttgttagttgctctttctggctctgcctctcctttgctttcctcgggatgccactctgtgcccaggacggttctgagactgaacactgagggcaggagcaagggaggaagccaggggcgaggcaggccgcgggaaagccagggcccctgcctgcaggttagaaagaggcgagcgtggattgtcacagctgcgggcatgggaagggctagctgagctcttcacctgcatcctggctgccgtgaggattccccgtgttagaggtggggacgcctgctggaggccgcctggctgatgtagggctatcgggaagtgccagggcctgtgttcccaactgtcgcccccttcaggctaagtctcaggcagggacagacccagaaagaacacagtctgccctcagagagctctttgcagtgtagtgacactggggtttctgcagtcagggaggagggagggtggccaggctgacagctttttgcaagaggagggggaccagcaccagctgggaggcataggctaggacaggcccacgtggaggctgggcaggaagggcctgctgaggtcacacagctgttggtggttgggccagggcggcttcctcctttcagaatgctagggtggctctcaccactggccgcctctccttgccaggcctgccaactcaggggacagatggagcaggagtggagaaagggaaaggcaggtctggggtgtggtcgtgttttcttaactctgcttctgtcttgctctcccctcccctggctttcctctctgcctgctcctgtctctccctggggtttctggtggtggaaaagctcaagcctttgcgaagctaatgacctgcctctgtgcgaagcttacgggaggctggacctcgacacagactctgctgatggcctctcggcccctctgctggcgtccccggagcccagtgctggccccctacaggtggcagcccctgcccactcccatgctggtggccctggccccactgagcacgcctgagcctccggggccacgcttcgttctcaggaacaaaacctgaggcagccctttggatgccctcacagccttgcttctctcagcctaggttcccatttggggacttcaggaccccagagccactaggacttccttgggaagcccgttagcccagggtgggtcccaccaggacagtagggaaacagttgtttccctagccatttccgaatagcccatcattccgagtcatcatctctgtttgctgccttcctggccagccaggtggaagaaagtttccaagctaggtctggcccgttggggatctcagcagtggggcaggagggtgcctgatttcggggagtcctgacccgagcctgttgtcagagttgggaggggctctgagcagtgttgggcaggccgggtctcccatcccgaggccagcgttcctgtgcagagccccatccactggttcttgccctgagccacatatgtctgtgccatgggctgagtgccacgacaggcccgtgtgacagctgctgcccacgcatgtggaagctaggtgggactcattcctaattctgccgttgtaatgagacttgattaaaacaccgccacttttttgc

SEQ ID NO: 1231 - DNA, 2725 bp, Homo sapiens
aaaaatcgaggcggggctgagaggctgcggcggctgactaggttttcggaccgcggcgcggcggggaagagagactgcggcgggagggccaggccgtgggagagacgcgggaaagtgcgggtcgcagaggcacttgaccaccccgccctaggccgacccggcggacgcggcgtctggtgtgcgggcgctggggcgggtcccaggtctccccgctgcgctgcttgaggctcagccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccaggtataaatagcgctggactccccatgcagagcgggagcctgcctacctgggcctggccagcaggcagggctgccttctgctttttcaaattcttgctggtcttagcagtggagccatgcctgggtttcagagcagagctcctggccagagcgtttgaccgacagacaattcacatccatatgccagggccctgggcctttcccacagtgcaatgtgatgaaaaccacaggactcacgccagtcggataggccgagtctggagaagggaggcgcctggctgtatcccccgcaggccctcttccgagagccttcctcctcgggcagtgcgttctggggctgtgctgctcctgttaccttctgaatccatatgtagagatttcagccaaggctgggccagccttttttgggcagtcaggtccacacctatgtccagggcaccagggatgcaattccatgtggatgtcaccaaaccccagtgtggaggcagggacagtcatgggaatgtgggggatgaagcccaggcagggaatggccttgaaagccattggagctccaattcgtgacccactcagccttatccacggagctggagccaacctacgtgccaggccccatgctgggtcccagggatgcagaagggtcaaaacccatcatcctgacccttgtggggctccgtaagaagctgaaaccttcgaccgtttgagctggaggggccctgagaaatcagagtctacgtatcatttacttagggggaaacttaggctggagacagggaggccttccactctgccccattagcttagaaaatcaagattcagtccagcagatgcagagtccatgtccatcttgtgccttctcctggacaaacctttccttcctggtggtggatttaaaatactcctttctgcccattggccatgctgggagccacagctatccagagccagcatgacctggggcttggtttccctgccctgggctcagtggcactgctgagctgcagcagtcctagagttttccagggggttctgagggaatctttggtccccagtactcattaactcagcagacatgaggcagcatttcctccacactagggtggctgagaggggtcctggggtgtttcagacccttctgggcatctccttccacagctgttcagtttgtcggtctctttgaggcagccaccgtccctgagggcccctgcacagagcagctgtgggcctgtaattcagcctgcctgccttgccttggggcagggagagagggaacctgctcacggccctgcagcagagcagggcgcaaacccaggacatctgtgccaggcttcccatgccctcccccaacagtccctcagcttcacccagcggggcttccaggccagcctgtgtcccctcccgcaggcctcctgccccctacaggtggcagcccctgcccactcccatgctggtggccctggccccactgagcacgcctgagcctccggggccacgcttcgttctcaggaacaaaacctgaggcagccctttggatgccctcacagccttgcttctctcagcctaggttcccatttggggacttcaggaccccagagccactaggacttccttgggaagcccgttagcccagggtgggtcccaccaggacagtagggaaacagttgtttccctagccatttccgaatagcccatcattccgagtcatcatctctgtttgctgccttcctggccagccaggtggaagaaagtttccaagctaggtctggcccgttggggatctcagcagtggggcaggagggtgcctgatttcggggagtcctgacccgagcctgttgtcagagttgggaggggctctgagcagtgttgggcaggccgggtctcccatcccgaggccagcgttcctgtgcagagccccatccactggttcttgccctgagccacatatgtctgtgccatgggctgagtgccacgacaggcccgtgtgacagctgctgcccacgcatgtggaagctaggtgggactcattcctaattctgccgttgtaatgagacttgattaaaacaccgccacttttttgca

SEQ ID NO: 1232 - DNA, 4380 bp, Homo sapiens
ctgagcaccgcgcgcaaaggcccggccccagggccaggcaactccagcgccgaggccgtccagtgcggctggagggcagaggccgagaggcgcggcgcggaacttgagccccttgtcccggcgcaccggggaaccatgagggatgttaagcgagggagtggaattaccccccttttttttttcttttggagacgtagtctccccctgtcgcccaggctggagtgcagtggcgcgatctcggctcactgcgacctgtgcttcccgggttcaagcgattctcctgcctcagcctcccgagtagctgggattacaggcgcctgccatcacgcccggctaatttttgtatttttagtagagttggggtttcaccatgttggtcaggctagtctcaaactcctgacctcaggtgatccctgcctcggcctcccaaagtgctgggattacaggcgtgagccaccgcgcccggttggaatgaccactttttaggacctcttccctgccgcgcagagactggagggagcggggcccgcagtgcagggatgaggtcccaggtctccccgctgcgctgcttgaggctcagccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccagctcaagcctttgcgaagctaatgacctgcctctgtgcgaagcttacgggaggctggacctcgacacagactctgctgatggcctctcggcccctctgctggcgtccccggagcccagtgctggccccctacaggtggcagcccctgcccactcccatgctggtggccctggccccactgagcacgcctgagcctccggggccacgcttcgttctcaggaacaaaacctgaggcagccctttggatgccctcacagccttgcttctctcagcctaggttcccatttggggacttcaggaccccagagccactaggacttccttgggaagcccgttagcccagggtgggtcccaccaggacagtagggaaacagttgtttccctagccatttccgaatagcccatcattccgagtcatcatctctgtttgctgccttcctggccagccaggtggaagaaagtttccaagctaggtctggcccgttggggatctcagcagtggggcaggagggtgcctgatttcggggagtcctgacccgagcctgttgtcagagttgggaggggctctgagcagtgttgggcaggccgggtctcccatcccgaggccagcgttcctgtgcagagccccatccactggttcttgccctgagccacatatgtctgtgccatgggctgagtgccacgacaggcccgtgtgacagctgctgcccacgcatgtggaagctaggtgggactcattcctaattctgccgttgtaatgagacttgattaaaacaccgccacttttttgcattgctgctctttcttcctcattccttgtcagtccaggaccatccttggtctcccagcagttgtccgagcagcagctcctcagctctgcctggacagcctggcccaaggtcactctctcctcattggcacctggtaggtccccagtattcagtgaatggacctgctgccatcattgcacatccaggcacctgtgcctctgctggcatctcatcctcactgctaccagagccggtgctcctagtgccggtattttagagaggagaggatgtggacttagaaggggtgaggtgtaccacggccacagagctaggaagtgaagtggcaggaatcagaacttgaacctgatggaagtctagacccagtgtcttttggtgccaggctcaccttagaaatgcagaagtcacaacactgggcaggaagtgtggggggagcacagttcgtccacaggaagtatgggggagcactgtgggggagcaccccaccccagttcctccagcaccatccatgtgcttcatcttctcatgggggaggccatcgtctttcccgatgtatgaatgaggtgacagcccaggatccagccttggggacaggtaagaacacagctgacccatcaccacctgaaccagagaaccccacagccaagcagaaggcaccagacagacaggagcttgaggcccagtcctggctctggacctggcttctggggtggcctagggaagttgcttcccctctgagggagaatttccccattgatacgtgtggtgatctgttcccgcactattttagctgtggaaatgccttgtacttaaccactgaggaagaaaaagattacaaccagatggaagcatatatgaagcgagagcccggaaggaactggccagactttgtggtgggatcccacttaccctgttcctaaaatcctgagcgataagacctgccatcagcttcattttctgcttggccaggaccatcattcccatgtgaaaatcaagttatttctccttcttaaagccaagccgctctgctgaccttttttcctctccagctcatggccttggcagcagagctccacggggaagcagctgataaccatttgcagttctctcttgggcctacgtcagacaggttttgtctccatgactctagcaaaactacacctattaaggtcaccagtggcctccacattgctaagccccggcccattctcagtccatgtaactcttttatcccaagctttttattttgagggcagtggaactcatggaagtacttgtcagtttgcctctctgagcacattctccttcgtccatcaccacaaccagaatggatgatgattgcatatcctctggtatctagctgtattcagatttcttcagttgttccccaaatagtttttttaatgcctattttttttctttctagtccagaggtcttttatttttttaacacccacgatgccatgaattcatagggaagaggttccagcagctcaggctccttcccattggttctcacagtgtgctgctctgggtggagcaggctggcgcttcagttgaatccaggtacctttctctttggcttccctctttttctgatcattttccttcacgcgtttcaggaagctctctcggctcttagagtgcttagtgtgctgaatatgcacattcattctcttggcaagaatcttgcccttacttgtttacaacagtgccaacagcatgctggggaacactgtagactctcccagtctagccatggtgacatttgtggggcattcctttttgaacagtacccattcccttgatatctacaatatcacctttctcatcaatttgcatatacttggccaaaggaacaactgcatgttttctgaaaggcctagagaacatatattgggtgcctctcctctttccctttgtgttcgtcattttggcgaattactggaaggtggcggttccagctgaaaggcttttatgcctatttttattgtgtgttgcatttggttgttattttggaatcttaaaatctaaaacaggaccaggtcaggcccagtggctcctgctgtaatcccagcactttgagaagccaaagcgggtggatcacttgtggtcagaagttttgagaccagcctgggcaacatggagaaaccccgtctctactaaaaagtatagaaatcggccgggcgcggtggcttacgcctgcaaccccagcactttgggaggccaaggcgggcggatcacctgaggtcgggatttccagaccagcctgaccaacatggagaaaccctgtctctactaaaaagtatagaaattggccgggcgcggtggctcacgcctgtaatcccagcactttgggaggccgaggcgggcagatcacctgaggtcgggagttccagaccagcctgaccaacatggagaaaccctgtctctactaaaaatacaaaaattagccgggcgtgctggtccatgcctataatcccagctacttggtaggcggaggcaggagaatcgcttgaacccgggaggcagaggttgcagtgagccgagatcgggccactgcactccagcttgggcaacaagagcgaaactccacctc

SEQ ID NO: 1233 - DNA, 534 bp, Homo sapiens
aaagctaaaaatcgaggcggggctgagaggctgcggcggctgactaggttttcggaccgcggcgcggcggggaagagagactgcggcgggagggccaggtctccccgctgcgctgcttgaggctcagccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattac

SEQ ID NO: 1234 - DNA, 1654 bp, Homo sapiens
acagtgccccgggaccggaagagggagccgtggtttccggaacttcgcccgcgtctctgggcttttgctctgtcaggctggtggcgttttggtgtcttcgtttgttatggccgctgctgtcgctatggagacagatgatgctggaaatcgacttcggtttcagttggagttggaatttgtgcaatgtttagccaacccaaattaccttaattttcttgcccaaagaggttacttcaaagacaaagcttttgttaattatcttaaatacttgctttactggaaagacccagaatatgccaagtatctaaagtaccctcagtgtttacacatgttagagctgctccaatatgaacacttccgaaaggagctggtgaatgctcagtgtgcgaaatttattgatgaacagcagattctacattggcagcactattcccggaagcggatgcgccttcagcaagccttggcagagcagcaacagcaaaataacacatcgggaaaatgaaaaactggatacaaacgaggcacttaatacatgtatataatgtatttcttttgtacagtgaagacaaaaaaaatgaaaactcttcctatctacctttattatggtagcccctagaacctttagtgtgctttttcatccaactttttattgttaatagactatttctgttaaacctgaattgttctttgatttccctgtggatttgtaaggtgtttttcttttttacgcatttagcataatcagctgattaagaatggaaaagttaggtgctttagaccaaataaggcactggggcatggggtaggggtgggccaccaagtatactgaattctaaggctagctgttcctgacatatagtagggcaagaccatctcctggaaccttactgtctcagatcaactactctaccactctactctaagatgtagtgagagtagcggagtcactgacctctttaaatcataggacaggaactgcataaaggttcttgaattctgcaggacaggaaataactgtattacctgctttgcaaggtggctttaagaatcactgaatcactgtggcctcacttgacctagtcatggcaggacaactagtggttagttactaactggactcttgactttagaacaaacatgaggagcctcaaatacttgtgttcatttgggaaagctaccattgatttgggaggtaccacaaaccaggtgctatgttaagtgcttccttgaattctcattttattctaagaaccttgtttatagaagagaaaactgaggtttggacggggtgagtaacttgcctgtggttacacagctagtaagtggtagagtcagtgtgactgactcccagcttggagttcttcccagaactgggttatagagtctttccggccgctctccgccacctgcctcatcccaagtaaagcacattgagacagctgcaaaacaaactgcttctagtgctcaggagtctgttttttattaaacaaaacaaaactgcctgaattaagcagaggctagattagaggtcatgtgctttccttcagtggtgaggttaggttctacattccaaaatcaaagaaggggtttcaggaatatcatcagttgctttgcagatggagataacttaaaataaaagatactgatcttttga

SEQ ID NO: 1235 - DNA, 1995 bp, Homo sapiens
gaaagagaacctgtaaacgctctcggaattatggcggcggtggatatccgagacaatctgctgggaatttcttgggttgacagctcttggatccctattttgaacagtggtagtgtcctggattacttttcagaaagaagtaatcctttttatgacagaacatgtaataatgaagtggtcaaaatgcagaggctaacattagaacacttgaatcagatggttggaatcgagtacatccttttgcatgctcaagagcccattcttttcatcattcggaagcaacagcggcagtcccctgcccaagttatcccactagctgattactatatcattgctggagtgatctatcaggcaccagacttgggatcagttataaactctagagtgcttactgcagtgcatggtattcagtcagcttttgatgaagctatgtcatactgtcgatatcatccttccaaagggtattggtggcacttcaaagatcatgaagagcaagataaagtcagacctaaagccaaaaggaaagaagaaccaagctctatttttcagagacaacgtgtggatgctttacttttagacctcagacaaaaatttccacccaaatttgtgcagctaaagcctggagaaaagcctgttccagtggatcaaacaaagaaagaggcagaacctataccagaaactgtaaaacctgaggagaaggagaccacaaagaatgtacaacagacagtgagtgctaaaggcccccctgaaaaacggatgagacttcagtgagtactggacaaaagagaagcctggaagactcctcatgctagttatcatacctcagtactgtggctcttgagctttgaagtactttattgtaaccttcttatttgtatggaatgcgcttattttttgaaaggatattaggccggatgtggtggctcacgcctgtaatcccagcactttgggaggccatggcgggtggatcacttgaggtcagaagttcaagaccagcctgaccaatatggtgaaaccccgtctctactaaaaatacaaaaattagccgggcgtggtggcgggcgcccatagtcccagctactcgggaggctgagacaggagacttgcttgaacccgggaggtggaggttgccctgagctgattatcatgctgttgcactccagcttgggcgacagagcgagactttgtctcaaaaaagaagaaaagatattattcccatcatgatttcttgtgaatatttgttatatgtcttctgtaacctttcctctcccggacttgagcaacctacacactcacatgtttactggtagatatgtttaaaagcaaaataaaggtatttgtatatattgcttcatcatgacttttttcttcatcataactgatatttttcagatgcactttgaagacataaaggatgttaaagtagtaactaagcatatttctttttgttcagttacataatcctcagtattaaaataaacagttgctgacattttggaagatgaagaaaaggaaaaacctcactcaccaataccattaccctataaatactgtaacagtgttgtgaattttaatcttattctgtgtgtagatacttcttttttcaataaagaaaaggaattttattttttttaaagttatggaggctgagaagtccagcattgattggctccatctggtgagggccttcttgctggtaggaagtctgcaaagtccctaggcagcacagggtatctcatggcaagggggctgagtgtgcttgctgcatgtagatgcttttaaaactgtactttaatcattcctttcgtacaattttactttattatatctgttgtaagcttttccccatgtttatgtagtttttatagactgttttagtgtccgaatttctgtaaatgattgtatctcagttttctttctgtcttatatttgggatttttcccagtttacattattttatataagactgctgtgattatatctttgtataatgcc

SEQ ID NO: 1236 - DNA, 1507 bp, Homo sapiens
gtaaacgctctcggaattatggcggcggtggatatccgagacaatctgctgggaatttcttgggttgacagctcttggatccctattttgaacagtggtagtgtcctggattacttttcagaaagaagtaatcctttttatgacagaacatgtaataatgaagtggtcaaaatgcagaggctaacattagaacacttgaatcagatggttggaatcgagtacatccttttgcatgctcaagagcccattcttttcatcattcggaagcaacagcggcagtcccctgcccaagttatcccactagctgattactatatcattgctggagtgatctatcaggcaccagacttgggatcagttataaactctagagtgagtttattttccttttacaagcttactgcagtgcatggtattcagtcagcttttgatgaagctatgtcatactgtcgatatcatccttccaaagggtattggtggcacttcaaagatcatgaagagcaagataaagtcagacctaaagccaaaaggaaagaagaaccaagctctatttttcagagacaacgtgtggatgctttacttttagacctcagacaaaaatttccacccaaatttgtgcagctaaagcctggagaaaagcctgttccagtggatcaaacaaagaaagaggcagaacctataccagaaactgtaaaacctgaggagaaggagaccacaaagaatgtacaacagacagtgagtgctaaaggcccccctgaaaaacggatgagacttcagtgagtactggacaaaagagaagcctggaagactcctcatgctagttatcatacctcagtactgtggctcttgagctttgaagtactttattgtaaccttcttatttgtatggaatgcgcttattttttgaaaggatattaggccggatgtggtggctcacgcctgtaatcccagcactttgggaggccatggcgggtggatcacttgaggtcagaagttcaagaccagcctgaccaatatggtgaaaccccgtctctactaaaaatacaaaaattagccgggcgtggtggcgggcgcccatagtcccagctactcgggaggctgagacaggagacttgcttgaacccgggaggtggaggttgccctgagctgattatcatgctgttgcactccagcttgggcgacagagcgagactttgtctcaaaaaagaagaaaagatattattcccatcatgatttcttgtgaatatttgttatatgtcttctgtaacctttcctctcccggacttgagcaacctacacactcacatgtttactggtagatatgtttaaaagcaaaataaaggtatttgtatatattgcttcatcatgacttttttcttcatcataactgatatttttcagatgcactttgaagacataaaggatgttaaagtagtaactaagcatatttctttttgttcagttacataatcctcagtattaaaataaacagttgctgacattttgg

SEQ ID NO: 1237 - DNA, 931 bp, Homo sapiens
gtaaacgctctcggaattatggcggcggtggatatccgagacaatctgctgggaatttcttgggttgacagctcttggatccctattttgaacagtggtagtgtcctggattacttttcagaaagaagtaatcctttttatgacagaacatgtaataatgaagtggtcaaaatgcagaggctaacattagaacacttgaatcagatggttggaatcgagtacatccttttgcatgctcaagagcccattcttttcatcattcggaagcaacagcggcagtcccctgcccaagttatcccactagctgattactatatcattgctggagtgatctatcaggcaccagacttgggatcagttataaactctagagtgcttactgcagtgcatggtattcagtcagcttttgatgaagctatgtcatactgtcgatatcatccttccaaagggtattggtggcacttcaaagatcatgaagagcaagctaaagcctggagaaaagcctgttccagtggatcaaacaaagaaagaggcagaacctataccagaaactgtaaaacctgaggagaaggagaccacaaagaatgtacaacagacagtgagtgctaaaggcccccctgaaaaacggatgagacttcagtgagtactggacaaaagagaagcctggaagactcctcatgctagttatcatacctcagtactgtggctcttgagctttgaagtactttattgtaaccttcttatttgtatggaatgcgcttattttttgaaaggatattaggccggatgtggtggctcacgcctgtaatcccagcactttgggaggccatggcgggtggatcacttgaggtcagaagttcaagaccagcctgaccaatatggtgaaaccccgtctctactaaaaatacaaaaattagccgggcgtggtggc

SEQ ID NO: 1238 - DNA, 975 bp, Homo sapiens
ggaattatggcggcggtggatatccgagacaatctgctgggaatttcttgggttgacagctcttggatccctattttgaacagtggtagtgtcctggattacttttcagaaagaagtaatcctttttatgacagaacatgtaataatgaagtggtcaaaatgcagaggctaacattagaacacttgaatcagatggttggaatcgagtacatccttttgcatgctcaagagcccattcttttcatcattcggaagcaacagcggcagtcccctgcccaagttatcccactagctgattactatatcattgctggagtgatctatcaggcaccagacttgggatcagttataaactctagagtgcttactgcagtgcatggtattcagtcagcttttgatgaagctatgtcatactgtcgatatcatccttccaaagggtattggtggcacttcaaagatcatgaagagcaagataaagtcagacctaaagccaaaaggaaagaagaaccaagctctatttttcagagacaacgtgtggatgctttacttttagacctcagacaaaaatttccacccaaatttgtgcagctaaagcctggagaaaagcctgttccagtggatcaaacaaagaaagaggcagaacctataccagaaactgtaaaacctgaggagaaggagaccacaaagaatgtacaacagacagtgagtgctaaaggcccccctgaaaaacggatgagacttcagaaagctgtgtgaagagacaaagggagaatgccatgtgaagatggaggatcggagtgatgcgtctacaagccaaggaatgccaaagatttccggccagtcaccagaagctaagaggcaaagaaggattcccctacaggtttcagagaaagcatagcccatatccctgctgacactttgattttggattttcagcctccagaattttgagacaataaatttattgtttaagtc

SEQ ID NO: 1239 - DNA, 1483 bp, Homo sapiens
ggaaaaccggaagtgaaatcgtggcagccgcctcggccgccgcaatgcagagagaggagaagcagcttgaggcatcattagatgcactgctgagtcaagtggctgatctgaagaactctctggggagtttcatttgcaagttggagaacgagtatggccggctgacctggccatctgtcctggacagctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggattacagcaggtgcagatggcaggagctccaagccagcagcagccaatgctcagtggggtacaaatggctcaggcaggtcaaccagggaaaatgccaagtggaataaaaaccaacatcaagtcggcttccatgcatccctaccagcggccctcctgcctgggtttcattctggctatccctctaaggcgcaaggtgaagaagcttctgggccaggaaggaaaaaaaaatgcccacctgcagctctggtgaagcttgggcctgctctcctttccatcctctaaggagccaacttggcttttacctgtcaaatagtcataaagtcccctatcctttaccccaccttatacacacgaggctttctcaggaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggagggggcaacccccagtagctttgcctgcttttataaagttgaacaaattgaatttagacattcaggctaacctgcctttcttagtactcctttgttggcatgggcaggggttgagtcagcagaagtggaccaaaggattcctctgaataaagttatttaaattga

SEQ ID NO: 1240 - DNA, 1924 bp, Homo sapiens
ggaaaaccggaagtgaaatcgtggcagccgcctcggccgccgcaatgcagagagaggagaagcagcttgaggcatcattagatgcactgctgagtcaagtggctgatctgaagaactctctggggagtttcatttgcaagttggagaacgagtatggccggctgacctggccatctgtcctggacagctttgccttgctttctggacagctgaacactctgaacaaggtcttgaagcatgaaaaaacaccgctgttccgtaaccaggtcatcattcctctggtgttgtctccagaccgagatgaagatctcatgcggcagactgaaggacgggtgcctgttttcagccatgaggtagtccctgaccatctgagaaccaagcctgaccctgaagtggaagaacaggagaagcaactgacgacagatgctgcccgcattggtgcagatgcagcccagaagcagatccagagcttgaataaaatgtgttcaaaccttctggagaaaatcagcaaagaggagcgagaatcagagagtggaggtctccggccgaacaagcagacctttaaccctacagacactaatgccttggtggcagctgttgcctttgggaaaggactatctaattggagaccttcaggcagcagtggtcctggccaggcaggccagccaggagctgggacgatccttgcaggaacctcaggattacagcaggtgcagatggcaggagctccaagccagcagcagccaatgctcagtggggtacaaatggctcaggcaggtcaaccagggaaaatgccaagtggaataaaaaccaacatcaagtcggcttccatgcatccctaccagcggtgagtgtggctggcaacctcgactccctggtgctctttgcagagttgggcagtgaaattaccttttgctcaaggctcacctagatgggtacaataaaaagaacatgggctttcagcagcagacaaatcccacttccaccactgactagctgtgtgaccttggacaagtgacctaatttttctgagcctgtttctcatttgtaaatggtgataatacctacctcatagggttgttgtgaggattaaaatgaggaaatgaatgtaaagcacttagtacagtatatgaaataatgggtattcaataaatgatagtttctacagatccttctccccaccaccctccacagtccttgatccagaacttaccctaatctgatactgcctcacgtcaatggtgagctgatggacacaagatcaaataaggctatgcttattttgtgctgccagaaactgtagcaacctctgtgttcttagaggcacactgtttttgcaggccctcctgcctgggtttcattctggctatccctctaaggcgcaaggtgaagaagcttctgggccaggaaggaaaaaaaaatgcccacctgcagctctggtgaagcttgggcctgctctcctttccatcctctaaggagccaacttggcttttacctgtcaaatagtcataaagtcccctatcctttaccccaccttatacacacgaggctttctcaggaagtggctctgccaggcaggactatgtgggaaagggtttttccttagcacacgaaaaagccccttcccctggattcatgtttcttattttggagggagaagggaattgcacttcacactgccatcagggtttagttgacctcataatggtgcccactttctcgactttggccaggatttccttcaaagaaaacgactttccttcatttccctaagcctgtggcccaaatggtggaccagaatgatggtgggagggggcaacccccagtagctttgcctgcttttataaagttgaacaaattgaatttagacattcaggctaacctgcctttcttagtactcctttgttggcatgggcaggggttg

SEQ ID NO: 1241 - DNA, 1579 bp, Homo sapiens
actcaacccgccccagagcacagcttcgccgagcccacctggtccccatcccggccttggcaatgaccctggcggcttcctcccagcgttcccaaatcattcgctccaagttccgatctgtcctccagcttcggatccacagacggaatcaggagcagatctcggatccggacccgtggatctcagcctcagaccctcctctggccccggccttgccctcgggcacggcccctttcctcttcagccctggggtcctgctccccgagccagaatattgtcctccttggaggtccccaaagaaggagtctcccaagatctcccaacgttggagggagtccaagcccagggggaacttgacataccaccagtacatgcccccagagccgagacagggatccagggcggacccccaagccgaggggtccgccctgggtcctcctgggccatctctgtgggaagggacagactcgcagcagccacatcctaggatgaagccctctcccctcactccctgcccaccaggagtccctagcccctcgccccccccacacaagttggaacttcagacccttaaactggaggagctgacggtctcagagctccggcagcagctgcgcctgcggggcctcccagtgtcggggaccaagtctatgctcctggagcgcatgcgcggcggcgcgccgccccgcgagcggccgaagccgcggcgcgaggacagtcccgcgggtgctccctggccgcgcctcaagcccaaggccctggcagccgcccggcgtcagggctcggtcaagcccagcgcagcatctcacaggccacctcttccacgtgccgcggataccccggggacggctccggctccaactcccactccggctcctgctgcagctccagccctgaccccttcctcagggccgggctcagcggctctgactctggaggaggagctgcaggaagcgatccggagggcgcagttgcttcctaaccggggcatcgatgacatcctggaggatcaggtggagcctgatgaccccctgccccctattcccctggacttccctggctccttcgacgtgctgtccccctccccggactctgaaggcctctcatctgttttctcctcttcactcccgtctcccacgaactcctcctccccttctcccagggaccccacggactccctggactggctggaggccctgagcgggggtcctcctctgggttctggtcccccaccccccagcatcttctccgctgacttatctgactccagcagcagccggctgtgggacctgctggaggatccatggtgatggattctaggatttacagagacagagaactgatgggggtggagagaagctccttgtgggaggagagggaactaccagcagagcccctcctaccgcagacacaggatcggagacaacctccaaccccacctgcctcctgaagtgctgctgacatgcaactgccttaactttgcctacctggcctccttatgatccccctccggcgtggtatggttggggggcttcttttgctgctggccacggcaaacaagctgcttgctgcttccttc

SEQ ID NO: 1242 - DNA, 1823 bp, Homo sapiens
gaatggcgctggcccgcggcgctgcgctggcagggagcaggcgggaggcccgaggaagggagcctgctgcccgcccacccgcctgcacaggctgtgtaagggggctgggcacgcatatcccgccaacaactgcagctcccaccagcctgccaggccaggctcctggacactcccttcccgccttcctcctcccacctccctcctccctccacagtcctccagcttcggatccacagacggaatcaggagcagaatccagttcaggcgcccatctcccagcaatcaagtcttgctccctggcctgccctccggcaccctggagccccgctttccacacagccttgctcctcccggcctggcttgctgcctgcaggcctctcagggtccttcaccgtctctccagtctcggatccggacccgtggatctcagcctcagaccctcctctggccccggccttgccctcgggcacggcccctttcctcttcagccctggggtcctgctccccgagccagaatattgtcctccttggaggtccccaaagaaggagtctcccaagatctcccaacgttggagggagtccaagcccagggggaacttgacataccaccagtacatgcccccagagccgagacagggatccagggcggacccccaagccgaggggtccgccctgggtcctcctgggccatctctgtgggaagggacagactcgcagcagccacatcctaggatgaagccctctcccctcactccctgcccaccaggagtccctagcccctcgccccccccacacaagttggaacttcagacccttaaactggaggagctgacggtctcagagctccggcagcagctgcgcctgcggggcctcccagtgtcggggaccaagtctatgctcctggagcgcatgcgcggcggcgcgccgccccgcgagcggccgaagccgcggcgcgaggacagtcccgcgggtgctccctggccgcgcctcaagcccaaggccctggcagccgcccggcgtcagggctcggtcaagcccagcgcagcatctcacaggccacctcttccacgtgccgcggataccccggggacggctccggctccaactcccactccggctcctgctgcagctccagccctgaccccttcctcagggccgggctcagcggctctgactctggaggaggagctgcaggaagcgatccggagggcgcagttgcttcctaaccggggcatcgatgacatcctggaggatcaggtggagcctgatgaccccctgccccctattcccctggacttccctggctccttcgacgtgctgtccccctccccggactctgaaggcctctcatctgttttctcctcttcactcccgtctcccacgaactcctcctccccttctcccagggaccccacggactccctggactggctggaggccctgagcgggggtcctcctctgggttctggtcccccaccccccagcatcttctccgctgacttatctgactccagcagcagccggctgtgggacctgctggaggatccatggtgatggattctaggatttacagagacagagaactgatgggggtggagagaagctccttgtgggaggagagggaactaccagcagagcccctcctaccgcagacacaggatcggagacaacctccaaccccacctgcctcctgaagtgctgctgacatgcaactgccttaactttgcctacctggcctccttatgatccccctccggcgtggtatggttggggggcttcttttgctgctggccacggcaaacaagctgcttgctgcttccttc

SEQ ID NO: 1243 - DNA, 1386 bp, Homo sapiens
agactcaacccgccccagagcacagcttcgccgagcccacctggtccccatcccggccttggcaatgaccctggcggcttcctcccagcgttcccaaatcattcgctccaagttccgatctgtcctccagcttcggatccacagacggaatcaggagcagatctcggatccggacccgtggatctcagcctcagaccctcctctggccccggccttgccctcgggcacggcccctttcctcttcagccctggggtcctgctccccgagccagaatattgtcctccttggaggtccccaaagaaggagtctcccaagatctcccaacgttggagggagtccaagcccagggggaacttgacataccaccagtacatgcccccagagccgagacagggatccagggcggacccccaagccgaggggtccgccctgggtcctcctgggccatctctgtgggaagggacagactcgcagcagccacatcctaggatgaagccctctcccctcactccctgcccaccaggagtccctagcccctcgccccccccacacaagttggaacttcagacccttaaactggaggagctgacggtcaagcccagcgcagcatctcacaggccacctcttccacgtgccgcggataccccggggacggctccggctccaactcccactccggctcctgctgcagctccagccctgaccccttcctcagggccgggctcagcggctctgactctggaggaggagctgcaggaagcgatccggagggcgcagttgcttcctaaccggggcatcgatgacatcctggaggatcaggtggagcctgatgaccccctgccccctattcccctggacttccctggctccttcgacgtgctgtccccctccccggactctgaaggcctctcatctgttttctcctcttcactcccgtctcccacgaactcctcctccccttctcccagggaccccacggactccctggactggctggaggccctgagcgggggtcctcctctgggttctggtcccccaccccccagcatcttctccgctgacttatctgactccagcagcagccggctgtgggacctgctggaggatccatggtgatggattctaggatttacagagacagagaactgatgggggtggagagaagctccttgtgggaggagagggaactaccagcagagcccctcctaccgcagacacaggatcggagacaacctccaaccccacctgcctcctgaagtgctgctgacatgcaactgccttaactttgcctacctggcctccttatgatccccctccggcgtggtatggttggggggcttcttttgctgctggccacggcaaacaagctgcttgctgcttccttc

SEQ ID NO: 1244 - DNA, 1581 bp, Homo sapiens
agactcaacccgccccagagcacagcttcgccgagcccacctggtccccatcccggccttggcaatgaccctggcggcttcctcccagcgttcccaaatcattcgctccaagttccgatctgtcctccagcttcggatccacagacggaatcaggagcagatctcggatccggacccgtggatctcagcctcagaccctcctctggccccggccttgccctcgggcacggcccctttcctcttcagccctggggtcctgctccccgagccagaatattgtcctccttggaggtccccaaagaaggagtctcccaagatctcccaacgttggagggagtccaagcccagggggaacttgacataccaccagtacatgcccccagagccgagacagggatccagggcggacccccaagccgaggggtccgccctgggtcctcctgggccatctctgtgggaagggacagactcgcagcagccacatcctaggatgaagccctctcccctcactccctgcccaccaggagtccctagcccctcgccccccccacacaagttggaacttcagacccttaaactggaggagctgacggtctcagagctccggcagcagctgcgcctgcggggcctcccagtgtcggggaccaagtctatgctcctggagcgcatgcgcggcggcgcgccgccccgcgagcggccgaagccgcggcgcgaggacagtcccgcgggtgctccctggccgcgcctcaagcccaaggccctggcagccgcccggcgtcagggctcggtcaagcccagcgcagcatctcacaggccacctcttccacgtgccgcggataccccggggacggctccggctccaactcccactccggctcctgctgcagctccagccctgaccccttcctcagggccgggctcagcggctctgactctggaggaggagctgcaggaagcgatccggagggcgcagttgcttcctaaccggggcatcgatgacatcctggaggatcaggtggagcctgatgaccccctgccccctattcccctggacttccctggctccttcgacgtgctgtccccctccccggactctgaaggcctctcatctgttttctcctcttcactcccgtctcccacgaactcctcctccccttctcccagggaccccacggactccctggactggctggaggccctgagcgggggtcctcctctgggttctggtcccccaccccccagcatcttctccgctgacttatctgactccagcagcagccggctgtgggacctgctggaggatccatggtgatggattctaggatttacagagacagagaactgatgggggtggagagaagctccttgtgggaggagagggaactaccagcagagcccctcctaccgcagacacaggatcggagacaacctccaaccccacctgcctcctgaagtgctgctgacatgcaactgccttaactttgcctacctggcctccttatgatccccctccggcgtggtatggttggggggcttcttttgctgctggccacggcaaacaagctgcttgctgcttccttc

SEQ ID NO: 1245 - DNA, 968 bp, Homo sapiens
agtcggcgccaaaatcaaacgcgtcctggcctgtcccgcccctctccccaagcgcgggcccggccagcggaagcccctgcgcccgcgccatgtcaaagaaaaaaggactgagtgcagaagaaaagagaactcgcatgatggaaatattttctgaaacaaaagatgtatttcaattaaaagacttggagaagattgctcccaaagagaaaggcattactgctatgtcagtaaaagaagtccttcaaagcttagttgatgatggtatggttgactgtgagaggatcggaacttctaattattattgggcttttccaagtaaagctcttcatgcaaggaaacataagttggaggttctggaatctcagttgtctgagggaagtcaaaagcatgcaagcctacagaaaagcattgagaaagctaaaattggccgatgtgaaacggaagagcgaaccaggctagcaaaagagctttcttcacttcgagaccaaagggaacagctaaaggcagaagtagaaaaatacaaagactgtgatccgcaagttgtggaagaaatacgccaagcaaataaagtagccaaagaagctgctaacagatggactgataacatattcgcaataaaatcttgggccaaaagaaaatttgggtttgaagaaaataaaattgatagaacttttggaattccagaagactttgactacatagactaaaatattccatggtggtgaaggatgtacaagcttgtgaatatgtaaattttaaactattatctaactaagtgtactgaattgtcgtttgcctgtaactgtgtttatcattttattaatgttaaataaagtgtaaaatgcagatgttcttcaccccttttggtagaacaaaagcaggatgataaccatatccccccagtgctcatcaaagtaggacaataaaaatccatccatctcagtccaggcagatttacaaatgatttt

SEQ ID NO: 1246 - DNA, 1101 bp, Homo sapiens
gagtttgcggtgagcagagatcgcgccactgcattccagcctggcgacagagcaagactccatctcaaataaataaataaataaatggatagggagagggccacacagagactctgacagattcagagagggagggcctgggctttgcttccctccccgacgccagtgaagcccctcccccacgccacaggagccccctcccccaacacagtctctctaatcagagctggccagttaacctctaattgctggaacaggcgggggctggcaggcatgtaattgccccaagcctgaggctcccttggtctccatcccccggaccccggtgggccagaccttggggttcagactgcggccggccaggcaggcagagtgactcttgctggtggctgcagcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctcccttctctaatttcttcttttttttaatgataaagtctt

SEQ ID NO: 1247 - DNA, 1758 bp, Homo sapiens
atgcgctcctggccgtgacccccgctgggggcgggggccggggtccatgcgcggagtccccacccggcccggcgcctgccgctgacggcggcgggggtgggggggcgcgcgcctggcctcctgcccaccccctggcgtcaacaccgcgggccgtcaggggctgcggccccgggctgcgccctcccccgcggccaggctctggagggacccaggagctgccgccggcctcagcccatggcccggaggtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctcccttctctaatttcttcttttttttaatgataaagtcttaaaaacacgga

SEQ ID NO: 1248 - DNA, 1715 bp, Homo sapiens
atgcgcggagtccccacccggcccggcgcctgccgctgacggcggcgggggtgggggggcgcgcgcctggcctcctgcccaccccctggcgtcaacaccgcgggccgtcaggggctgcggccccgggctgcgccctcccccgcggccaggctctggagggacccaggagctgccgccggcctcagcccatggcccggaggtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaaggtccacgacctgtgcgacaacttctgtcaccgctacatcacctgcctcaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctccc

SEQ ID NO: 1249 - DNA, 1828 bp, Homo sapiens
aggctctggagggacccaggagctgccgccggcctcagcccatggcccggaggtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaaggtccacgacctgtgcgacaacttctgtcaccgctacatcacctgcctcaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgagacgctcagaagcgccggttctcccagacgtctgcctgggcctgggctccccatcccccggaccccggtgggccagaccttggggttcagactgcggccggccaggcaggcagagtgactcttgctggtggctgcagcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagaggtgtgagggtctaagggctggggattgtgcaattctcaaacctccattagacctcaggactccaagagtgggcacttccagagtagtgggtcagcctgggtccctgtactgtgggttctctgaggcttgatgggaagatattcatccatctgtccgtccgtccatccatccatccatccatccatcctcctcctccatgtatccatccatctacccactcactcacccatccatatctttatccatccgttactcaattactcattcacccgcaatccatccatccaaacctagtccacccacctacccactcattacccatctgaccacacattcacccactcactccattcatctctccactcgccaacccactcatccatctacctccacactgaccaaccacccacacatctacccatttatctgtgcattcacccacctccctacccaggcttccacccacctacccatcaactcacccatccatccacccacacatcc

SEQ ID NO: 1250 - DNA, 1918 bp, Homo sapiens
ggggcgggggccggggtccatgcgcggagtccccacccggcccggcgcctgccgctgacggcggcgggggtgggggggcgcgcgcctggcctcctgcccaccccctggcgtcaacaccgcgggccgtcaggggctgcggccccgggctgcgccctcccccgcggccaggctctggagggacccaggagctgccgccggcctcagcccatggcccggaggtatgatgagctgccgcactacccaggcatcgtggatggccccgcagccctggctagcttcccagagacagtgcccgcagtaccagggccctatggcccgcaccggcctccccagcccctgcccccaggcttggacagcgacggcctgaagagggagaaggatgagatctatggacacccgctcttccccctcttggccctggtctttgagaaatgtgaactggctacatgctctccccgtgacggggccggagctgggctggggacaccccctggaggtgacgtctgctcctctgattccttcaacgaggacatcgctgcctttgccaagcaggttcgctctgagaggcccctcttctcctccaacccagaactggacaatctgatgatccaggccatccaggtgctgcggttccacctgctggagctggagaaggtccacgacctgtgcgacaacttctgtcaccgctacatcacctgcctcaagggaaagatgcccatcgacctggtcatcgaggatcgggacggcggctgcagggaggacttcgaggactacccagcctcctgccccagcctcccagaccagaataatatgtggattcgagaccatgaggatagtgggtctgtacatttggggaccccaggtccatccagtgggggcctggcctcccagagtggggacaactccagtgaccaaggagacgggctggacaccagcgtggcctctcccagttctggtggagaagatgaggacttggaccaggagcgacggcgaaacaagaagagggggatcttccccaaggtggccaccaacatcatgcgagcctggttgttccagcacctctcgagacgctcagaagcgccggttctcccagacgtctgcctgggcctgggctccccatcccccggaccccggtgggccagaccttggggttcagactgcggccggccaggcaggcagagtgactcttgctggtggctgcagcacccgtacccctcggaggagcagaagaaacagctggcgcaggacacggggctcaccatcctgcaagtcaacaactggttcattaacgcccggagacgcatcgtgcaacctatgatcgatcaatccaaccgcacagggcagggtgcagccttcagcccagagggccagcccatcgggggctataccgagacgcagccacacgtggccgtccggcctccgggatcagtggggatgagtttgaacttggaaggagaatggcattatctatagaggctgatgcaggagagacccagcctccggctgtgacccccagcctcacacctgcctctggttcccgcctggtcctccagcttcaggaccccacctccaaaggcccctctgctcaatgcctacctccctagggccctgctgggacatgggggcctgagtgcccatccaagggctctcaaggacaccggcaaggcctccaggccctgagccccacttctgccttcacctctgcctgggacccgagctgggctcctgggccttggtccccagaagatggcggctagggcctcgccgccaggacagagaagggacggggtggctgggcagtcagggaaggagggtcgcccggatccgacattttggagagattccttcactctcctgtcccccctacctcccttctctaatttcttcttttttttaatgataaagtcttaaaaacacg

SEQ ID NO: 1251 - DNA, 1918 bp, Homo sapiens; identical to SEQ ID NO: 1250

SEQ ID NO: 1252 - DNA, 4170 bp, Homo sapiens
gacacattggcgtgagacctgggagtacgttgtgccaaatcattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctctctagaggaaaaaattaaggtgaaaagcactgaagttgagatcctagagaagtctcaaattgaagccattgcttcctcgttagggaacgcgaatcccctgagctgaaggagaaggaaaaatggatccgctttcttaaacctttccagaatttgcccctagaaccactcctattcttgacgcccagaatggtcagtgcctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaggaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaagagtgccagtcttccgaagagtccatggggtctaattccatgcgttctatcctggaggaagacgaggaagacgaggagccaccaagagtccttttataccacgaaccacgttcgtttgaagtaggaatgctagtctggcataaacataaaaaataccccttctggccagcagtggtcaaaagcgtcaggcagagagataagaaagcaagtgtgctatacatcgaaggacacatgaacccgaaaatgaaaggtttcacagtgtctcttaaaagtttaaagcactttgattgtaaagagaaacagacgcttctgaatcaagccagggaggacttcaaccaggacatcggctggtgtgtctccctcatcaccgactacagggtccggttaggctgcgggtcttttgctggctctttcctggaatattacgcggctgatataagctatcctgtccgaaaatccatccagcaggacgtcttggggaccaagcttcctcaactgagcaaggggagccccgaggagcccgtggtggggtgccccctggggcagaggcagccctgccggaaaatgctccccgaccgctcgcgggccgcccgggaccgggccaaccagaagctggtggagtacattgtgaaggccaagggcgcggagagccacctgcgggccatcctaaagagcaggaagccatctcgctggctgcagaccttcctgagctccagccagtacgtgacctgtgtggagacctacctggaggatgaggggcagctggacctggtggtgaagtacctgcagggcgtctaccaggaggtgggggccaaggtgctccagcgcaccaacggcgaccggatccggttcattctggacgtgcttctgcccgaggccatcatctgtgcgatctctgcggtggacgaggtggactacaagacggctgaggagaagtacatcaaggggccttcgctgagctaccgggaaaaagaaatatttgacaaccagctccttgaagagcggaaccggcgccgtcggtgagggagcagccggctgtgctgtcagcggggcctggcggtggaagcgcctccagtgtgcatgagcgtgtctgaagatggggggctcagggggcacgtttgcgtttggacctgtctgtgcgttctcctgcgtggcagtcctgatttccatgcttctggagaatccatttcgttaacactgaaagccagttctcttttcctggcagtttttttcattttatttttggcattttttacaagataccgttcgggaaaggcttttgaaaggacggaagcgtattcactgtgcgccagtactcctggctgtgctgtggtttctcccgacgtgcacatcgatctcgtatgtgtggcatctgatattaaacgggaggttttaagaagcgtctgccgtgatcatggagcttcggaagcgggaatggttcttccgggtttgctgttttgtctgtttcccccttgtgtggtttccgcctgcgacagttccagaatttgctctcccactcagtgtgctctgcagctgtgaggaaacagccttcgttagaggcgggagcagagacgagccgctgctctgtgtcgtgtttgctgtggccgcagggagaggagcaggacacgcacctttccaggggcctctgtgtcccgcactgtgtgtgagtggaccgcagcgcgcagccacatgccctggctgccatgggccagaccgcctccacctcccccgcccgcctggcctgtcctgagtgcatttccctgcactgtgtcgtcactgcacagccagtcaccgcggtctcagtcatcggcgcggatggctatgctggggtcccagggtggccgcagcagtcagggtcactgtgggagccctggggtggagtgacaaaccgcattgtcctgtgcccgccatggcagaagcgcagcctttgtatggaggcccaaccgcgctcccgtctggagaagcggcttccggggtgtggctgccgggtcggctctggtccacagcacggtgccggggctgcaggttgttgagggctgtgactccgtggggctcagccaggctccagcagggtcagacgtgctgttaagagcaaagccacagacgatgacttgtccattctcagtggatgctccaggctgtgcctacacagcagtgctggtgacatgtccagggttccagggcccggtggcctgggagctgctttctccccactggctgggctgcatctggccctggctggaggccttgctttgaggggctgtgaccctcttcccccaggccctccccagccgacgacagccaccggagaggagatcggaacacgattgtctcagatgcagggcgctgtgcgggacgaagccgcaaggactctcgtatcgggcccttgggactcgggaggtgccagaggcggcggctgctctggacctcggtgttcactgacctttgtttcacttgcctctgctcgactccgagagcaggaaacccggccgtggcctggcagctccgcctcccatgcccgcacgctggggtctgtcttgtctggagcagtggggcacaccccggaggaggcgggggtcagggctgtcggccttggccccctgctggtcgctgtttcggggactcggggcggccagtaccaccgcctgaggcggggctcagcagcgttgcatgtacgggcctcgtactgcctcatggaaaatcctccggagccgccctccattgtgggttcctgagagtaggacacattgccatggttttgtgggaatcacgcgcccctgatggaacttttctgctgttgtgaagtacttttatccatttgcttctctgctgaccttgccaagttgttcgaggtggaattaaacacctcccagacctc

SEQ ID NO: 1253 - DNA, 4092 bp, Homo sapiens
cggcgggtgcggcggcggcggcccgcgctccgcaggacacattggcgtgagacctgggagtacgttgtgccaaatcattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctctctagaggaaaaaattaaggtgaaaagcactgaagttgagatcctagagaagtctcaaattgaagccattgcttcctcgttagcctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaggaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaagagtgccagtcttccgaagagtccatggggtctaattccatgcgttctatcctggaggaagacgaggaagacgaggagccaccaagagtccttttataccacgaaccacgttcgtttgaagtaggaatgctagtctggcataaacataaaaaataccccttctggccagcagtggtcaaaagcgtcaggcagagagataagaaagcaagtgtgctatacatcgaaggacacatgaacccgaaaatgaaaggtttcacagtgtctcttaaaagtttaaagcactttgattgtaaagagaaacagacgcttctgaatcaagccagggaggacttcaaccaggacatcggctggtgtgtctccctcatcaccgactacagggtccggttaggctgcgggtcttttgctggctctttcctggaatattacgcggctgatataagctatcctgtccgaaaatccatccagcaggacgtcttggggaccaagcttcctcaactgagcaaggggagccccgaggagcccgtggtggggtgccccctggggcagaggcagccctgccggaaaatgctccccgaccgctcgcgggccgcccgggaccgggccaaccagaagctggtggagtacattgtgaaggccaagggcgcggagagccacctgcgggccatcctaaagagcaggaagccatctcgctggctgcagaccttcctgagctccagccagtacgtgacctgtgtggagacctacctggaggatgaggggcagctggacctggtggtgaagtacctgcagggcgtctaccaggaggtgggggccaaggtgctccagcgcaccaacggcgaccggatccggttcattctggacgtgcttctgcccgaggccatcatctgtgcgatctctgcggtggacgaggtggactacaagacggctgaggagaagtacatcaaggggccttcgctgagctaccgggaaaaagaaatatttgacaaccagctccttgaagagcggaaccggcgccgtcggtgagggagcagccggctgtgctgtcagcggggcctggcggtggaagcgcctccagtgtgcatgagcgtgtctgaagatggggggctcagggggcacgtttgcgtttggacctgtctgtgcgttctcctgcgtggcagtcctgatttccatgcttctggagaatccatttcgttaacactgaaagccagttctcttttcctggcagtttttttcattttatttttggcattttttacaagataccgttcgggaaaggcttttgaaaggacggaagcgtattcactgtgcgccagtactcctggctgtgctgtggtttctcccgacgtgcacatcgatctcgtatgtgtggcatctgatattaaacgggaggttttaagaagcgtctgccgtgatcatggagcttcggaagcgggaatggttcttccgggtttgctgttttgtctgtttcccccttgtgtggtttccgcctgcgacagttccagaatttgctctcccactcagtgtgctctgcagctgtgaggaaacagccttcgttagaggcgggagcagagacgagccgctgctctgtgtcgtgtttgctgtggccgcagggagaggagcaggacacgcacctttccaggggcctctgtgtcccgcactgtgtgtgagtggaccgcagcgcgcagccacatgccctggctgccatgggccagaccgcctccacctcccccgcccgcctggcctgtcctgagtgcatttccctgcactgtgtcgtcactgcacagccagtcaccgcggtctcagtcatcggcgcggatggctatgctggggtcccagggtggccgcagcagtcagggtcactgtgggagccctggggtggagtgacaaaccgcattgtcctgtgcccgccatggcagaagcgcagcctttgtatggaggcccaaccgcgctcccgtctggagaagcggcttccggggtgtggctgccgggtcggctctggtccacagcacggtgccggggctgcaggttgttgagggctgtgactccgtggggctcagccaggctccagcagggtcagacgtgctgttaagagcaaagccacagacgatgacttgtccattctcagtggatgctccaggctgtgcctacacagcagtgctggtgacatgtccagggttccagggcccggtggcctgggagctgctttctccccactggctgggctgcatctggccctggctggaggccttgctttgaggggctgtgaccctcttcccccaggccctccccagccgacgacagccaccggagaggagatcggaacacgattgtctcagatgcagggcgctgtgcgggacgaagccgcaaggactctcgtatcgggcccttgggactcgggaggtgccagaggcggcggctgctctggacctcggtgttcactgacctttgtttcacttgcctctgctcgactccgagagcaggaaacccggccgtggcctggcagctccgcctcccatgcccgcacgctggggtctgtcttgtctggagcagtggggcacaccccggaggaggcgggggtcagggctgtcggccttggccccctgctggtcgctgtttcggggactcggggcggccagtaccaccgcctgaggcggggctcagcagcgttgcatgtacgggcctcgtactgcctcatggaaaatcctccggagccgccctccattgtgggttcctgagagtaggacacattgccatggttttgtgggaatcacgcgcccctgatggaacttttctgctgttgtgaagtacttttatccatttgcttctctgctgaccttgccaagttgttcgaggtggaattaaacacctcccagacctc

SEQ ID NO: 1254 - DNA, 1314 bp, Homo sapiens
ggcggtggcggaggcggacacattggcgtgagacctgggagtacgttgtgccaaatcattgccacttgccacatgagtgtaaatgatggcggatgctatgtcctctgccgatgggaaaagcgattatggcctgcgaaggttttggcccgaaccgcgacttcaacaaaaaataagagaagaaaggaatattttctagctgtgcaaatcctctctctagaggaaaaaattaaggtgaaaagcactgaagttgagatcctagagaagtctcaaattgaagccattgcttcctcgttagcctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaggaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaagagtgccagtcttccgaagagtccatggggtctaattccatgcgttctatcctggaggaagacgaggaagacgaggagccaccaagagtccttttataccacgaaccacgttcgtttgaagta

SEQ ID NO: 1255 - DNA, 2837 bp, Homo sapiens
cattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctctctagaggaaaaaattaaggtgaaaagcactgaagttgagatcctagagaagtctcaaattgaagccattgcttcctcgttagcctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaggaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaagagtgccagtcttccgaagagtccatggggtctaattccatgcgttctatcctggaggaagacgaggaagacgaggagccaccaagagtccttttataccacgaaccacgttcgtttgaagtaggaatgctagtctggcataaacataaaaaataccccttctggccagcagtggtcaaaagcgtcaggcagagagataagaaagcaagtgtgctatacatcgaaggacacatgaacccgaaaatgaaaggtttcacagtgtctcttaaaagtttaaagcactttgattgtaaagagaaacagacgcttctgaatcaagccagggaggacttcaaccaggacatcggctggtgtgtctccctcatcaccgactacagggtccggttaggctgcgggtcttttgctggctctttcctggaatattacgcggctgatataagctatcctgtccgaaaatccatccagcaggacgtcttggggaccaagcttcctcaactgagcaaggggagccccgaggagcccgtggtggggtgccccctggggcagaggcagccctgccggaaaatgctccccgaccgctcgcgggccgcccgggaccgggccaaccagaagctggtggagtacattgtgaaggccaagggcgcggagagccacctgcgggccatcctaaagagcaggaagccatctcgctggctgcagaccttcctgagctccagccagtacgtgacctgtgtggagacctacctggaggatgaggggcagctggacctggtggtgaagtacctgcagggcgtctaccaggaggtgggggccaaggtgctccagcgcaccaacggcgaccggatccggttcattctggacgtgcttctgcccgagtgctgggaaatgcgagtgcgtgcgcttgaccctgtgcggagacggagccgcttacttgacccctgtgcagagatggagctgcttagaagctgtcagcaccagggggtgcgaactccctccctactgcgggcgcacagatgcttcccagcctcggtgggccatcatctgtgcgatctctgcggtggacgaggtggactacaagacggctgaggagaagtacatcaaggggccttcgctgagctaccgggaaaaagaaatatttgacaaccagctccttgaagagcggaaccggcgccgtcggtgagggagcagccggctgtgctgtcagcggggcctggcggtggaagcgcctccagtgtgcatgagcgtgtctgaagatggggggctcagggggcacgtttgcgtttggacctgtctgtgcgttctcctgcgtggcagtcctgatttccatgcttctggagaatccatttcgttaacactgaaagccagttctcttttcctggcagtttttttcattttatttttggcattttttacaagataccgttcgggaaaggcttttgaaaggacggaagcgtattcactgtgcgccagtactcctggctgtgctgtggtttctcccgacgtgcacatcgatctcgtatgtgtggcatctgatattaaacgggaggttttaagaagcgtctgccgtgatcatggagcttcggaagcgggaatggttcttccgggtttgctgttttgtctgtttcccccttgtgtggtttccgcctgcgacagttccagaatttgctctcccactcagtgtgctctgcagctgtgagg

SEQ ID NO: 1256 - DNA, 498 bp, Homo sapiens
gtccttgcagcctcacagaatgaggttcctgcgcacccctggaagaactggcctacagacggtcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaggaaactcagcgcagaaggctagcttgtgcctgaatggatcttccctttcagag

SEQ ID NO: 1257 - DNA, 4818 bp, Homo sapiens
gcggctcctgcgcgttcccgccgaggcagtggcggcgggagcggcagagacggcagcggccggagtcccgttgctgagtctcacatccgggttctggccgtgacccagctgcggccgccgcggagatgtgacccggcagtacggcaaatatggcggagccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggtgaaatattaaacaaagaggaagtaaaagttgaagggttacacattaatggaccaacaggtggaaataagaaaccacttcatgcagatatggatactaatggttatgaaacagataaccttaccactgacccaaaacttgcccatatgactgcaagaaatgaaaatgattttgatgaaaaaagtgagagacctgccaaaaggcgaagggtaaacagcaatggaaaagaaagtccaggttcttctgaatttttccaagaagcagtctcacatgggaaatttgaagaacttgaaaacacagatgactaaattttagacctattttactttctttggagtaaattctggtgtgactaaaattttcagggttgatgggttaccttaaaaagttgatttccttgaagcagtttgaaaatttgaattgagtcttaactttaggaaatgaggtttcataattctgccttttgcagatttttttactttaaagctgtcagactcttttaagggtattttaaaaattagtaaatttgaatgaactaaagatatatctctaccttctcatttgaatatctttagttcattcagatttactaattttggtaaatctgaatgaactaaagatgtatctgtaccttctcatttgatgtattaatcataaaatttcactacaaggtaatttttgcttagtttgatggatgaatgggaaactcaagtccaaatttctgcttaataccaatttctctgagtttcttgaaatgtctttaaaacagacatttttctcaccaaacagtttgagtatctttattaaggaaacccttacgaatcctgaaaattatgctagcatgatttttttatatatagaagtttaaaaataaaccaggtcaggtttgtatatgtaaaattgttgacatcaatgatgtctttccatattcttatctgggcttaagaaatacattctgtatttttccagattctttgtagcctttgaaagatttttacagtacatatgtcttgactgagctgtcctttcttaatacaaaagcgtgtataattttcttaacttgtacagttggtaaacttttatgagaggaattgttattctgagtctgtcagctttcattttattttgctaaggtttttctaatgaatttttaagtgtttgtgtagtaattaagtcatatttcttatccaggtggttaaagcattcataaaggattataaaatttttttttttttttttttttttaaatttctacttaagggcaagtaatttgagaattctgaaattaagcatgatgcttagattgcagtttgttttgcatttgctataattttcaaaattatttttgaagcaagacaaaagtttaatgtcagcttaagtgcttaaatatatcatgctgaccagaatcctgttatttttatatgcatcataaaatttcccatttctgcattaaataaacagaggaggggggtcaagtgatacttagatattggcacacacaaggaacaactgttggcaggcagtatcgattttatgaagagaaagtgaagtttgaaaacttttcaaacttttctagttacaatccaatttttcagatttgataatgcttttccaaagtgaaaataagatacacaataatcattgctctgtgtgattacagataggattatccatctgcatagccttgtaaaagtgccattttatttttagtgctaaattcttgttaaataatgtagttttatatagctgatagaccaacctatatccaaacttttataaaatattaattattcttgtttttctcacacaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcatcttaatgtacattcactgttgttacatacatatctaagtaaatcaaagttttgggtggaagtgttgagaagtatgagttttttgttgtttttgttttacttaaaacttttaatttatccagaatggcagtagctttagcaagcagatggtcacaatctgttttctaaatcattttttattaaatgaatccaaagtatcctagctctttgtcaaagatggtctgtagaaatgtttttaaagattagggatgctgtactttttgaattgttgcagtgttggagatgccattttcacctttttaaaaagatgcattttatttgcaggtttgtgaagttcttgcaaactcttactacagaaatgttttaaatacattctcaggcatgtttgcaaaaatatggcacatgtatacattttaggaaatgttacttttgttaatctttaaaaaatacacctaatgaaagacattccactattatgcgtaatgctcagctttttgtaaagaaatatttaattgtattttgtgtttatacaggtatttcacacaataatttgttcttaatgcagccactataacttgataagtcattgcactatttaaaaagttttagtaatatcatgaatttaatttgcttaagatttagtacatttcagaacttttgaacttttgacaaattgcattggaaaaagaagtctgttaatagtgatttagtctccccgcctcattcccacccccaacaaagcactatcattttcatttggaatgggtattttctgtttcatgatgtattttcaaatagagttcaggatctgcaattcagttcaacacaagtttgttgagctttaaaatgtatttgaagtaatatttaaataggcatttaaaatttcaaattagatgttaaatttatgcatagtaattttgcactgtaaaataattcccttctcccattccttgtctgccattctgaatatgcttattaaaatatttttttaaacatatttgcctacataatactgtgtgaatattttcattagattaattcactaagattttattagagattgtttgaatgatgcatgttattgacaaggcaaatatatatatatacacagtctgtttcttctattcctagacatattgcactactttttcagtggttcttggtcccctttaccacatcttgggtgatgtatttttgtcttcttcccctttgccacaagagatcctttcagtccctagacctccattcactctgtttctcttctgctggattatataatttaaaaataatgtgttcccgtattttgtagtggagttcatatcacattatgttttgcaaaataaaacttgttttgtcacaat

SEQ ID NO: 1258 - DNA, 3595 bp, Homo sapiens
aggagggcggaggcggaggggagggcagagggttggtggagctggaggaagctccggacgacgactggaagaaggaggcgggcggcccgggcctcaggcccctcccaggctctgagtctcccggctgcaggcggatggatggggcttcttcaggcggtggcggcagcagcgaaggtggcggcggcagcagcggcagcggctatggtgtggtcgctcgattctcccagtgcctggctgagtttcggacgtggttaagaaccaactggttgaggttcaatgcagacaagacggatgtgatgctgccatctgttgaatcttcaagtccaggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcatcttaatgtacattcactgttgttacatacatatctaagtaaatcaaagttttgggtggaagtgttgagaagtatgagttttttgttgtttttgttttacttaaaacttttaatttatccagaatggcagtagctttagcaagcagatggtcacaatctgttttctaaatcattttttattaaatgaatccaaagtatcctagctctttgtcaaagatggtctgtagaaatgtttttaaagattagggatgctgtactttttgaattgttgcagtgttggagatgccattttcacctttttaaaaagatgcattttatttgcaggtttgtgaagttcttgcaaactcttactacagaaatgttttaaatacattctcaggcatgtttgcaaaaatatggcacatgtatacattttaggaaatgttacttttgttaatctttaaaaaatacacctaatgaaagacattccactattatgcgtaatgctcagctttttgtaaagaaatatttaattgtattttgtgtttatacaggtatttcacacaataatttgttcttaatgcagccactataacttgataagtcattgcactatttaaaaagttttagtaatatcatgaatttaatttgcttaagatttagtacatttcagaacttttgaacttttgacaaattgcattggaaaaagaagtctgttaatagtgatttagtctccccgcctcattcccacccccaacaaagcactatcattttcatttggaatgggtattttctgtttcatgatgtattttcaaatagagttcaggatctgcaattcagttcaacacaagtttgttgagctttaaaatgtatttgaagtaatatttaaataggcatttaaaatttcaaattagatgttaaatttatgcatagtaattttgcactgtaaaataattcccttctcccattccttgtctgccattctgaatatgcttattaaaatatttttttaaacatatttgcctacataatactgtgtgaatattttcattagattaattcactaagattttattagagattgtttgaatgatgcatgttattgacaaggcaaatatatatatatacacagtctgtttcttctattcctagacatattgcactactttttcagtggttcttggtcccctttaccacatcttgggtgatgtatttttgtcttcttcccctttgccacaagagatcctttcagtccctagacctccattcactctgtttctcttctgctggattatataatttaaaaataatgtgttcccgtattttgtagtggagttcatatcacattatgttttgcaaaataaaacttgttttgtcacaatattttctttgctatcgatggataattaggagtgggcacttggaataactgagggctggtgaatataataggcaatatttacatggggtgtgtaactaaataccaaatcagatagtaaggttttcccaactataatccatattcatgaaaaatgccagtgtggaaaaccatgtaacatacagaagaacaggagtttccaaattttaaccttttattctaaaaatgactctcttctctcaaaatgactttttctgtatcacataattctactgatacaactttttaccgtaaaaattaactctcttctttaatatcaagttcatcctttgcagaatcttaaagggttttccacacatccatccacccacttacagactgatttcatgtatctgaatatctgattaacctttcttttctaataccagttttccataaactcttgtcatgtacccttagtattgtgctgatcttttgccaactatacggacgtggagtttttccttttcagaatatgattattttcaatttgtctttagttagtataaagaattatagaatgtataatgtaattaaaatgtcattttgcttgc

SEQ ID NO: 1259 - DNA, 4978 bp, Homo sapiens
gactggaagaaggaggcgggcggcccgggcctcaggcccctcccaggctctgagtctcccggctgcaggcggatggatggggcttcttcaggcggtggcggcagcagcgaaggtggcggcggcagcagcggcagcggctatggtgtggtcgctcgattctcccagtgcctggctgagtttcggacgtggttaagaaccaactggttgaggttcaatgcagacaagacggatgtgatgctgtagaaaatgtgcatcagatgtttatgtttaattggtttacagactgtctgtggactcttttcctgtcaaattaccagccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggtgaaatattaaacaaagaggaagtaaaagttgaagggttacacattaatggaccaacaggtggaaataagaaaccacttcatgcagatatggatactaatggttatgaaacagataaccttaccactgacccaaaacttgcccatatgactgcaagaaatgaaaatgattttgatgaaaaaagtgagagacctgccaaaaggcgaagggtaaacagcaatggaaaagaaagtccaggttcttctgaatttttccaagaagcagtctcacatgggaaatttgaagaacttgaaaacacagatgactaaattttagacctattttactttctttggagtaaattctggtgtgactaaaattttcagggttgatgggttaccttaaaaagttgatttccttgaagcagtttgaaaatttgaattgagtcttaactttaggaaatgaggtttcataattctgccttttgcagatttttttactttaaagctgtcagactcttttaagggtattttaaaaattagtaaatttgaatgaactaaagatatatctctaccttctcatttgaatatctttagttcattcagatttactaattttggtaaatctgaatgaactaaagatgtatctgtaccttctcatttgatgtattaatcataaaatttcactacaaggtaatttttgcttagtttgatggatgaatgggaaactcaagtccaaatttctgcttaataccaatttctctgagtttcttgaaatgtctttaaaacagacatttttctcaccaaacagtttgagtatctttattaaggaaacccttacgaatcctgaaaattatgctagcatgatttttttatatatagaagtttaaaaataaaccaggtcaggtttgtatatgtaaaattgttgacatcaatgatgtctttccatattcttatctgggcttaagaaatacattctgtatttttccagattctttgtagcctttgaaagatttttacagtacatatgtcttgactgagctgtcctttcttaatacaaaagcgtgtataattttcttaacttgtacagttggtaaacttttatgagaggaattgttattctgagtctgtcagctttcattttattttgctaaggtttttctaatgaatttttaagtgtttgtgtagtaattaagtcatatttcttatccaggtggttaaagcattcataaaggattataaaatttttttttttttttttttttttaaatttctacttaagggcaagtaatttgagaattctgaaattaagcatgatgcttagattgcagtttgttttgcatttgctataattttcaaaattatttttgaagcaagacaaaagtttaatgtcagcttaagtgcttaaatatatcatgctgaccagaatcctgttatttttatatgcatcataaaatttcccatttctgcattaaataaacagaggaggggggtcaagtgatacttagatattggcacacacaaggaacaactgttggcaggcagtatcgattttatgaagagaaagtgaagtttgaaaacttttcaaacttttctagttacaatccaatttttcagatttgataatgcttttccaaagtgaaaataagatacacaataatcattgctctgtgtgattacagataggattatccatctgcatagccttgtaaaagtgccattttatttttagtgctaaattcttgttaaataatgtagttttatatagctgatagaccaacctatatccaaacttttataaaatattaattattcttgtttttctcacacaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcatcttaatgtacattcactgttgttacatacatatctaagtaaatcaaagttttgggtggaagtgttgagaagtatgagttttttgttgtttttgttttacttaaaacttttaatttatccagaatggcagtagctttagcaagcagatggtcacaatctgttttctaaatcattttttattaaatgaatccaaagtatcctagctctttgtcaaagatggtctgtagaaatgtttttaaagattagggatgctgtactttttgaattgttgcagtgttggagatgccattttcacctttttaaaaagatgcattttatttgcaggtttgtgaagttcttgcaaactcttactacagaaatgttttaaatacattctcaggcatgtttgcaaaaatatggcacatgtatacattttaggaaatgttacttttgttaatctttaaaaaatacacctaatgaaagacattccactattatgcgtaatgctcagctttttgtaaagaaatatttaattgtattttgtgtttatacaggtatttcacacaataatttgttcttaatgcagccactataacttgataagtcattgcactatttaaaaagttttagtaatatcatgaatttaatttgcttaagatttagtacatttcagaacttttgaacttttgacaaattgcattggaaaaagaagtctgttaatagtgatttagtctccccgcctcattcccacccccaacaaagcactatcattttcatttggaatgggtattttctgtttcatgatgtattttcaaatagagttcaggatctgcaattcagttcaacacaagtttgttgagctttaaaatgtatttgaagtaatatttaaataggcatttaaaatttcaaattagatgttaaatttatgcatagtaattttgcactgtaaaataattcccttctcccattccttgtctgccattctgaatatgcttattaaaatatttttttaaacatatttgcctacataatactgtgtgaatattttcattagattaattcactaagattttattagagattgtttgaatgatgcatgttattgacaaggcaaatatatatatatacacagtctgtttcttctattcctagacatattgcactactttttcagtggttcttggtcccctttaccacatcttgggtgatgtatttttgtcttcttcccctttgccacaagagatcctttcagtccctagacctccattcactctgtttctcttctgctggattatataatttaaaaataatgtgttcccgtattttgtagtggagttcatatcacattatgttttgcaaaataaaacttgttttgtcacaata

SEQ ID NO: 1260 - DNA, 1728 bp, Homo sapiens
ctggaagaaggaggcgggcggcccgggcctcaggcccctcccaggctctgagtctcccggctgcaggcggatggatggggcttcttcaggcggtggcggcagcagcgaaggtggcggcggcagcagcggcagcggctatggtgtggtcgctcgattctcccagtgcctggctgagtttcggacgtggttaagaaccaactggttgaggttcaatgcagacaagacggatgtgatgctgccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcat

SEQ ID NO: 1261 - DNA, 1802 bp, Homo sapiens
ctggaagaaggaggcgggcggcccgggcctcaggcccctcccaggctctgagtctcccggctgcaggcggatggatggggcttcttcaggcggtggcggcagcagcgaaggtggcggcggcagcagcggcagcggctatggtgtggtcgctcgattctcccagtgcctggctgagtttcggacgtggttaagaaccaactggttgaggttcaatgcagacaagacggatgtgatgctgaaaatgtgcatcagatgtttatgtttaattggtttacagactgtctgtggactcttttcctgtcaaattaccagccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcat

SEQ ID NO: 1262 - DNA, 5626 bp, Homo sapiens
aggagggcggaggcggaggggagggcagagggttggtggagctggaggaagctccggacgacgactggaagaaggaggcgggcggcccgggcctcaggcccctcccaggctctgagtctcccggctgcaggcggatggatggggcttcttcaggcggtggcggcagcagcgaaggtggcggcggcagcagcggcagcggctatggtgtggtcgctcgattctcccagtgcctggctgagtttcggacgtggttaagaaccaactggttgaggttcaatgcagacaagacggatgtgatgctgaaaatgtgcatcagatgtttatgtttaattggtttacagactgtctgtggactcttttcctgtcaaattaccaggccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggtgaaatattaaacaaagaggaagtaaaagttgaagggttacacattaatggaccaacaggtggaaataagaaaccacttcatgcagatatggatactaatggttatgaaacagataaccttaccactgacccaaaacttgcccatatgactgcaagaaatgaaaatgattttgatgaaaaaagtgagagacctgccaaaaggcgaagggtaaacagcaatggaaaagaaagtccaggttcttctgaatttttccaagaagcagtctcacatgggaaatttgaagaacttgaaaacacagatgactaaattttagacctattttactttctttggagtaaattctggtgtgactaaaattttcagggttgatgggttaccttaaaaagttgatttccttgaagcagtttgaaaatttgaattgagtcttaactttaggaaatgaggtttcataattctgccttttgcagatttttttactttaaagctgtcagactcttttaagggtattttaaaaattagtaaatttgaatgaactaaagatatatctctaccttctcatttgaatatctttagttcattcagatttactaattttggtaaatctgaatgaactaaagatgtatctgtaccttctcatttgatgtattaatcataaaatttcactacaaggtaatttttgcttagtttgatggatgaatgggaaactcaagtccaaatttctgcttaataccaatttctctgagtttcttgaaatgtctttaaaacagacatttttctcaccaaacagtttgagtatctttattaaggaaacccttacgaatcctgaaaattatgctagcatgatttttttatatatagaagtttaaaaataaaccaggtcaggtttgtatatgtaaaattgttgacatcaatgatgtctttccatattcttatctgggcttaagaaatacattctgtatttttccagattctttgtagcctttgaaagatttttacagtacatatgtcttgactgagctgtcctttcttaatacaaaagcgtgtataattttcttaacttgtacagttggtaaacttttatgagaggaattgttattctgagtctgtcagctttcattttattttgctaaggtttttctaatgaatttttaagtgtttgtgtagtaattaagtcatatttcttatccaggtggttaaagcattcataaaggattataaaatttttttttttttttttttttttaaatttctacttaagggcaagtaatttgagaattctgaaattaagcatgatgcttagattgcagtttgttttgcatttgctataattttcaaaattatttttgaagcaagacaaaagtttaatgtcagcttaagtgcttaaatatatcatgctgaccagaatcctgttatttttatatgcatcataaaatttcccatttctgcattaaataaacagaggaggggggtcaagtgatacttagatattggcacacacaaggaacaactgttggcaggcagtatcgattttatgaagagaaagtgaagtttgaaaacttttcaaacttttctagttacaatccaatttttcagatttgataatgcttttccaaagtgaaaataagatacacaataatcattgctctgtgtgattacagataggattatccatctgcatagccttgtaaaagtgccattttatttttagtgctaaattcttgttaaataatgtagttttatatagctgatagaccaacctatatccaaacttttataaaatattaattattcttgtttttctcacacaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcatcttaatgtacattcactgttgttacatacatatctaagtaaatcaaagttttgggtggaagtgttgagaagtatgagttttttgttgtttttgttttacttaaaacttttaatttatccagaatggcagtagctttagcaagcagatggtcacaatctgttttctaaatcattttttattaaatgaatccaaagtatcctagctctttgtcaaagatggtctgtagaaatgtttttaaagattagggatgctgtactttttgaattgttgcagtgttggagatgccattttcacctttttaaaaagatgcattttatttgcaggtttgtgaagttcttgcaaactcttactacagaaatgttttaaatacattctcaggcatgtttgcaaaaatatggcacatgtatacattttaggaaatgttacttttgttaatctttaaaaaatacacctaatgaaagacattccactattatgcgtaatgctcagctttttgtaaagaaatatttaattgtattttgtgtttatacaggtatttcacacaataatttgttcttaatgcagccactataacttgataagtcattgcactatttaaaaagttttagtaatatcatgaatttaatttgcttaagatttagtacatttcagaacttttgaacttttgacaaattgcattggaaaaagaagtctgttaatagtgatttagtctccccgcctcattcccacccccaacaaagcactatcattttcatttggaatgggtattttctgtttcatgatgtattttcaaatagagttcaggatctgcaattcagttcaacacaagtttgttgagctttaaaatgtatttgaagtaatatttaaataggcatttaaaatttcaaattagatgttaaatttatgcatagtaattttgcactgtaaaataattcccttctcccattccttgtctgccattctgaatatgcttattaaaatatttttttaaacatatttgcctacataatactgtgtgaatattttcattagattaattcactaagattttattagagattgtttgaatgatgcatgttattgacaaggcaaatatatatatatacacagtctgtttcttctattcctagacatattgcactactttttcagtggttcttggtcccctttaccacatcttgggtgatgtatttttgtcttcttcccctttgccacaagagatcctttcagtccctagacctccattcactctgtttctcttctgctggattatataatttaaaaataatgtgttcccgtattttgtagtggagttcatatcacattatgttttgcaaaataaaacttgttttgtcacaatattttctttgctatcgatggataattaggagtgggcacttggaataactgagggctggtgaatataataggcaatatttacatggggtgtgtaactaaataccaaatcagatagtaaggttttcccaactataatccatattcatgaaaaatgccagtgtggaaaaccatgtaacatacagaagaacaggagtttccaaattttaaccttttattctaaaaatgactctcttctctcaaaatgactttttctgtatcacataattctactgatacaactttttaccgtaaaaattaactctcttctttaatatcaagttcatcctttgcagaatcttaaagggttttccacacatccatccacccacttacagactgatttcatgtatctgaatatctgattaacctttcttttctaataccagttttccataaactcttgtcatgtacccttagtattgtgctgatcttttgccaactatacggacgtggagtttttccttttcagaatatgattattttcaatttgtctttagttagtataaagaattatagaatgtataatgtaattaaaatgtcattttgcttgc

SEQ ID NO: 1263 - DNA, 3875 bp, Homo sapiens
aggagggcggaggcggaggggagggcagagggttggtggagctggaggaagctccggacgacgactggaagaaggaggcgggcggcccgggcctcaggcccctcccaggctctgagtctcccggctgcaggcggatggatggggcttcttcaggcggtggcggcagcagcgaaggtggcggcggcagcagcggcagcggctatggtgtggtcgctcgattctcccagtgcctggctgagtttcggacgtggttaagaaccaactggttgaggttcaatgcagacaagacggatgtgatgctgaaaatgtgcatcagatgtttatgtttaattggtttacagactgtctgtggactcttttcctgtcaaattaccagccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggtgaaatattaaacaaagaggaagtaaaagttgaagggttacacattaatggaccaacaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcatcttaatgtacattcactgttgttacatacatatctaagtaaatcaaagttttgggtggaagtgttgagaagtatgagttttttgttgtttttgttttacttaaaacttttaatttatccagaatggcagtagctttagcaagcagatggtcacaatctgttttctaaatcattttttattaaatgaatccaaagtatcctagctctttgtcaaagatggtctgtagaaatgtttttaaagattagggatgctgtactttttgaattgttgcagtgttggagatgccattttcacctttttaaaaagatgcattttatttgcaggtttgtgaagttcttgcaaactcttactacagaaatgttttaaatacattctcaggcatgtttgcaaaaatatggcacatgtatacattttaggaaatgttacttttgttaatctttaaaaaatacacctaatgaaagacattccactattatgcgtaatgctcagctttttgtaaagaaatatttaattgtattttgtgtttatacaggtatttcacacaataatttgttcttaatgcagccactataacttgataagtcattgcactatttaaaaagttttagtaatatcatgaatttaatttgcttaagatttagtacatttcagaacttttgaacttttgacaaattgcattggaaaaagaagtctgttaatagtgatttagtctccccgcctcattcccacccccaacaaagcactatcattttcatttggaatgggtattttctgtttcatgatgtattttcaaatagagttcaggatctgcaattcagttcaacacaagtttgttgagctttaaaatgtatttgaagtaatatttaaataggcatttaaaatttcaaattagatgttaaatttatgcatagtaattttgcactgtaaaataattcccttctcccattccttgtctgccattctgaatatgcttattaaaatatttttttaaacatatttgcctacataatactgtgtgaatattttcattagattaattcactaagattttattagagattgtttgaatgatgcatgttattgacaaggcaaatatatatatatacacagtctgtttcttctattcctagacatattgcactactttttcagtggttcttggtcccctttaccacatcttgggtgatgtatttttgtcttcttcccctttgccacaagagatcctttcagtccctagacctccattcactctgtttctcttctgctggattatataatttaaaaataatgtgttcccgtattttgtagtggagttcatatcacattatgttttgcaaaataaaacttgttttgtcacaatattttctttgctatcgatggataattaggagtgggcacttggaataactgagggctggtgaatataataggcaatatttacatggggtgtgtaactaaataccaaatcagatagtaaggttttcccaactataatccatattcatgaaaaatgccagtgtggaaaaccatgtaacatacagaagaacaggagtttccaaattttaaccttttattctaaaaatgactctcttctctcaaaatgactttttctgtatcacataattctactgatacaactttttaccgtaaaaattaactctcttctttaatatcaagttcatcctttgcagaatcttaaagggttttccacacatccatccacccacttacagactgatttcatgtatctgaatatctgattaacctttcttttctaataccagttttccataaactcttgtcatgtacccttagtattgtgctgatcttttgccaactatacggacgtggagtttttccttttcagaatatgattattttcaatttgtctttagttagtataaagaattatagaatgtataatgtaattaaaatgtcattttgcttgc

SEQ ID NO: 1264 - DNA, 2552 bp, Homo sapiens
ctggaagaaggaggcgggcggcccgggcctcaggcccctcccaggctctgagtctcccggctgcaggcggatggatggggcttcttcaggcggtggcggcagcagcgaaggtggcggcggcagcagcggcagcggctatggtgtggtcgctcgattctcccagtgcctggctgagtttcggacgtggttaagaaccaactggttgaggttcaatgcagacaagacggatgtgatgctgccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggtgaaatattaaacaaagaggaagtaaaagttgaagggttacacattaatggaccaacaggtggaaataagaaaccacttcatgcagatatggatactaatggttatgaaacagataaccttaccactgacccaaaacttgcccatatgactgcaagaaatgaaaatgattttgatgaaaaaagtgagagacctgccaaaaggcgaagggtaaacagcaatggaaaagaaagtccaggttcttctgaatttttccaagaagcagtctcacatgggaaatttgaagaacttgaaaacacagatgactaaattttagacctattttactttctttggagtaaattctggtgtgactaaaattttcagggttgatgggttaccttaaaaagttgatttccttgaagcagtttgaaaatttgaattgagtcttaactttaggaaatgaggtttcataattctgccttttgcagatttttttactttaaagctgtcagactcttttaagggtattttaaaaattagtaaatttgaatgaactaaagatatatctctaccttctcatttgaatatctttagttcattcagatttactaattttggtaaatctgaatgaactaaagatgtatctgtaccttctcatttgatgtattaatcataaaatttcactacaaggtaatttttgcttagtttgatggatgaatgggaaactcaagtccaaatttctgcttaataccaatttctctgagtttcttgaaatgtctttaaaacagacatttttctcaccaaacagtttgagtatctttattaaggaaacccttacgaatcctgaaaattatgctagcatgatttttttatatatagaagtttaaaaataaaccaggtcaggtttgtatatgtaaaattgttgacatcaatgatgtctttccatattcttatctgggcttaagaaatacattctgtatttttccagattctttgtagcctttgaaagatttttacagtacatatgtcttgactgagctgtcctttcttaatacaaaagcgtgtataattttcttaacttgtacagttggtaaacttttatgagaggaat

SEQ ID NO: 1265 - DNA, 1648 bp, Homo sapiens
gcggctcctgcgcgttcccgccgaggcagtggcggcgggagcggcagagacggcagcggccggagtcccgttgctgagtctcacatccgggttctggccgtgacccagctgcggccgccgcggagatgtgacccggcagtacggcaaatatggcggagccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcat

SEQ ID NO: 1266 - DNA, 2762 bp, Homo sapiens
cacacggccatggcggaggcctcctcgctggggaggcagagtcctcgcgtggtctcctgcctcgagcacagcctgtgcccaggggagccgggcttgcagacaacagcagtggtgtccatgggctctggagaccatcagttcaacctcgcagagatcctgtcacagaactacagtgttaggggggagtgcgaggaggcctcgaggtgcccagacaagcccaaggaggagctggagaaggacttcatctcccagagcaacgacatgccctttgatgagctgcttgcgctctatggctacgaggcgtcagaccccatttcagaccgggagagtgagggtggtgacgtggccccgaacctcccagacatgaccctggacaaagaacaaatagcgaaggatttgctttcaggggaagaagaggaagagacgcaatcatctgctgacgacctcaccccgtccgtgacctcccacgaggcctccgacctcttccctaaccggagtggatctcgtttcctggctgatgaagacagagagcctggctcttctgcctcctccgacaccgaggaggactctcttcctgccaacaaatgtaagaaggagatcatggtgggacctcagttccaagctgacctcagcaacctgcacttgaaccggcactgtgagaagatctacgagaacgaagaccagctgctctgggaccccagcgtcctccctgagagggaggtggaggagttcctgtacagggcggtgaagcggcgttggcacgagatggccgggcctcagctcccagagggagaagccgtgaaagacagtgagcaggcgctgtacgagttggtgaaatgcaacttcaatgtggaggaggccctgcgaaggctgcggttcaacgtgaaggtgatccgagatgggctctgtgcttggagtgaagaggagtgcaggaactttgagcacggcttccgtgtgcatggaaagaactttcacctgatccaggccaacaaggtgcgcacacggtcagtgggcgagtgtgtcgagtactactacctgtggaagaagtcggagcgctacgactacttcgcccagcagacgcggctgggccggaggaagtacgtcccgtccggaaccacggacgcagaccaggacctggatggcagcgaccccgatggccccggccgtccgcgcccggagcaagacaccctgactgggatgcgcacagatccactgagcgtggatggcacggccggtggtctcgatgagcccggagtggcctctgatggactcccgtcctcggagccagggccgtgttccttccagcagctggatgagtcccccgctgtacccctgtcccatcggcccccagccctggccgacccagcctcataccagccagctgtcactgctccggagccagacgccagcccaaggctggccgtggacttcgccctgcccaaggagctgcccctcatctccagccatgtggacctcagcggggatccggaggagactgtggccccagcacaggtggctttgtcggtcaccgagtttggactcatcggcattggggacgtgaaccccttcctggccgcccaccccacgtgcccggcccccgggctacactcggagcccctgtcacactgtaacgtgatgacctgctgactcctggccgcgggcggcgtatgcggcccagactggacttagcgctgccgctgggcccgcctctgtcagtcttcctgaccccttccccaccccccgggccttggggtagcacctccttctgcttcagaacacgtcaggactggggtgaggtggctgggccgtgagcccttgcccctgtccacacagaatggacccacggccccacccagcgccgtcagcgcccggcactgccacccgggtccgggccgctgcctgcacgtgggatccgtcgggcagccggggacagaagagaccccgccgttgggacgcagggcagagccggccacctagtcccttccagccagcagaggcgagggaaggcgtcactgccccggcggggagacgggcaggacgccctgccccgcaccagcagcctccgccggggcgccctcagctccctgcttggctctgtctctccacacccggcagggccgcgggctgccccagccctgggggtcgtgggcagctgctactcagtgccaaccccgtggggcacagagccatatacctcgctgtccggcccccaccccagcctcgccttcccaccccatcgtctccacttcaggaaaagccgcactttacacccccacctgcctcttccccctccatccctgctccccgatcctgagcggttggggtggggtccctcagcaaccccaggcgtgggtttgaggagacaggtgatttacatcccctttgctgtcctcccccggtaccaaggcagggagcctccggaggagccggccctgctggccacgcaggggccagactccagcctgtttccccagccctgcaggtcttccttctgtgggaagcttcctagcaagatggcttggagtcctggtccccctcctccctggccctctcgttcgtttctgtttctgtttacacgttggagtggggtcctccgtgggcggcggcgcgccctgccccgggtgtcgtccggcctcttgtgctcgagcccctttccgagttggactcgaccatccctcaccccaccaaggaccacactgtgaagtgataactgccttgaacccccctttgctgttttatttattaaacttgatttgaagccc

SEQ ID NO: 1267 - DNA, 5188 bp, Homo sapiens
aaggtaccaatatggcggaggcttcttttggaagttcgagcccagttgggtctttgtcttctgaggatcatgattttgaccccactgctgagatgttggtccatgactatgatgatgaaagaactcttgaagaagaggaaatgatggatgagggtaaaaacttcagttcagaaattgaagacttagaaaaggaaggaaccatgcctctagaagatttactggcattctatggctatgaacctacaattccagcagttgcaaattccagtgcaaatagttccccaagtgaactggcagatgaactaccagacatgacactagacaaagaggaaatagcaaaagacctgttgtcaggtgatgacgaggaaactcagtcttctgcggatgatctgacgccatctgtgacttcccatgaaacttctgatttcttccctaggcctttacgatcaaatactgcatgtgatggtgataaggaatcagaggttgaagatgttgaaacagacagtggtaattcacctgaagatttgaggaaggaaataatgattggtttacaatatcaggcagagattcccccttatcttggagagtacgatggtaatgagaaagtatatgaaaacgaagaccagttactttggtgtcctgatgtggttttggagagcaaagttaaggaataccttgttgagacttcattaaggactggcagtgaaaaaataatggataggatttctgcaggaacacacacaagggacaatgaacaggcattatatgaacttctcaagtgtaaccacaatataaaggaagcaatcgaaagatactgctgcaatggaaaggcctctcaagaaggaatgactgcatggacggaagaagaatgccgaagctttgaacatgcactcatgctttttggaaaagattttcatcttatacagaagaataaggtgagaactaggacagttgctgagtgtgtagcattctactatatgtggaagaaatctgaacgttatgattactttgctcaacagacaagatttgggaaaaaaagatataaccatcaccctggagttacggactatatggatcgtttagtagatgaaacagaagctttgggtgggacggtaaatgcttcagccttaacttctaaccggcctgagcctattcctgatcaacagctaaacattctcaactccttcactgccagtgacttgacagctttgaccaacagtgtagcaaccgtctgcgaccccacagatgtgaattgtttggatgatagctttcctccactgggcaacacaccccgtggacaagttaatcatgtgcctgttgtaacagaagagttactcaccctgcccagcaatggggaaagtgattgttttaatttatttgagactggattttatcactcggagctaaaccctatgaacatgtgcagtgaagagtcagagagaccagcaaaaagattgaaaatgggcattgccgtccctgaatcctttatgaatgaagtttctgtaaataacctgggtgtggactttgaaaatcacacacatcacatcaccagtgccaaaatggctgtttctgtggctgactttggcagtctctctgccaacgagaccaatggtttcatcagtgcccatgctctgcatcagcacgcggccctacactctgagtgacctgagtgaggatcccggaactgcgtgtgcagcaccagtaaacttgaggggagctatcaggtttgcatagtctttcactggaagtttgaacctttctcactatgacatcagtgatgtcagtatgtatagaactatatcttgatttatcaagagtattttcatttttcaatccataaatgtggaaatgaactatgatcagcagagttgggaactaagattgaactctgtggtgcagctttaagctctgcttctctcttcctcatctcccaatacctcttccccactcccttctttttctattcttttgtgttccccactgccctcactcccaattttaaaacctgtagacagaggccaccagctcaaaaccagcacagatgttctgaactgaatggtgtggcctgtttttgtgtaaattccttttgccgtaatggatgcagtggaataacaatgtttacaggtaccgatcccgatccctgctcaatgtagcatttttttggttttattttcttaataaaagcaggggtaggtttctttaaactgcacaaacatgcaaggattttttaaaaatggaaacttctctcatgttattcaactagagcacttcagtttacaaaacagcaagtccatctttatggaagccagcacaaggaactgtgtgcaaataatgaagacgcttgcttggatcctgtttcaaaattctagaccagggctaccttacacagaattggtcatgttactgccaggagatttctgtgtaacttcatttattggctacagttttggcatttgaagatgtggtactcagatggggttttgtccaccattgtcaagattgtaatcttaaaaatcataccagtcattgataatttagtttatcctgaggcagtcgacttgcagaggcacagtctacaaagcctaggatgttgccactcaatggtttacattttgggacatcttttaagttgtttgtagcactgcagttcaaagtgttaatatttagagggacttctagattttatacctaatgcagtagaaccttgaagtatatttaagcttttttgttaagcttgaacagttggcaagaataatgtgagttcctatctgaaatagaatggtacattaccacttttaagttttaaaaattgatagatgttcagatgtatctcaaactcagttttatttttattccaaatattgtgaatgagaagccattgtcctaaactttggccatttttgtgctataaacatgcatttttaagttataaggtgaatcaaacaatatgtaatacagtattaggatgtaatctttgcttttgtagtactgttaaaatagagaattatgttgtttgcaccgtcttaattaaaattcttgatttttactagttgctttgcaaaaaacaaatgtttggctgcattgctaatatttgtaagtataagttgcttcaaggttgtgctgatgagtagataggatgtagtgatcttagtagtgattgaaagggagggtatttattatacaaactgtgaactgcaatgacatccttagttttggatgatgtgtattcttgtttttctttgcagcattttaatgaagattgctttgaagtgtttacgcagtagcacattagtataaaatttagtttagcacagtggacaaaaagtagttaaattaataacttaaaatcagtctctaatttatacatctgaagtatagcattcctgtatgcacacagtaaataatgggtagcctgggctctgtgttactttcttgtatttttatccaagttgtcagcttcttattgctgtgttgttgtgctaaactttgaaccttatttcttttattaaaaatcagtacactttctataatttagtaagatactggccataatcttccattgttataaccttaattttcactctgggtttacagtggctggtctgtataaataatttacacaaagatgactgaatgctaataccagttgcacttaaatgaacatgcccattctcagtagctgatgcagtaatatattcagtttatctatgcattgctggggtcttgatataagatggaaacagtgtttcttatctaaagttttgattatcagcaagttgaatggacactttagttatttaaataaagatttttgaccaaaatccagaaaatggtatgagagaaaaataaattccagctagtttaatagatttttaaatgtcaatctgattttagcctcttagagagtgctaactagctggtaatgtttacttttaattccttgttaaaatgaggcaataatttgcaagatttttgtatataagtgtaaattcttcatatctttttagatctaattcaatattttctgactacttctgccatgtataataccatttttgtgcatgcttgatgtgacattcataaattgtaccactatgactttatccatgtaaaatagctatttattgaattttcttttaaaagctggatttactgggttttttttttctctcagtttaaacatcttaacagagaatttgttactgtttattaaaagaattgcatttggaagcaagaaaacaaccggatttgcaatcatgtgaagaaacaataatgcctttattatcaagtgttaagcacaattcttataacaaactgtgataaattctttttgtttttttttcctttgccccattattttcttatgaacaaaccaaaaattcatggtgagcagttgcagtgttggctgatatatcttttatgtacagggaatttgaaaaggacagtggattcatttagaagtgtaactggtgctgtgattatagcaatacatttgttagttgtacttcatctttttcatgctagctttttaaatgtttagttttcctcttgtcatggtcagctgctgaatttacttgaaggatgtagaatactgtttaaaaaatactaaaatttgtacaattagatcaaagaattgtgcaatcatttcctttttaatttttaaaatgttgaggctcataaatatttgagaacatcagatctaatagagcatagtgatactatttaatttaaccaaagtctctagtgaatatttcaactttgaatgtaaactaacaaataaacctgaccaccaaggagattgtttgcccagagtttcaaagcacattgtctacaaatggaaattgaaataatttataaaatattgacgttactatgttttttaaaaagttcctaattttttcactaaatggaggaaactattagttttattgttaaatatggtagatattaatattcctcttagatgaccagtgattccaattgtcccagtttgaaataagtaccctgtgagtatgagataaattagtgacaatcagaacaagtttcagtatcagatgttcaagaggaagttgctattgcattgattttaatatttgtacataaacactgatttttttgagcattattttgtatttgttgtactttaatacctggtgtacagttccagaaataaaaatctgggaatctt

SEQ ID NO: 1268 - DNA, 5198 bp, Homo sapiens
tcgttcgccctaaaggtaccaatatggcggaggcttcttttggaagttcgagcccagttgggtctttgtcttctgaggatcatgattttgaccccactgctgagatgttggtccatgactatgatgatgaaagaactcttgaagaagaggaaatgatggatgagggtaaaaacttcagttcagaaattgaagacttagaaaaggaaggaaccatgcctctagaagatttactggcattctatggctatgaacctacaattccagcagttgcaaattccagtgcaaatagttccccaagtgaactggcagatgaactaccagacatgacactagacaaagaggaaatagcaaaagacctgttgtcaggtgatgacgaggaaactcagtcttctgcggatgatctgacgccatctgtgacttcccatgaaacttctgatttcttccctaggcctttacgatcaaatactgcatgtgatggtgataaggaatcagaggttgaagatgttgaaacagacagtggtaattcacctgaagatttgaggaaggaaataatgattggtttacaatatcaggcagagattcccccttatcttggagagtacgatggtaatgagaaagtatatgaaaacgaagaccagttactttggtgtcctgatgtggttttggagagcaaagttaaggaataccttgttgagacttcattaaggactggcagtgaaaaaataatggataggatttctgcaggaacacacacaagggacaatgaacaggcattatatgaacttctcaagtgtaaccacaatataaaggaagcaatcgaaagatactgctgcaatggaaaggcctctcaaggaatgactgcatggacggaagaagaatgccgaagctttgaacatgcactcatgctttttggaaaagattttcatcttatacagaagaataaggtgagaactaggacagttgctgagtgtgtagcattctactatatgtggaagaaatctgaacgttatgattactttgctcaacagacaagatttgggaaaaaaagatataaccatcaccctggagttacggactatatggatcgtttagtagatgaaacagaagctttgggtgggacggtaaatgcttcagccttaacttctaaccggcctgagcctattcctgatcaacagctaaacattctcaactccttcactgccagtgacttgacagctttgaccaacagtgtagcaaccgtctgcgaccccacagatgtgaattgtttggatgatagctttcctccactgggcaacacaccccgtggacaagttaatcatgtgcctgttgtaacagaagagttactcaccctgcccagcaatggggaaagtgattgttttaatttatttgagactggattttatcactcggagctaaaccctatgaacatgtgcagtgaagagtcagagagaccagcaaaaagattgaaaatgggcattgccgtccctgaatcctttatgaatgaagtttctgtaaataacctgggtgtggactttgaaaatcacacacatcacatcaccagtgccaaaatggctgtttctgtggctgactttggcagtctctctgccaacgagaccaatggtttcatcagtgcccatgctctgcatcagcacgcggccctacactctgagtgacctgagtgaggatcccggaactgcgtgtgcagcaccagtaaacttgaggggagctatcaggtttgcatagtctttcactggaagtttgaacctttctcactatgacatcagtgatgtcagtatgtatagaactatatcttgatttatcaagagtattttcatttttcaatccataaatgtggaaatgaactatgatcagcagagttgggaactaagattgaactctgtggtgcagctttaagctctgcttctctcttcctcatctcccaatacctcttccccactcccttctttttctattcttttgtgttccccactgccctcactcccaattttaaaacctgtagacagaggccaccagctcaaaaccagcacagatgttctgaactgaatggtgtggcctgtttttgtgtaaattccttttgccgtaatggatgcagtggaataacaatgtttacaggtaccgatcccgatccctgctcaatgtagcatttttttggttttattttcttaataaaagcaggggtaggtttctttaaactgcacaaacatgcaaggattttttaaaaatggaaacttctctcatgttattcaactagagcacttcagtttacaaaacagcaagtccatctttatggaagccagcacaaggaactgtgtgcaaataatgaagacgcttgcttggatcctgtttcaaaattctagaccagggctaccttacacagaattggtcatgttactgccaggagatttctgtgtaacttcatttattggctacagttttggcatttgaagatgtggtactcagatggggttttgtccaccattgtcaagattgtaatcttaaaaatcataccagtcattgataatttagtttatcctgaggcagtcgacttgcagaggcacagtctacaaagcctaggatgttgccactcaatggtttacattttgggacatcttttaagttgtttgtagcactgcagttcaaagtgttaatatttagagggacttctagattttatacctaatgcagtagaaccttgaagtatatttaagcttttttgttaagcttgaacagttggcaagaataatgtgagttcctatctgaaatagaatggtacattaccacttttaagttttaaaaattgatagatgttcagatgtatctcaaactcagttttatttttattccaaatattgtgaatgagaagccattgtcctaaactttggccatttttgtgctataaacatgcatttttaagttataaggtgaatcaaacaatatgtaatacagtattaggatgtaatctttgcttttgtagtactgttaaaatagagaattatgttgtttgcaccgtcttaattaaaattcttgatttttactagttgctttgcaaaaaacaaatgtttggctgcattgctaatatttgtaagtataagttgcttcaaggttgtgctgatgagtagataggatgtagtgatcttagtagtgattgaaagggagggtatttattatacaaactgtgaactgcaatgacatccttagttttggatgatgtgtattcttgtttttctttgcagcattttaatgaagattgctttgaagtgtttacgcagtagcacattagtataaaatttagtttagcacagtggacaaaaagtagttaaattaataacttaaaatcagtctctaatttatacatctgaagtatagcattcctgtatgcacacagtaaataatgggtagcctgggctctgtgttactttcttgtatttttatccaagttgtcagcttcttattgctgtgttgttgtgctaaactttgaaccttatttcttttattaaaaatcagtacactttctataatttagtaagatactggccataatcttccattgttataaccttaattttcactctgggtttacagtggctggtctgtataaataatttacacaaagatgactgaatgctaataccagttgcacttaaatgaacatgcccattctcagtagctgatgcagtaatatattcagtttatctatgcattgctggggtcttgatataagatggaaacagtgtttcttatctaaagttttgattatcagcaagttgaatggacactttagttatttaaataaagatttttgaccaaaatccagaaaatggtatgagagaaaaataaattccagctagtttaatagatttttaaatgtcaatctgattttagcctcttagagagtgctaactagctggtaatgtttacttttaattccttgttaaaatgaggcaataatttgcaagatttttgtatataagtgtaaattcttcatatctttttagatctaattcaatattttctgactacttctgccatgtataataccatttttgtgcatgcttgatgtgacattcataaattgtaccactatgactttatccatgtaaaatagctatttattgaattttcttttaaaagctggatttactgggttttttttttctctcagtttaaacatcttaacagagaatttgttactgtttattaaaagaattgcatttggaagcaagaaaacaaccggatttgcaatcatgtgaagaaacaataatgcctttattatcaagtgttaagcacaattcttataacaaactgtgataaattctttttgtttttttttcctttgccccattattttcttatgaacaaaccaaaaattcatggtgagcagttgcagtgttggctgatatatcttttatgtacagggaatttgaaaaggacagtggattcatttagaagtgtaactggtgctgtgattatagcaatacatttgttagttgtacttcatctttttcatgctagctttttaaatgtttagttttcctcttgtcatggtcagctgctgaatttacttgaaggatgtagaatactgtttaaaaaatactaaaatttgtacaattagatcaaagaattgtgcaatcatttcctttttaatttttaaaatgttgaggctcataaatatttgagaacatcagatctaatagagcatagtgatactatttaatttaaccaaagtctctagtgaatatttcaactttgaatgtaaactaacaaataaacctgaccaccaaggagattgtttgcccagagtttcaaagcacattgtctacaaatggaaattgaaataatttataaaatattgacgttactatgttttttaaaaagttcctaattttttcactaaatggaggaaactattagttttattgttaaatatggtagatattaatattcctcttagatgaccagtgattccaattgtcccagtttgaaataagtaccctgtgagtatgagataaattagtgacaatcagaacaagtttcagtatcagatgttcaagaggaagttgctattgcattgattttaatatttgtacataaacactgatttttttgagcattattttgtatttgttgtactttaatacctggtgtacagttccagaaataaaaatctgggaatcttt

SEQ ID NO: 1269 - DNA, 2369 bp, Homo sapiens
ctggaaggggccacttcacacctcgggctcggcataaagcggccgccggccgccggcccccagacgcgccgccgctgccatggcccagcccctgtgcccgccgctctccgagtcctggatgctctctgcggcctggggcccaactcggcggccgccgccctccgacaaggactgcggccgctccctcgtctcgtccccagactcatggggcagcaccccagccgacagccccgtggcgagccccgcgcggccaggcaccctccgggacccccgcgccccctccgtaggtaggcgcggcgcgcgcagcagccgcctgggcagcgggcagaggcagagcgccagtgagcgggagaaactgcgcatgcgcacgctggcccgcgccctgcacgagctgcgccgctttctaccgccgtccgtggcgcccgcgggccagagcctgaccaagatcgagacgctgcgcctggctatccgctatatcggccacctgtcggccgtgctaggcctcagcgaggagagtctccagcgccggtgccggcagcgcggtgacgcggggtcccctcggggctgcccgctgtgccccgacgactgccccgcgcagatgcagacacggacgcaggctgaggggcaggggcaggggcgcgggctgggcctggtatccgccgtccgcgccggggcgtcctggggatccccgcctgcctgccccggagcccgagctgcacccgagccgcgcgacccgcctgcgctgttcgccgaggcggcgtgccctgaagggcaggcgatggagccaagcccaccgtccccgctccttccgggcgacgtgctggctctgttggagacctggatgcccctctcgcctctggagtggctgcctgaggagcccaagtgacaagggacaactgacgccgtctctgtgagcaccgaggctttttggcctcagcaccttcgaagtggttccttggcagactgcctttcctggaagagggcacgggcgatcccgacgggggcattcctgcgggtgagagccgtccccaccgcggcggcccttctcagcccctccctccatggagggacccatagggctagacactttgaggcaagcaggaggctctgcctaatgtgaatttatttatttgtgaataaactgtactggtgtcagttggcaatttcttcttcctacccgtggacacagagctccctctctccctccaaagaagagcatgggagaggtgggaggggttcttgcaatctttagccccccgacccccacaggcccagacccctttggccttacccccagccctggctcagcatctagtccagatgggtcagcctggaatgggtggggagggacgtcctgtgagaaggcagcggcaagtagaatctgctcatcttttctttgaacctggtggggaactggttaaaaccaaaatatctgtgtagaaatacaactccattattgagtatttattgtatgtacatcaggtacctattatactcaagtaaccattttacagaaggatgaggatcagcgctcaagcccaggtaggcctccagagtcccagcgctcagctcttgtgggattttgccagctccatacatgttggggcctgagggataacagctccaaggggttattttcttgcatcctgtggtcttattctccatgcacgggagcatcctggccttggaactcccccaccctccgccggcattttcccatctgccttttctctggtttccccaccttgtggcttagagacataaataatggtgtggcggtcctgagtttatataaccatgacctcctacaggcctagatggggtgagatgaggggcccatggggttgcatcggaatccacacaggcagttgcgtgcctgtctgcattggctggattcacatcagggagcaagaaacgggaggcttgagcccagaaagtgtgtcctcatccagccagggtgtctgggcaacagtcatgattagagggtgcggtggggagaagggatgtgtagcctctctgccaagcgtcctttaccctctatggatagatacccagttctcccctcctctccttcaagtgtctgaaacacaggcttcagtgtctgtttttataagagctttattaggatacaattcacataccataaaattcactcttttaacaactgaatggctttagtacatccacagagttgtgcaagcattgccactaattttagaacgttttcaccccccaaaagaaaccgtatacctgttaacatcactcctcactattccctactcccagtccctggcactcactcttctagtctctgtctctataggtttgctttttcaggacatttcatataaaaggaatcgcaaaatacg

SEQ ID NO: 1270 - DNA, 3058 bp, Homo sapiens
cgaaggtgttccggaaggaggcgaaccctgaggcgggcccggcaagccttccctgcggccggcagagcccaacgactagtgggactccgcgggggcgggggtagctggagcctggctctggcctggcaggagccgagctcgttccggaagaagccgagcggacgggggccagcctcagcgtcccgggagtgaggcgatagctgcggcggcgacagcgcgggccgggatgaaccgcgacggctgaggcagcggaggtgccggctgcgcgggccccagtgagactccctcgaagcggcagcccaccgttcggggctttgcctcgagccgagccctgcccccgcgagcctcccggacccctttgtgcggccggaggcggcggcgggaacggccatggcggccaacatgtaccgggtgggagattacgtctattttgagaactcttccagcaatccttacctggttagacggattgaggagctcaacaagactgcaaatggaaatgtggaggcaaaggttgtctgtcttttccggcgcagggacatttctagtagcctcaacagcctggctgatagtaatgccagggagtttgaagaggaatcaaagcagccaggggtgtctgagcagcagcgccatcaactgaagcaccgggaactttttctttctcggcaatttgaatcattaccagccacccacatacgggggaaatgcagtgtgaccctcttgaatgagacagatatcttgagccagtacctggaaaaggaggactgctttttttactcactggtgtttgaccccgtgcagaagacacttctcgctgatcagggcgagattagagttggttgcaaataccaagctgagatcccagatcgcctagtagagggagaatctgataatcggaaccagcagaagatggagatgaaggtctgggacccagacaaccctctcacagaccggcagatcgaccagtttcttgtggtggcccgagctgtgggaacctttgcaagagccctagattgtagcagctccattcggcagccaagcttgcacatgagtgcagctgctgcctcccgagatatcactctgtttcacgccatggataccttgcaaaggaacggctacgacctggctaaggccatgtcgaccctggtaccccagggaggcccggtgctgtgtcgggatgagatggaggaatggtcagcctcagaggccatgctatttgaggaggccctagagaagtatgggaaggacttcaatgatattcgccaggattttctaccctggaagtcacttgccagcatagtccagttttattacatgtggaaaaccacagaccggtatattcagcagaaaaggttgaaagctgctgaagcagacagcaaactgaaacaggtctacattcccacctacactaagccaaaccctaaccagatcatttctgtgggttcaaaacctggcatgaatggggctggatttcagaagggcctgacttgtgagagttgccacaccacacagtctgctcagtggtatgcctggggcccacctaacatgcagtgccgcctctgtgcttcctgttggatctactggaagaagtatgggggactgaagaccccaactcagcttgagggggccactcggggcaccacggagccacactcaaggggtcatttatccagacctgaagctcaaagtctctctccttacacaaccagcgccaacagggccaagctactggctaagaacagacaaactttcctgcttcagaccacaaagctgacccgtcttgccagacgcatgtgcagggacctattacagccaaggagggccgcccgacggccttatgctcctatcaatgccaatgccatcaaagcagagtgctccattcgacttcctaaggccgccaagactccattgaagattcaccctctggtgcggctgcccctggcaactatcgtcaaagatctggtggcccaggcacccctgaaaccaaaaacacctcggggtaccaagacaccgatcaacagaaaccagctgtcccagaaccggggactggggggcattatggtgaaacgggcctatgagactatggcaggggcaggggttcctttctctgccaatggaaggcctctggcttcagggattcgttcaagctcacagccagcagccaagcgtcagaaactaaacccagctgatgcccccaatcctgtggtgtttgtggccacaaaggataccagggccctacggaaggctctgacccatctggaaatgcggcgagctgctcgccgacccaacttgcccctgaaggtgaagccaacgctgattgcagtgcggccccctgtccctctacctgcaccctcacatcctgccagcaccaatgagcctattgtcctggaggactgagcacctgtggggaagggaggtgggctgagaggtagagggtggatgcccagggcacccaaacctcccttccctttcgtgtcgaagggagtgaggagtgaattaaggaagagagcaagtgagtgtgtgtccctggaggggttgggcgccctctggtgttaccacctcgagacttgtctcatgcctccatgcttgccgatggaggacagactgcaggaacttggcccatgtgggaacctagcctgttttggggggtaggacccacagatgtcttggacagttttggggggagggttttttaattttttaaaaattttgcctccctttgtgaaaggggatggggaggggaagagtaaacagataacaggtggtggtacctggttgggggaggggggcgtgcactgccatgtctttttttttttttttttttttttttttcctaattgggggtttctctttctgtccggtgtccggactttcctaattggagtttgaggcccctaagctggcatcaaccccaggccacgctcgctctttccttccctcccctccccctctgccttttgtacgccagttctcagaaataaagatcttttgtccgtttttttaacctcggattctgtaattggttcttatagtaacaaataaaaagctgttttcttca

SEQ ID NO: 1271 - DNA, 2577 bp, Homo sapiens
gcacaaccccccccttctccctgaggttgggaacaatacaccaatgagcctggggctgaggttcttctgctccctcccactttggttggcgcctagccaggggagtttgaagaggaatcaaagcagccaggggtgtctgagcagcagcgccatcaactgaagcaccgggaactttttctttctcggcaatttgaatcattaccagccacccacatacgggggaaatgcagtgtgaccctcttgaatgagacagatatcttgagccagtacctggaaaaggaggactgctttttttactcactggtgtttgaccccgtgcagaagacacttctcgctgatcagggcgagattagagttggttgcaaataccaagctgagatcccagatcgcctagtagagggagaatctgataatcggaaccagcagaagatggagatgaaggtctgggacccagacaaccctctcacagaccggcagatcgaccagtttcttgtggtggcccgagctgtgggaacctttgcaagagccctagattgtagcagctccattcggcagccaagcttgcacatgagtgcagctgctgcctcccgagatatcactctgtttcacgccatggataccttgcaaaggaacggctacgacctggctaaggccatgtcgaccctggtaccccagggaggcccggtgctgtgtcgggatgagatggaggaatggtcagcctcagaggccatgctatttgaggaggccctagagaagtatgggaaggacttcaatgatattcgccaggattttctaccctggaagtcacttgccagcatagtccagttttattacatgtggaaaaccacagaccggtatattcagcagaaaaggttgaaagctgctgaagcagacagcaaactgaaacaggtctacattcccacctacactaagccaaaccctaaccagatcatttctgtgggttcaaaacctggcatgaatggggctggatttcagaagggcctgacttgtgagagttgccacaccacacagtctgctcagtggtatgcctggggcccacctaacatgcagtgccgcctctgtgcttcctgttggatctactggaagaagtatgggggactgaagaccccaactcagcttgagggggccactcggggcaccacggagccacactcaaggggtcatttatccagacctgaagctcaaagtctctctccttacacaaccagcgccaacagggccaagctactggctaagaacagacaaactttcctgcttcagaccacaaagctgacccgtcttgccagacgcatgtgcagggacctattacagccaaggagggccgcccgacggccttatgctcctatcaatgccaatgccatcaaagcagagtgctccattcgacttcctaaggccgccaagactccattgaagattcaccctctggtgcggctgcccctggcaactatcgtcaaagatctggtggcccaggcacccctgaaaccaaaaacacctcggggtaccaagacaccgatcaacagaaaccagctgtcccagaaccggggactggggggcattatggtgaaacgggcctatgagactatggcaggggcaggggttcctttctctgccaatggaaggcctctggcttcagggattcgttcaagctcacagccagcagccaagcgtcagaaactaaacccagctgatgcccccaatcctgtggtgtttgtggccacaaaggataccagggccctacggaaggctctgacccatctggaaatgcggcgagctgctcgccgacccaacttgcccctgaaggtgaagccaacgctgattgcagtgcggccccctgtccctctacctgcaccctcacatcctgccagcaccaatgagcctattgtcctggaggactgagcacctgtggggaagggaggtgggctgagaggtagagggtggatgcccagggcacccaaacctcccttccctttcgtgtcgaagggagtgaggagtgaattaaggaagagagcaagtgagtgtgtgtccctggaggggttgggcgccctctggtgttaccacctcgagacttgtctcatgcctccatgcttgccgatggaggacagactgcaggaacttggcccatgtgggaacctagcctgttttggggggtaggacccacagatgtcttggacagttttggggggagggttttttaattttttaaaaattttgcctccctttgtgaaaggggatggggaggggaagagtaaacagataacaggtggtggtacctggttgggggaggggggcgtgcactgccatgtctttttttttttttttttttttttttttcctaattgggggtttctctttctgtccggtgtccggactttcctaattggagtttgaggcccctaagctggcatcaaccccaggccacgctcgctctttccttccctcccctccccctctgccttttgtacgccagttctcagaaataaagatcttttgtccgtttttttaacctcggattctgtaattggttcttatagtaacaaataaaaagctgttttcttc

SEQ ID NO: 1272 - DNA, 2265 bp, Homo sapiens
gagagggtgcggggaaccgcgacgcggcagggctccgagactcccagagagaagctgcgggcagccccgacggcactttcggggctgcgtcaggggctccccggggcacggagtggccttcggaaccggttccgaaggagctgacagggtagggagggaacgcgaggggctggggcgacggctttgccaccgcgggggagccgcccggaggtttcctcttcccaggcgttattgtgcgcctcgattcgaaaagattacgtctattttgagaactcttccagcaatccttacctggttagacggattgaggagctcaacaagactgcaaatggaaatgtggaggcaaaggttgtctgtcttttccggcgcagggacatttctagtagcctcaacagcctggctgatagtaatgccagggagtttgaagaggaatcaaagcagccaggggtgtctgagcagcagcgccatcaactgaagcaccgggaactttttctttctcggcaatttgaatcattaccagccacccacatacgggggaaatgcagtgtgaccctcttgaatgagacagatatcttgagccagtacctggaaaaggaggactgctttttttactcactggtgtttgaccccgtgcagaagacacttctcgctgatcagggcgagattagagttggttgcaaataccaagctgagatcccagatcgcctagtagagggagaatctgataatcggaaccagcagaagatggagatgaaggtctgggacccagacaaccctctcacagaccggcagatcgaccagtttcttgtggtggcccgagctgtgggaacctttgcaagagccctagattgtagcagctccattcggcagccaagcttgcacatgagtgcagctgctgcctcccgagatatcactctgtttcacgccatggataccttgcaaaggaacggctacgacctggctaaggccatgtcgaccctggtaccccagggaggcccggtgctgtgtcgggatgagatggaggaatggtcagcctcagaggccatgctatttgaggaggccctagagaagtatgggaaggacttcaatgatattcgccaggattttctaccctggaagtcacttgccagcatagtccagttttattacatgtggaaaaccacagaccggtatattcagcagaaaaggttgaaagctgctgaagcagacagcaaactgaaacaggtctacattcccacctacactaagccaaaccctaaccagatcatttctgtgggttcaaaacctggcatgaatggggctggatttcagaagggcctgacttgtgagagttgccacaccacacagtctgctcagtggtatgcctggggcccacctaacatgcagtgccgcctctgtgcttcctgttggatctactggaagaagtatgggggactgaagaccccaactcagcttgagggggccactcggggcaccacggagccacactcaaggggtcatttatccagacctgaagctcaaagtctctctccttacacaaccagcgccaacagggccaagctactggctaagaacagacaaactttcctgcttcagaccacaaagctgacccgtcttgccagacgcatgtgcagggacctattacagccaaggagggccgcccgacggccttatgctcctatcaatgccaatgccatcaaagcagagtgctccattcgacttcctaaggccgccaagactccattgaagattcaccctctggtgcggctgcccctggcaactatcgtcaaagatctggtggcccaggcacccctgaaaccaaaaacacctcggggtaccaagacaccgatcaacagaaaccagctgtcccagaaccggggactggggggcattatggtgaaacgggcctatgagactatggcaggggcaggggttcctttctctgccaatggaaggcctctggcttcagggattcgttcaagctcacagccagcagccaagcgtcagaaactaaacccagctgatgcccccaatcctgtggtgtttgtggccacaaaggataccagggccctacggaaggctctgacccatctggaaatgcggcgagctgctcgccgacccaacttgcccctgaaggtgaagccaacgctgattgcagtgcggccccctgtccctctacctgcaccctcacatcctgccagcaccaatgagcctattgtcctggaggactgagcacctgtggggaagggaggtgggctgagaggt

SEQ ID NO: 1273 - DNA, 1973 bp, Homo sapiens
ctagcctggcgctgggggcgggcaccagcccccacccctcggcgtaccatcccctttacttcccccaccccctgtcccctcccttccctcccttcccccccgtggcgaggcagcagcgacggcggcggcggcagcggcggtcgcggctgaggctgaggaggaggcggcggcggcgggcggggctcggctcgggctccgcgggcgggcgggcggacatggcggccaacatgtaccgggtcggagattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggat

SEQ ID NO: 1274 - DNA, 1785 bp, Homo sapiens
atggcggccaacatgtaccgggtcggagattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactga

SEQ ID NO: 1275 - DNA, 2202 bp, Homo sapiens
cccactcggccttgctagcctggcgctgggggcgggcaccagcccccacccctcggcgtaccatcccctttacttcccccaccccctgtcccctcccttccctcccttcccccccgtggcgaggcagcagcgacggcggcggcggcagcggcggtcgcggctgaggctgaggaggaggcggcggcggcgggcggggctcggctcgggctccgcgggcgggcgggcggacatggcggccaacatgtaccgggtcggagattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatgtaagatgcttttaaattcttaaccttatatgttgtgcttctgaccattttctcttttcctctctttccttttttttttgtttgtttgtttgcaataaacataagttcttgtgtacagccttttatttggtttattttttaacattgtttttgtgtgctgccatttgtatcatgccaacctggaaaaaaaaaatcaaaacattgaaacttctgtactctttaccagagagtagtgcttagcaaaagattggtgggaggtgatcctattccatggggttttgtgatggaattgcctgcagagcccttattgaagcacttttaccttttaggtagtgccacaatgtaacccctaaggatgctgttataatgagactccataatcgagacagtacagtccagtcttacatggattcattaggtttaaataaaatttgccaatttacactaa

SEQ ID NO: 1276 - DNA, 748 bp, Homo sapiens
tccttgtcctgagaaggcaggcttcattgatcaatttgaccccatttcatgatttattttaatagtgtaagaggaaaagaagtgtgatggccaagagttcacagaggaagcaacgtgactgtgtaaaccaatgcaaatcaaagcctggcttgagcacctcaatccctttgagaatgtccagttacacattcaagaggccagtaacgagaattacaccccatcctggcaatgaggtcagataccatcaatgggaggagagcttggagaagcctcagcaggtctgctggcagaggagactgcagggactccaggcttacagcagtgcaggagaactttcaagcactttggatcttgccaataccttgcaaaaacttgtccctagttacacaggtggatctctgctggaggatcttgccagtggtctggagcactcctgccccatgccccaccttgcctgctcttcagatgcggtggagataattcctgcagagggagtgggtatctcgcagctcctctgcaaacaatttctggttactgaggaagatatcaggaaacaggaagggaaagtgaagacagtcagagagagactcgcaatagcactgattgcggatggactcgctaatgaggcagagaaagtgagagaccaagaaggccgtcctgaaaaacgctaagaaaaaaagggaagatagtgcagatgaaataaagtgtaatcctttattaacatctctttgcagtgtccccaatgagg

SEQ ID NO: 1277 - DNA, 3584 bp, Homo sapiens
atgcgcgggaggccgctcggtgatccgcggcggcggcagcggcgcttcctgctaggaccggccggggccgtaccggaggctcgggctccaccgaccctcctcccaccccctcccactcaccctctgggccgcgactgcgcagggcggggccggccgaaccatgggccgcggtgtgggctaagctggtggccccggctttagactggaccccacaatgtttgcagagatgttcaggcacgcgggagctgattacacacaatgaatgggggcaatgagagcagtggagcagacagagctgggggccctgtggccacatctgtccccatcggctggcagcgctgtgtgcgagagggtgctgtgctctacatcagtccaagtggcacagagctgtcttccttggagcaaacccggagctacctcctcagcgatgggacctgcaagtgcggtctggagtgtccacttaatgtccccaaggttttcaactttgaccctttggccccggtgaccccgggtggggctggggtggggccagcatcagaggaggacatgaccaagctgtgcaaccaccggcggaaagctgttgctatggcaactctgtaccgcagcatggagaccacctgctcacactcttctcctggagagggagcgagcccccaaatgttccacactgtgtccccagggcccccctctgcccgccctccctgtcgagttcctcctacaactccacttaatgggggtcctggctcccttcccccagaaccaccctcagtttcccaggcctttcccactctagcaggccctggggggcttttccccccaaggcttgctgacccagtcccttctgggggcagtagcagcccccgtttcctcccaaggggcaatgccccctctccagccccacctcctccacctgctatcagcctcaatgctccctcatacaactggggagctgccctcagatccagcctggtgccctctgacctgggctctcctccggcccctcatgcctcctcctcaccaccttcagaccctcctctcttccactgtagtgatgccttaacaccccctcccctgcccccgagcaataatctccccgcccaccctggtcctgcctctcagccaccagtgtcttcagccactatgcacctgcccctggtcctggggcccctgggaggggcccccacggtggaggggcctggggcaccccccttccttgctagcagcctactctctgcagcggccaaggcacagcatcccccactaccccctcccagcactttacagggccgaaggccccgtgcccaggcaccctcagcttcccactcctcatcacttcgtccctctcagcgtcgtccccgcagaccccctactgtatttcgattgctagaagggagaggccctcaaacccctagacggagccgtcctcgggcccctgctcctgtcccccaacccttttctctcccggagccatcccaaccaattctcccttctgtgctgtccctgctgggactccccacccctggcccttcccactctgatggaagctttaaccttttggggtcagatgcacaccttcctcctcccccaaccctctcctcagggagccctccccagcccaggcaccccatccagccctccctgcctgggaccaccagtggcagcctcagcagtgtgccaggtgcccctgccccaccagctgcctccaaagccccagtagtccccagccctgtgcttcaaagcccatccgaaggactggggatgggggcaggcccggcctgccctctgcctcccctggctggtggagaggctttccctttccccagccctgagcagggcctggcactgagtggagctggcttccctgggatgcttggggccttgcctctccctctgagtctggggcagcctccaccttctccattgctcaaccacagtttatttggtgtgctgactgggggaggaggacaacctccccctgagcccctgctacccccaccaggaggacctggtcctcccctagccccaggagagcctgaagggccttcgcttttggtggcttccttgcttcctccaccaccctcagaccttcttccacctccttcagcacctcccagcaacctccttgcctctttcctgcccctgttggctctgggccccacagctggggatggggagggatctgcagagggagccgggggtccaagtggggagccattttcaggcttgggagacctgtcccccctacttttccccccactttcagccccccctaccctcatagctttaaattctgcgctgctggctgccaccctggatcccccctcggggacacccccccagccctgtgtcctgagtgccccccaacctggaccacctacctccagtgtcaccacggcaactactgacccgggggcctcctctctgggcaaggccccctccaactcagggagacccccccaactccttagccctctgctgggtgccagcctgctgggtgacctgtcttcactgaccagcagccctggagccctccccagcctgttgcagcctcctggccctcttctctctggccagttggggctgcagctcctccctggggggggagctcctccacccctctcagaggcttctagtcccctagcctgcctgctacagagtctccagatccctccagagcagccagaagccccctgtctaccccccgagagccctgcctcagccctcgaaccagagcctgccaggcctcccctcagtgccttagccccaccccatggttctcccgaccccccagtccctgagctgctcactgggagggggtcagggaaacggggccggaggggaggagggggacttaggggcattaatggtgaggccaggccagcccggggccgaaagcctggcagccggcgggagcctggccgactggccctcaaatgggggacacgtggtggcttcaatggacaaatggaaaggcaagaagaacccaccattggcagcataatggggagctggctgaagggggtgctgagcccaaggatccaccccctcccgggccccattctgaggaccttaaggtgccccagtagtcagaaagtctcgtcgtggccgtaggagaaaatacaaccctacccggaacagcaatagctcccgccaggacattaccttggaacccagccctacagcccgagcagctgtccctctgcctccccgggcccgccctggccgtcctgccaaaaacaagaggaggaaactggccccatagcagccatacctggagctggatctgaccctgattggggagagctgagtgctgagccttgggagcccctgccagccacctgcacctgctgccctccttcccagtgaaagagacgttgtgatgatgcgactgaggattatgcaacgtggtccaaccggagcggccagcatgaccagctgtccaggggctgcctcctgccttttcttttgtaaagacaagacccttgggagttttaattctgttttgtacttgccctgtggggcctccactgcttttctatgggagacactcttaatttaacagatgagaatattttgaaactctg

SEQ ID NO: 1278 - DNA, 4282 bp, Homo sapiens
gcggctgcggcagcgacggcggcggcggcagcggcagcagcctgcgcagtgccttctgggaacggaatccccagggctgcccctggcccccatggcgcatgcgcgggaggccgctcggtgatccgcggcggcggcagcggcgcttcctgctaggaccggccggggccgtaccggaggctcgggctccaccgaccctcctcccaccccctcccactcaccctctgggccgcgactgcgcagggcggggccggccgaaccatgggccgcggtgtgggctaagctggtggccccggctttagactggaccccacaatgtttgcagagatgttcaggcacgcgggagctgattacacacaatgaatgggggcaatgagagcagtggagcagacagagctgggggccctgtggccacatctgtccccatcggctggcagcgctgtgtgcgagagggtgctgtgctctacatcagtccaagtggcacagagctgtcttccttggagcaaacccggagctacctcctcagcgatgggacctgcaagtgcggtctggagtgtccacttaatgtccccaaggttttcaactttgaccctttggccccggtgaccccgggtggggctggggtggggccagcatcagaggaggacatgaccaagctgtgcaaccaccggcggaaagctgttgctatggcaactctgtaccgcagcatggagaccacctgctcacactcttctcctggagagggagcgagcccccaaatgttccacactgtgtccccagggcccccctctgcccgccctccctgtcgagttcctcctacaactccacttaatgggggtcctggctcccttcccccagaaccaccctcagtttcccaggcctttcccactctagcaggccctggggggcttttccccccaaggcttgctgacccagtcccttctgggggcagtagcagcccccgtttcctcccaaggggcaatgccccctctccagccccacctcctccacctgctatcagcctcaatgctccctcatacaactggggagctgccctcagatccagcctggtgccctctgacctgggctctcctccggcccctcatgcctcctcctcaccaccttcagaccctcctctcttccactgtagtgatgccttaacaccccctcccctgcccccgagcaataatctccccgcccaccctggtcctgcctctcagccaccagtgtcttcagccactatgcacctgcccctggtcctggggcccctgggaggggcccccacggtggaggggcctggggcaccccccttccttgctagcagcctactctctgcagcggccaaggcacagcatcccccactaccccctcccagcactttacagggccgaaggccccgtgcccaggcaccctcagcttcccactcctcatcacttcgtccctctcagcgtcgtccccgcagaccccctactgtatttcgattgctagaagggagaggccctcaaacccctagacggagccgtcctcgggcccctgctcctgtcccccaacccttttctctcccggagccatcccaaccaattctcccttctgtgctgtccctgctgggactccccacccctggcccttcccactctgatggaagctttaaccttttggggtcagatgcacaccttcctcctcccccaaccctctcctcagggagccctccccagcccaggcaccccatccagccctccctgcctgggaccaccagtggcagcctcagcagtgtgccaggtgcccctgccccaccagctgcctccaaagccccagtagtccccagccctgtgcttcaaagcccatccgaaggactggggatgggggcaggcccggcctgccctctgcctcccctggctggtggagaggctttccctttccccagccctgagcagggcctggcactgagtggagctggcttccctgggatgcttggggccttgcctctccctctgagtctggggcagcctccaccttctccattgctcaaccacagtttatttggtgtgctgactgggggaggaggacaacctccccctgagcccctgctacccccaccaggaggacctggtcctcccctagccccaggagagcctgaagggccttcgcttttggtggcttccttgcttcctccaccaccctcagaccttcttccacctccttcagcacctcccagcaacctccttgcctctttcctgcccctgttggctctgggccccacagctggggatggggagggatctgcagagggagccgggggtccaagtggggagccattttcaggcttgggagacctgtcccccctacttttccccccactttcagccccccctaccctcatagctttaaattctgcgctgctggctgccaccctggatcccccctcggggacacccccccagccctgtgtcctgagtgccccccaacctggaccacctacctccagtgtcaccacggcaactactgacccgggggcctcctctctgggcaaggccccctccaactcagggagacccccccaactccttagccctctgctgggtgccagcctgctgggtgacctgtcttcactgaccagcagccctggagccctccccagcctgttgcagcctcctggccctcttctctctggccagttggggctgcagctcctccctggggggggagctcctccacccctctcagaggcttctagtcccctagcctgcctgctacagagtctccagatccctccagagcagccagaagccccctgtctaccccccgagagccctgcctcagccctcgaaccagagcctgccaggcctcccctcagtgccttagccccaccccatggttctcccgaccccccagtccctgagctgctcactgggagggggtcagggaaacggggccggaggggaggagggggacttaggggcattaatggtgaggccaggccagcccggggccgaaagcctggcagccggcgggagcctggccgactggccctcaaatgggggacacgtggtggcttcaatggacaaatggaaaggtccccaagaagaacccaccattggcagcataatggggagctggctgaagggggtgctgagcccaaggatccaccccctcccgggccccattctgaggaccttaaggtgcccccgggagtagtcagaaagtctcgtcgtggccgtaggagaaaatacaaccctacccggaacagcaatagctcccgccaggacattaccttggaacccagccctacagcccgagcagctgtccctctgcctccccgggcccgccctggccgtcctgccaaaaacaagaggaggaaactggccccatagcagccatacctggagctggatctgaccctgattggggagagctgagtgctgagccttgggagcccctgccagccacctgcacctgtggacagtgggtgggggcactactccccactcagagcacaaatgcaactccttcccctacaatcccatcctgagccattgcagggggcagggaagttcacccccccccaccacccccccgcccccccgaagccatgtcactgaaaaggcctgggggggatggtatatggccctttccccaccaggcgctaaggggaacacccccttccccaggtcttttatttgtttaagttatttttgcacaaatgactcttttatatttaattcgatttcattgcctcccttcttaaagccaacaggctcagtttacaaacctgtgagctactgttggctgctgccctccttcccagtgaaaggtacaaagcaataagcatcatgcatcctccccttacccctccaacacccctctgcctctggctcaggttgctcaaagcacagatcctctcttaccccgtccccaggtttgaaacacatagcctcatttcaaggtgtagccaggttcccccgactttcctctgggatataaaaaagggggtaagggggcaaagagagccctctgggcctctcctcccatacacactacactgccccttctccccccatcaaaacgctcagagacgttgtgatgatgcgactgaggattatgcaacgtggtccaaccggagcggccagcatgaccagctgtccaggggctgcctcctgccttttcttttgtaaagacaagacccttgggagttttaattctgttttgtacttgccctgtggggcctccactgcttttctatgggagacactcttaatttaacagatgagaatattttgaaactctg

SEQ ID NO: 1279 - DNA, 3592 bp, Homo sapiens
atgcgcgggaggccgctcggtgatccgcggcggcggcagcggcgcttcctgctaggaccggccggggccgtaccggaggctcgggctccaccgaccctcctcccaccccctcccactcaccctctgggccgcgactgcgcagggcggggccggccgaaccatgggccgcggtgtgggctaagctggtggccccggctttagactggaccccacaatgtttgcagagatgttcaggcacgcgggagctgattacacacaatgaatgggggcaatgagagcagtggagcagacagagctgggggccctgtggccacatctgtccccatcggctggcagcgctgtgtgcgagagggtgctgtgctctacatcagtccaagtggcacagagctgtcttccttggagcaaacccggagctacctcctcagcgatgggacctgcaagtgcggtctggagtgtccacttaatgtccccaaggttttcaactttgaccctttggccccggtgaccccgggtggggctggggtggggccagcatcagaggaggacatgaccaagctgtgcaaccaccggcggaaagctgttgctatggcaactctgtaccgcagcatggagaccacctgctcacactcttctcctggagagggagcgagcccccaaatgttccacactgtgtccccagggcccccctctgcccgccctccctgtcgagttcctcctacaactccacttaatgggggtcctggctcccttcccccagaaccaccctcagtttcccaggcctttcccactctagcaggccctggggggcttttccccccaaggcttgctgacccagtcccttctgggggcagtagcagcccccgtttcctcccaaggggcaatgccccctctccagccccacctcctccacctgctatcagcctcaatgctccctcatacaactggggagctgccctcagatccagcctggtgccctctgacctgggctctcctccggcccctcatgcctcctcctcaccaccttcagaccctcctctcttccactgtagtgatgccttaacaccccctcccctgcccccgagcaataatctccccgcccaccctggtcctgcctctcagccaccagtgtcttcagccactatgcacctgcccctggtcctggggcccctgggaggggcccccacggtggaggggcctggggcaccccccttccttgctagcagcctactctctgcagcggccaaggcacagcatcccccactaccccctcccagcactttacagggccgaaggccccgtgcccaggcaccctcagcttcccactcctcatcacttcgtccctctcagcgtcgtccccgcagaccccctactgtatttcgattgctagaagggagaggccctcaaacccctagacggagccgtcctcgggcccctgctcctgtcccccaacccttttctctcccggagccatcccaaccaattctcccttctgtgctgtccctgctgggactccccacccctggcccttcccactctgatggaagctttaaccttttggggtcagatgcacaccttcctcctcccccaaccctctcctcagggagccctccccagcccaggcaccccatccagccctccctgcctgggaccaccagtggcagcctcagcagtgtgccaggtgcccctgccccaccagctgcctccaaagccccagtagtccccagccctgtgcttcaaagcccatccgaaggactggggatgggggcaggcccggcctgccctctgcctcccctggctggtggagaggctttccctttccccagccctgagcagggcctggcactgagtggagctggcttccctgggatgcttggggccttgcctctccctctgagtctggggcagcctccaccttctccattgctcaaccacagtttatttggtgtgctgactgggggaggaggacaacctccccctgagcccctgctacccccaccaggaggacctggtcctcccctagccccaggagagcctgaagggccttcgcttttggtggcttccttgcttcctccaccaccctcagaccttcttccacctccttcagcacctcccagcaacctccttgcctctttcctgcccctgttggctctgggccccacagctggggatggggagggatctgcagagggagccgggggtccaagtggggagccattttcaggcttgggagacctgtcccccctacttttccccccactttcagccccccctaccctcatagctttaaattctgcgctgctggctgccaccctggatcccccctcggggacacccccccagccctgtgtcctgagtgccccccaacctggaccacctacctccagtgtcaccacggcaactactgacccgggggcctcctctctgggcaaggccccctccaactcagggagacccccccaactccttagccctctgctgggtgccagcctgctgggtgacctgtcttcactgaccagcagccctggagccctccccagcctgttgcagcctcctggccctcttctctctggccagttggggctgcagctcctccctggggggggagctcctccacccctctcagaggcttctagtcccctagcctgcctgctacagagtctccagatccctccagagcagccagaagccccctgtctaccccccgagagccctgcctcagccctcgaaccagagcctgccaggcctcccctcagtgccttagccccaccccatggttctcccgaccccccagtccctgagctgctcactgggagggggtcagggaaacggggccggaggggaggagggggacttaggggcattaatggtgaggccaggccagcccggggccgaaagcctggcagccggcgggagcctggccgactggccctcaaatgggggacacgtggtggcttcaatggacaaatggaaaggtccccaagaagaacccaccattggcagcataatggggagctggctgaagggggtgctgagcccaaggatccaccccctcccgggccccattctgaggaccttaaggtgcccccgggagtagtcagaaagtctcgtcgtggccgtaggagaaaatacaaccctacccggaacagcaatagctcccgccaggacattaccttggaacccagccctacagcccgagcagctgtccctctgcctccccgggcccgccctggccgtcctgccaaaaacaagaggaggaaactggccccatagcagccatacctggagctggatctgaccctgattggggagagctgagtgctgagccttgggagcccctgccagccacctgcacctgctgccctccttcccagtgaaagagacgttgtgatgatgcgactgaggattatgcaacgtggtccaaccggagcggccagcatgaccagctgtccaggggctgcctcctgccttttcttttgtaaagacaagacccttgggagttttaattctgttttgtacttgccctgtggggcctccactgcttttctatgggagacactcttaatttaacagatgagaatattttgaaactctg

SEQ ID NO: 1280 - DNA, 607 bp, Homo sapiens
gcatgcgcgggaggccgctcggtgatccgcggcggcggcagcggcgcttcctgctaggaccggccggggccgtaccggaggctcgggctccaccgaccctcctcccaccccctcccactcaccctctgggccgcgactgcgcagggcggggccggccgaaccatgggccgcggtgtgggctaagctggtggccccggctttagactggaccccacaatgtttgcagagatgttcaggtagctgtggtgatacggcagaggactcctcagtctccctcccagctgaggggttccccttgctcctctggggcttcccctgagttttcttgggtctccccacaacctttgccttcctggagtcctctctcaggtacttcgctcagtttaatcctcctagtgcctacatggatgtctgtgttatcaggcacgcgggagctgattacacacaatgaatgggggcaatgagagcagtggagcagacagagctgggggccctgtggccacatctgtccccatcggctggcagcgctgtgtgcgagagggtgctgtgctctacatcagtccaagtggcacagagctgtcttccttggagcaaacccggagctacc

SEQ ID NO: 1281 - DNA, 596 bp, Homo sapiens
acctattttcccccacggtactcctatggctttctccaagaccctctcttgctgtaccagacagcaagtcctgtgactccctgtgtgaggagcgcggcacaggcctgcctcctaggtgttcgggtcgagatttacagcggagtctcatcccgggacgtgtgagtgcacttcagcgcaggactgccctggactggggagaccggagccgcgattttagactcaactccccatcacttgccaagggatcttaccgtccttgtttgtaaattaaagataaaagttgtgaaggtgtgggctaagctggtggccccggctttagactggaccccacaatgtttgcagagatgttcaggcacgcgggagctgattacacacaatgaatgggggcaatgagagcagtggagcagacagagctgggggccctgtggccacatctgtccccatcggctggcagcgctgtgtgcgagagggtgctgtgctctacatcagtccaagtggcacagagctgtcttccttggagcaaacccggagctacctcctcagcgatgggacctgcaagtgcggtctggagtgtccacttaatgtccccaaggttt

SEQ ID NO: 1282 - DNA, 568 bp, Homo sapiens
aagtggctttgggtcacgaggcttcacggaggaggtgtgggctaagctggtggccccggctttagactggaccccacaatgtttgcagagatgttcaggcacgcgggagctgattacacacaatgaatgggggcaatgagagcagtggagcagacagagctgggggccctgtggccacatctgtccccatcggctggcagcgctgtgtgcgagagggtgctgtgctctacatcagtccaagtggcacagagctgtcttccttggagcaaacccggagctacctcctcagcgatgggacctgcaagtgcggtctggagtgtccacttaatgtccccaaggttttcaactttgaccctttggccccggtgaccccgggtggggctggggtggggccagcatcagaggaggacatgaccaagctgtgcaaccaccggcggaaagctgttgctatggcaactctgtaccgcagcatggagaccacctgctcacactcttctcctggagagggagcgagcccccaaatgttccacactgtgtccccagggcccccctctgcccgccctccctg

SEQ ID NO: 1283 - DNA, 532 bp, Homo sapiens
agtcggtcgtgagcctctttgccgcttgtctcccccagaagctgctgttccgcccacctagctttacccgccgttttacccccactataagggactcccatatttcttggcccctcccagctaatgggcacataggccttttgaacttttctttttaaagttggtatccatccactgggattgtcgacatctcgagtcttcttaaagaggtctcctggccgggctcagtggcttacgcctgtaatcccagcactttgggaggctgaggagagcggatcacttgaggtgtgggctaagctggtggccccggctttagactggaccccacaatgtttgcagagatgttcaggcacgcgggagctgattacacacaatgaatgggggcaatgagagcagtggagcagacagagctgggggccctgtggccacatctgtccccatcggctggcagcgctgtgtgcgagagggtgctgtgctctacatcagtccaagtggcacagagctgtcttccttggagcaaacccggagctac

SEQ ID NO: 1284 - DNA, 509 bp, Homo sapiens
accctctgccccctccgcgtcctctcggcccctttccccggccccatccccactcccccgccctcacctgcccccgccgcttctccctctcactgccagacttctgccttcctcaccgccctcccctcagtgcttcgcccaccctccgcccgccctctccccaagttccttcctacttcgtgcgccttcccctcctcctcaagctgagggaagcagtctgggtgacagggcgccttgttgtgagagggaaagtttggaagccgccagtgtggggtgggagcaatggtgtgggctaagctggtggccccggctttagactggaccccacaatgtttgcagagatgttcaggcacgcgggagctgattacacacaatgaatgggggcaatgagagcagtggagcagacagagctgggggccctgtggccacatctgtccccatcggctggcagcgctgtgtgcgagagggtgctgtgctctacatcagtccaagtggcacagagctgtctt

SEQ ID NO: 1285 - DNA, 852 bp, Homo sapiens
cgcgtccccaagaggtctacgggccggacctgggcagggactacggagcagtccatgggtcggggtacaggaggaaagtcaaggcactcaaagcccaggagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaa

SEQ ID NO: 1286 - DNA, 741 bp, Homo sapiens
agctgcggttggcttgtggcgtctccgccgccgccgccctcccttcctcttccccatcttcttctctcggtcccgggagcccccgcccggagagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggct

SEQ ID NO: 1287 - DNA, 1315 bp, Homo sapiens
gcgagctgtcgcgtctggtcgtggtctggcggagctgcggttggcttgtggcgtctccgccgccgccgccctcccttcctcttccccatcttcttctctcggtcccgggagcccccgcccggagagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactcattatgcgggctcttcttcaaaaggcaaggtgggacccggcggggagggtgctgctgaaccagcggtgaggcaggagcccagaccctgctctcctgcgagatgggattgggtggaaggggctccagggctcctggtgctccccatgtgggaatagggtggccacatcagtaaccgattccctgggcctccagcccggccttccagccatgggcctggctgcctgaagaggaaggaaaccacccccaacttggttgctggggacttgaagacttcagtgtgatctttacctaggggagggacagagctgggctggtggagcccatgggtgctg

SEQ ID NO: 1288 - DNA, 1487 bp, Homo sapiens
gctccgaggtgccccatgtgcggcaggaagaagcagcctccacaggactgcgctcagcgggagacggggcttccccgtgaagaggtgctgagtgcgaatgcccactccaacacctggtcactgtgtgatcttgagaaagagttgagcctctctgggccctggcttccccaacaaccaaaggctgtacagagagcggcttaggagagagctcctgtgtgcgccgccgagggctctgctggctcaggacatctgtaggaccagttccagctccagtgggcaccgccagcacgcccaggagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactcattatgcgggctcttcttcaaaaggcaaggtgggacccggcggggagggtgctgctgaaccagcggtgaggcaggagcccagaccctgctctcctgcgagatgggattgggtggaaggggctccagggctcctggtgctccccatgtgggaatagggtggccacatcagtaaccgattccctgggcctccagcccggccttccagccatgggcctggctgcctgaagaggaaggaaaccacccccaacttggttgctggggacttgaagacttcagtgtgatctttacctaggggagggacagagctgggctggtggagcccatgggtgctg

SEQ ID NO: 1289 - DNA, 2282 bp, Homo sapiens
gcgagccaattccggccgcgccggaagtctctactgaggaaagctatgaggatactctgttcgtaagctcccggtgaattttgttccacagactcggaagaaaggttggataagagttcactggagattgacaagtactcgggatagtgaaaagccggagttggaacatggatagccgcttgcaggagatccgggagcggcagaagttacggcgacagctcctcgcgcagcagttgggagctgaaagtgccgacagcattggtgccgtgttaaatagcaaagatgagcagagagaaattgctgaaacaagagaaacttgcagggcttcctatgatacctctgctccaaatgcaaaacgtaagtatctggatgaaggagagacagatgaagacaaaatggaagaatataaggatgaactagaaatgcaacaggatgaagaaaatttgccatatgaagaagagatttacaaagattctagtacttttcttaagggaacacagagcttaaatccccataatgattactgccaacattttgtagacactggacatagacctcagaatttcatcagggatgtaggtttagctgacagatttgaagaatatcctaaactgagggagctcatcaggctaaaggatgagttaatagctaaatctaacactcctcccatgtacttacaagccgatatagaagcctttgacatcagagaactaacacccaaatttgatgtgattcttctggaaccccctttagaagaatattacagagaaactggcatcactgctaatgaaaaatgctggacttgggatgatattatgaagttagaaattgatgagattgcagcacctcgatcatttatttttctctggtgtggttctggggaggggttggaccttggaagagtgtgtttacgaaaatggggttacagaagatgtgaagatatttgttggattaaaaccaataaaaacaatcctgggaagactaagactttagatccaaaggctgtctttcagagaacaaaggaacactgcctcatggggatcaaaggaactgtgaagcgtagcacagacggggacttcattcatgctaatgttgacattgacttaattatcacagaagaacctgaaattggcaatatagaaaaacctgtagaaatttttcatataattgagcatttttgtcttggtagaagacgccttcatctatttggaagagatagtacaattcgaccaggctggctcacagttggaccaacgcttacaaatagcaactacaatgcagaaacatatgcatcctatttcagtgctcctaattcctacttgactggttgtacagaagaaattgagagacttcgaccaaaatcgcctcctcccaaatctaaatctgaccgaggaggtggagctcccagaggtggaggaagaggtggaacttctgctggccgtggacgagaaagaaatagatctaacttccgaggagaaagaggtggctttagagggggccgtggaggagcacacagaggtggctttccacctcgataattgttgaagacattgaacctattcatcctcctctaaccttctttattgtaattaaatttcaagtgggagacttaactttagaactcacttccagcttgcactttgctttaatttctctgagctgcaagaatgtcttagcgagccttgcttgcagttgtcacacacactgtctggtttttttcaggataaatgaatgattctgccttttgttatgtgcgtgaacagaatggaacaactcaagtagcttcatcttcagagactgaatttattctgatagacttcagctaattacaaaggattttgctaatttttgggaataaataatggaaaaagatccagtctgtggtatcatgctagtgctgacagggccttgatagaatagagttggaaaagatggtaagcttttgtcagggttttaacattttcttgatgaaacaataaaaagaggtaagcttttttcttctttttttttaagttttaaataaactcagatataatttgaatactgaagaaattaagagactttgaacaaaaactcttcccaaatctaaatttgataggggaggtggagattccaggggtgggtgaaagaagagatagaacttagcaggcagacttaaaaaaaaaaaaaaagtttatcatcataatctcaattttgtggctatgactcctaatcacgcttcctaagaagcaaaggaggacaaatattcatgtgctagatagcactgtggtgtggacttgaac

SEQ ID NO: 1290 - DNA, 4777 bp, Homo sapiens
caactagaggagctcgccccctgcctgtgacagcttagggtcgcctactttttgtggacacactgccgtccacggagtgcagaggccgcctgcagttttcttgcgtccctgtgagacgcacggtggcgcaattcccgagcgtgccaatcccgggctggctggagggcgggctcttcaaatttgaattgcggaagtgttttgtgtgttagagaacgtcgcggaggaggtaagcgtcgcttggcgcctggccgccgcgggcaggatacaccgtgggcctgaggcgcgagcccggcggcgtgcggccctctctccgcgcggagccgagccggaactgcggcagtctctccctgccaggctcttcatccaaggtttctgtggatcccttctgaagttctatctgaaaattgcgcttaagtgaattttctgttagaagaacttggttgctactttcttgtcaagatgattgcaacacctttgaaacattcaagaatttacttacctccagaggcatcttctcaaaggagaaatctacccatggatgcaatcttttttgacagcattccttcaggcacacttactcctgtaaaagatttggtgaaatatcagaactcctccttaaaattgaatgaccataaaaagaatcagttcctaaaaatgacaacttttaacaataaaaatatatttcaatcaactatgctaacagaggctactacctctaacagttctcttgatatcagtgctataaagcccaacaaggatggattaaaaaataaagcaaactatgaatcaccaggaaaaatatttctaagaatgaaagaaaaagtactgcgtgacaagcaagaacagccatcaagaaacagtagtttgttggaaccacagaaaagtggaaataatgaaaccttcactcctaacagagttgaaaaaaaaaaattgcagcatacctacctatgtgaagaaaaggaaaacaacaaatcattccagtcagatgacagttcactaagagcctcagtccaaggagttcctctagaatcatcaaataatgatattttcctcccggtcaaacaaaagattcagtgccagcaggaaaagaaagcaccactgcacaatttaacttacgaacttccaactctgaaccaagaacaggaaaattttttggctgtagaagcccgaaacaagacattaactagagctcagttggctaaacaaatttttcactcaaaggagagtatagttgcaaccactaaatccaaaaaggacacgtttgttttagaaagcgttgattctgctgatgaacaatttcaaaatactaatgctgagactctcagtactaattgtattcctattaaaaatggcagcctgttaatggtttctgatagtgagaggacaacagaagggacttcgcaacagaaagttaaggaaggaaatggaaaaacagtgcctggagagacaggtcttccaggttccatgaaagatacatgtaaaattgtacttgcaacaccaagacttcatataacaatacctcggaggtcaaaaagaaatatttcaaagctttctcctccaagaatatttcaaactgttacaaatggacttaaaaaaaatcaggtagttcagctacaggaatggatgattaaaagcatcaataataatactgctatatgtgtagaaggaaaattgatagacgtcactaacatatattggcacagtaatgtaattatagagcggattgagcacaacaaacttaggactatatcaggcaacgtttatatattaaaaggcatgatagaccaaatttccatgaaagaagcaggatatccaaattatctcataaggaaatttatgtttggatttccagaaaattggaaagagcacattgataattttctggaacaattaagggctggtgaaaagaacagggaaaagaccaaacaaaaacagaaaactggaagatctgtccgtgacataaggaaatcaatgaaaaatgatgcacgagaaaaccaaacagatactgctcaaagagccaccaccacttacgattttgattgtgataatttggaactgaagagtaataagcacagtgagtcaccaggagctacagaattaaacatgtgccacagtaattgccaaaataaaccaacattaaggttcccagatgaccaagtaaataatactattcaaaatggaggaggagatgacttatctaatcaggaattaattggaaaaaaagaatataaaatgtcttcaaagaaactaaaaattggtgaaagaacaaatgaaaggataataaaaagtcagaagcaagagacaactgaagaattggatgtatccattgatattctaacctcaagggaacagtttttctcagatgaagaaagaaaatacatggccatcaatcagaagaaagcttatattttagtaacaccacttaaatctagaaaagtgatagagcaaagatgcatgaggtataatctgtccgctggcaccatcaaagcagtaacagattttgtaataccagagtgtcaaaaaaaaagtcccatcagcaagtccatggggactttagaaaatacatttgaaggtcataaaagtaaaaacaaggaagattgcgatgaacgtgacttacttactgtcaaccggaaaataaaaatatctaaccttgaaaaggaacaaatgctcacctctgactttaagaaaaataccagactattaccaaaattgaagaaaatagaaaatcaggtagctatgtcattttataagcatcagtcctcaccagatttgtcaagtgaagaaagtgaaacagaaaaggaaattaaaaggaaagctgaagttaagaaaaccaaagcaggaaacaccaaagaagcagtggttcacctgagaaagagcacaagaaacacaagtaatattccagtgattttggaacctgaaactgaagaaagtgaaaatgaattttatatcaaacaaaagaaagctagaccttccgtcaaagaaactcttcagaagtctggtgttaggaaagagtttccaattactgaggcagtaggatctgataagacaaataggcatcccttagaatgcttacctggtttaattcaggataaggaatggaatgagaaggagttacagaaacttcattgtgcttttgcatctcttccaaagcacaaacctggtttctggtcagaggtagctgcggctgtaggttctcgatctcctgaagaatgccagaggaaatacatggaaaatcccagaggaaaaggatcccagaaacatgtcactaagaagaagccagccaattccaaaggccaaaatggcaagagaggtgatgctgatcagaaacaaactattaagataactgccaaagtgggaactcttaaaaggaagcaacagatgagggaatttctggaacagttgccaaaagatgaccatgatgattttttcagtacaacacctttacagcatcaaagaatactgttgccaagtttccaggacagtgaagatgatgatgatattctgccaaatatggacaaaaatccaacaactccatcatcagttatctttccattggtaaaaactcctcaatgtcagcatgtcagtcctggcatgctaggttctataaataggaatgactgtgataaatatgtttttcgtatgcaaaaatatcataaaagtaatggtggtattgtctggggcaacatcaagaaaaaattagttgaaactgatttctcaactccaacaccaagaaggaaaaccccatttaacacagacttaggagaaaactctggtattggaaaacttttcactaatgctgtggaatctttagatgaagaagagaaagattattatttttcgaactctgattctgcatagtaaaatgagaaaatatgattcctgggatttttaccataaagcagacagtgtttgtattttcaactggagtacatgtattttctttgtaaagtagcttcctatgaaaatgtggacttttttgaaggtttcatatgtttgtgttcaaagtaaaatatcctcattgctgcagcttactaaaaatgtaaagaaaattgtttttgctcgtgtagatatctgtaaatttgtttttgcatattaaaatatatatagataattttttaataagcatccaagtctgtttactttaagaaaaccatttcccaaacagatttttttttatttcaagaaaattttgctaccatttaagtaagagaaggtgagaaggatgacagaggttgtattggtagctattgaattcatgaaaacttttaagttagcatttgttagcagttattatccaagccagagtaggatttgttaccagttgttatccaaacctaatgtttaaattacacattgttgaaattaaattacacattgttgacatgcttctctcctgattgtttttattttaaacttgtgataggcatatctatgaaacctttgtaaatttagtttattgctttaccattattttactaggtaaaattagagaacagattttgttctctaatttttaagccttatttacatatgcagaaacagcttaaatattttgactagattagacaaacagttaatagatccaccattaggaatcaatatattatgtcataataaacatcctttttctttcactgaaatttcttttagaaataaacttatttttgcttgttatgttttgaaacttgacataggatattttccctctggctacacattcacctacccttgttctctatttagattattcaaataaagttagtttgcttttatagta

SEQ ID NO: 1291 - DNA, 808 bp, Homo sapiens
ggtaagcgtcgcttggcgcctggccgccgcgggcaggatacaccgtgggcctgaggcgcgagcccggcggcgtgcggccctctctccgcgcggagccgagccggaactgcggcagtctctccctgccaggctcttcatccaaggggcagggacattaggaaacagaaagctctgttttggttcttggagcctttcaacgtgaccacaattatctgactttaaatgaagacagttctgcatgtccattacaggtttctgtggatcccttctgaagttctatctgaaaattgcgcttaagtgaattttctgttagaagaacttggttgctactttcttgtcaagatgattgcaacacctttgaaacattcaagaatttacttacctccagaggcatcttctcaaaggagaaatctacccatggatgcaatcttttttgacagcattccttcaggcacacttactcctgtaaaagatttggtgaaatatcagaactcctccttaaaattgaatgaccataaaaagaatcagttcctaaaaatgacaacttttaacaataaaaatatatttcaatcaactatgctaacagaggctactacctctaacagttctcttgatatcagtgctataaagcccaacaaggatggattaaaaaataaagcaaactatgaatcaccaggaaaaatatttctaagaatgaaagaaaaagtactgcgtgacaagcaagaacagccatcaagaaacagtagtttgttggaaccacagaaaagtggaaataatgaaaccttcactcctaacagagttgaaaaaa

SEQ ID NO: 1292 - DNA, 1575 bp, Homo sapiens
agcagcggcggttttttttcccatggcgctctggggcgcgggcgatttgtaggtaatggcaggcgttcggtcactgaggtgtagcagaggatgcgctggcggctgtgagtgcggcgacaagggcaaatgcagcgactcctcgctgttgggcaagagactctccgaagactcgagccgccaccagctgttgcagaagtgggcgagcatgtggagctccatgagcgaagacgcgtcggtggccgacatggagagggcgcagctggaggaggaggcggcggctgcggaggagaggccgctggtgttcctgtgctccggctgccggcggccgctgggcgactcgctgagctgggtggccagccaggaggacaccaactgcatcctgcttcgctgtgtttcctgtaatgtttctgtggataaggaacagaagctatccaaacgtgaaaaggaaaatggttgcgtccttgagactttgtgctgcgcggggtgctcactcaatcttggctacgtgtacagatgcacgcccaagaatcttgattacaagagagacttgttttgcctcagtgttgaagccattgaaagttatgttttagggtcctctgaaaagcaaattgtgtcagaagataaagagctttttaatcttgaaagcagagttgaaatagaaaagtctctaacacagatggaagatgtcttgaaagcattacaaatgaagctgtgggaggccgaatccaaattgtcctttgccacttgtaaaagctgaactctagtctgtgtcctccattctgcccccgcccttcctccccttatttgttaaatgaagcaacatagtgagacgtcgtctctacaaaaaaaaaaagaaaaaaaaaattagccaggcatgcgaaacgctgaggtgggaggatcagatgagcttgggaggttgaggctgcagtgagccttggtcatgccactactgtgttctagtctgggcaacagagtgagaccttctctcaaaaaaaaaacccaaaattgtagaattacttctatagctatattttatgataaagaagtgattgtttctcaaaatcgcattttaaagacgttttatggtacttgttggaattgggacttaggagttttgattttgataagaaactgggataattttctgaactttttttcctctgtatcacatttatttactatttttaaaaactttgacatttaacacttgggacaacatttattataaatgataagaaaaatcttagaggtttgtctacccacagtgtcatggaatcttctctgaaaactaatccataaagttccctggagaaattggtcagaatgatctgtcagaaccatttgaaaacttgctcaagagcagttgcttatatatagtaggattttactttttcctgcttatgtactactatatgcttaaaaaacctggaggaatacttaccaaagaggagtaaccatctctgagggtgggattctgggggaatttttgtttttttctgttttctataatgtgaaacttttgtagtatgtatttttctaattgaagagaataaagattaaaacaaagtgctttaa

SEQ ID NO: 1293 - DNA, 8608 bp, Homo sapiens
aggttcacaataaaggtgctaagaaagagaatgtaagacaggaaaataattaaatattcttaccgagtgtcttcaataggccgtgtttaagaggcgtcttacactccctgttgccagtggctggaacacaatggatcacacaggggcgatagacaccgaggatgaagtgggacctttagcccatcttgctccaagtcctcagagtgaagctgtggctcatgaattccaggaactctccttgcagtccagtcaaaacttaccccctctgaacgaaaggaaaaatgtgctccagctgaggctgcaacaaaggaggacgagagaacaactagtggaccagggcatcatgccacctttgaagagcccagcggcattccatgaacagataaaaagcttggaacgagccagaactgaaaactttttgaaacacaagattcggagtcgaccagatcgttctgaacttgtcaggatgcacattttagaagaaacatttgcagagccatccctgcaggctactcagatgaagttgaaaagagctcgactagcagatgatctgaatgaaaagattgctcaaagacctggtcctatggagctggtagagaaaaacatccttcctgtggactccagtgttaaagaagcaattataggcgttgggaaggaggactatccccacactcagggcgatttctcatttgatgaagacagcagtgacgctttgtctccggaccagcctgcgagtcaggagtcacaggggtcagccgcgtccccaagtgagccaaaagttagtgaatcgccatctcctgtgactacaaacactccagcgcagtttgcttcagtgtccccaacagttcctgaattcttgaaaactcctccaactgcagatcagcctcccccacggcctgcagctcctgtcctccccacaaacactgtgtcctcagcaaagcctggcccagcactggtgaagcaaagccatcccaagaatccaaatgacaaacaccgtagcaaaaagtgcaaagatcccaaaccacgggtaaagaagttaaagtaccaccaatacattccaccagatcagaagggtgagaagaatgagccgcagatggactctaactacgcccgcctgctccagcagcagcagctgttcctgcaactgcagatcctgagtcagcagaagcagcactacaactaccagaccatcctgcctgcaccattcaagccactcaatgacaaaaatagtaacagtgggaattcagctttgaacaatgccacacctaacacaccaagacagaatacatctactcctgtgagaaagccaggacctctgccttctagcctggatgacttaaaggtatcagaactgaagacagaactgaagttaaggggtctgccagtgtcaggcaccaaaccggacctcattgagcgcctaaaaccctaccaggaagtgaacagcagcggccttgctgctgggggcatcgtggcagtgtcatcatcagccattgtcaccagtaacccagaagtcactgtggccttgccggttacaacactacacaacactgtgactagctcagtctctactctcaaggcagaattgccacctacaggaaccagcaacgcaacccgtgtggaaaatgttcattcccctctgcccatttcaccatctccctccgaacagtccagtctcagtactgatgacacaaacatggcagacactttcaccgagattatgaccatgatgtcgccttcacagttcttgagttcatctcctttgagaatgacaaataatgaagacagtctgagtcccaccagcagcactctgtcaaacctggaactggatgcagccgaaaaggatcgcaagcttcaggagaaagagaagcaaatcgaagagctgaagaggaaactggaacaagagcagaagctcgtggaagtgctgaaaatgcaacttgaggttgaaaaacgagggcagcagcagcggcccctggaagcccagcccagtgccccaggtcattctgtcaagtcagatcagaagcacggcagccttggctcctccatcaaagatgaggcctcactccctgactgctccagctccaggcagcccatcccagtagccagccacgctgtaggccagcccgtctctacaggtggccagacccttgttgccaaaaaggctgtagttatcaagcaagaggtccctgtgggccaggcagagcagcagagtgtcgtctcgcagttttatacttcaccacaagcaggaatgcagactcagcctcagatagcaactgctgcacaaataccaactgctgccttggcctcaggcttggccccaactgtacctcagacacaagacacgttcccgcagcatgtgctcagtcagcctcaacaagtcagaaaggttttcacaaactcagcatcatcaaatacagttcttccatatcagagacatcctgccccagctgtccagcagccctttatcaataaggcctccaacagtgttcttcaatccagaaatgctccgcttccatccctgcaaaatggacctaacacacccaacaagcctagttcacccccgccaccccagcaatttgtcgtccagcactctctatttgggagtccagtcgccaagacaaaagatcccccccgctatgaggaggccatcaagcagacacgcagcacacaggcccctctgccagagatttccaacgctcacagtcagcagatggatgacctctttgatatcctcattaagagtggagagatctccctccccataaaagaagaaccttctcctatttccaaaatgagaccagtgacagccagcatcaccacaatgccagtgaatacagtggtgtcccggccaccaccccaagtccaaatggcaccacctgtatctttagaacctatgggcagtttatctgccagcttagagaaccaactagaagctttcttggatggaactttaccctcagccaatgaaattcctccactacaaagcagcagtgaagacagagagcccttctctctgatcgaggacctccagaatgatctgctgagtcactcaggtatgctggaccattcacactcacccatggagacttccgagacccagtttgctgcaggtactccctgtctgtctctcgacctgtcagactcaaacttggacaacatggagtggttggacattaccatgcccaactcctcttcaggactcactcctctcagcaccaccgcgccgagcatgttctctgctgactttctagacccacaggacctaccgctgccatgggactaacgtcacagatttcttttctgagagttgatgaggtttaagaacatgaagattctaaaaggtcagtttttagagatagatctatagttgcattgttgcaatcaaaatatgttgtcacagaaagaataggtggaaggtcatagcctggaacccaagtttgaaaacatttcattgtgttcagtagtgaatttctacagtttaacatagcacagggccttctgaaaatcgcacttgtcaaagacgactcatctatttctccagacttcagtaaagaatgaaaagtacctttagataaaaacaaagaagagtaatatatgcagcacagtgacgttaggattctggtaattaactacatttaaatctctggtcactttaagaccctaaataaaaggcagacagctccactcaaaaactaaggctgatgtgagggaggtgagaggtcactgcacttggtacttcctagagacggccggagccaggcccaagacacagcagaggtcaaaggcagtggagagccttggccagttcagtgacagcttctggctgaagacttttggttctattcagaaacctgtgtcgtttttttggtgttgtagtttattttgtgattttttggaatcgtactttatatttccaaatttaaatttaaatgcaagatctttcaacataaacagaagatacctacaaaatactgtcagaagtccaggtatactgataacactgaaaattctattagcaaccttctgggttggttagattgattttaatgtatatattagacatttgtatgtatgctctgacattgtgatttgtacagcctacgctggggtaaggaaatgggtatccaaggtcctacttttttaatagctcgaatatttctagagtacttgagccacatgtatttctgtatttaaagaattgctgactaactttcaggtaaccagacccatctcaaagaaccaagaaaaggctttagcatgaaatatctttctgagctggcgagttagaagaatggaaggtaaggggaaggtctgtcatctacccaggacattcccatgatgagtacaggtcagattgtgccacaaggtgggcctccacgtccctgccctggccctctttcttctgtcactaaccctggttatcattttacaggcttgtaactggatattctaccagagctctcactatattgtcaagcctaagattgaaaaactggaggctttattagtgtttttatatagaaaacagttattacatatgtgttaagtcatttcttaagaattttctaaaatgccaactatcacaggattatttcaagctagtcattgaggtatatgacaaaatgtaaataacaaaaaactgaaatctaccaaaagagcatggagatttttcttaaataataatattgtgctctccacctcacccttgtgtaaaccctcaggtcaggttggttcccctgggtcacaaaatggtaaatgttccatactgacatgccggaggcagcctgacccgttatttggaaagaatttgtgaattatttctgggtttgtgttttgcctaagagctgatcttatttctgatttgtgtgtgtgtggtttataaattttactacgtgtaacaaaagtctgcttttccagcatgagcacactggagccctctgctcactggcacttcctgactcaaaggcactaacagtgctcatgtgccttccagacggttcaaggcagaggccactgtgctcagtgtagtctgtgatgaatagtttaagtgttcagaaattggtaaaccaacacacgggatacaataactctctgttaaccagaacaccgtcatttgaccaagccctacaagagtttaccacactagatgttctgtgaatcctcgagtcagttccattgagaggggcctgtctccagggccaggctatttacttgggaaagtatttttcttacagttcttggccacagtttttttgctgagggtttctgtctgggcctatcaggtccatacttagaccctgagcatcttcttcattcagatttgaatggcttattaaattagcaccaaatatcagtgggactgtagaaggtaaccgaacactagtaccattgactctcgttgaataactttatatttccataatcctgaattgtgtagatagttttctagctctcgggtccctttattgctttttaaaatagggtttgaaacatgccacaggaaggttgctctccaaaaatacacagtgcagtgcaagaaaatgctatctcattggcctactctcctatgaattgctaaagtgcccacttcacatatgtgtttaaacctttataaaccagtatttcacttttaaaaagacaaggcatctctacccattaactctgcaagccactccacttgcaccattccgcttgaccctcctctctcctggcttgggtcaccagccaggcacctgtgacacgagtgctgctctccaggatctccactacatgttccaggttggagtgaggacgcgctatgtgctcacactcatgtgacatgaccaaagatgatactctgtaaacaaggcccttctgaccggactcagtgcgtgtgatggtgagtgcaatgaggaagggtggatattgactaaagactggttgttgttgttgtttaggttagtgtcacagccattacagcacaagtcaaagtcgccagttgaattttcattatgcacgtgtgtggtttaagcagtggtactgttgtatatcatattgtaaagtatcatactgccaagaaaataactcctagaaaggcattatctcacatccccatcttactttcctacatgttctcaaaacacagtagtaccagccttacctttctgctgtatgtagatagtcagatcatcctactgggggtgggatgaatttaaaagttataccaaaatttctgtaaagtctttgaaagtctaggagtaggtggtcatcttgtacatttcagcaaagcatccactaggaaacctcataggacagtgttagtggttcacgttctagtgtttttcctgaaatgtgcaatctactgtatagtattgccacataattgtacatagatgtattctgaatttgtggaatttcttgcttagatactattgtgtttgtttcatatgaatatttttgtaattctaaaagagatcttatttaaatttcctttttaaaagccgcatggttctgtgatccatgtaactgacactttttggctttcagtgctgtttagaaacagtggcaaaggcagggtggtgctgcctgcaagctgctgcctatggaaggcaaagtcatagtaatgagatagcacctctgaactgtgcagtcagcataccctgagtgatggctcaggggcgcactacctattttgtcaccagagctgactcaggcttcctggaccctcaaccccagatcattccaggcagcatagctttcttcacagtcctttcagaattcccaggctgaaatcagccatagcagttgacaaaacagctatccccacaagtgatgagatagtccctttactgtcctcaaatggacttggccttagagacgtggtaaagcactttggcagggtttaaaatatttgtgagaagcccacatttcagtatacatcctcactggcttccatgcacccacctgacggtagcctcacagaagtcctggctgtcactcaggtggggagctcatggtgccgctggggactttttagagaaatgtaaagagaatagctattcagtgtctactagcagagcaacatgtgtcaatttaaccaaattcacaaataaccctccatttttcaatatctgctactgtaaacatgaatattgaatactgacaagagaatacccatacaaatcgtcccaccgccctagaggccacagaattagcccaaaattatcaaagaacattaactggaaggtcaggtttttcaaggaacatagcttacaaatgcatcagtgtgtatctggagagcatcctaactgcatttcaactcatcttttaagtgatttcagtcaaaactggaaaacaactaagatgtagtaatttttttttcctggttcaaaccttcaataacttgctcattcagcagtctctctgagctacatttttatttgtaaagtgactctgtctgcatggcaatgagcaggtgcgtgttttttccacattcgccctttcttgcagtatccagggaaacacatcattacaaagggtttctacctgaaatctttcatggaaggcctacaattcgaaaagctgcacatgtttacagaagagctcttaccctccatgcaaacactttgctctgtggtgtcacagctttgtgacaataagatggcaatctcggatctacaaggtgctgtcgggaatcaaataaaatatgttatcagagatatcatcacatctatagtgtttaacagagctttatgccaactactaagacaaagctttaacaaagtttatagaatactgaaactcgtaacaattacctctctacgtgatgctgtaaggaatcttgctaatttggtaggaagaggaagcatttaggaaagggtttagtatctaccaaaagtacttgacctcaagtaaccaatagtaatgcaaacttgctttaaaggaaccaaaggcattgccaagtatttgccaaaaggaggcactttttatttaaaatttgagactaatgagatctcaaaaatcagccccaaaaaggtattatccatttaaggttataattttcactaagatgtagatatttctcttattgttttcatgtaaaatagtatagagttgttttgttggtttaagagtaacattcagtagtaatacaaagttttttttctatgtagaaattagttttcttttcttgcttgcaatagaaatgcaatgtgataggtgtttctcttcttattttcattgtcacattatgtcttagcatctcactttatgaaaaaaaggagaaagataccaatctacagagccctgcttgttgaagcactagtttaatcaacaaaaaattatggcaatcgggggtccattcatctattgcctttatgttgttttttaaaagaaaaaccatgatgcctttgtatttgctgtttgcacccctgaaatcaattccatatcatgtttgaatgccatacattttgcacatgtactgtacataagtaatgcatactgtatttttatatgtgtgcacatttatcatcagatcttttgtacatagtggcagtattgtagctgatcgggaaatgtttgatatctcagcaattttgcatttttgtgtctcaaataaaagacattttgatgt

SEQ ID NO: 1294 - DNA, 3465 bp, Homo sapiens
atgatcgatagctccaagaagcagcaacagggcttcccagagattttaactgctggggattttgaaccattaaaagaaaaggaatgccttgaggggagcaaccagaaaagtctcaaggaagtgctccagctgaggctgcaacaaaggaggacgagagaacaactagtggaccagggcatcatgccacctttgaagagcccagcggcattccatgaacagataaaaagcttggaacgagccagaactgaaaactttttgaaacacaagattcggagtcgaccagatcgttctgaacttgtcaggatgcacattttagaagaaacatttgcagagccatccctgcaggctactcagatgaagttgaaaagagctcgactagcagatgatctgaatgaaaagattgctcaaagacctggtcctatggagctggtagagaaaaacatccttcctgtggactccagtgttaaagaagcaattataggcgttgggaaggaggactatccccacactcagggcgatttctcatttgatgaagacagcagtgacgctttgtctccggaccagcctgcgagtcaggagtcacaggggtcagccgcgtccccaagtgagccaaaagttagtgaatcgccatctcctgtgactacaaacactccagcgcagtttgcttcagtgtccccaacagttcctgaattcttgaaaactcctccaactgcagatcagcctcccccacggcctgcagctcctgtcctccccacaaacactgtgtcctcagcaaagcctggcccagcactggtgaagcaaagccatcccaagaatccaaatgacaaacaccgtagcaaaaagtgcaaagatcccaaaccacgggtaaagaagttaaagtaccaccaatacattccaccagatcagaagggtgagaagaatgagccgcagatggactctaactacgcccgcctgctccagcagcagcagctgttcctgcaactgcagatcctgagtcagcagaagcagcactacaactaccagaccatcctgcctgcaccattcaagccactcaatgacaaaaatagtaacagtgggaattcagctttgaacaatgccacacctaacacaccaagacagaatacatctactcctgtgagaaagccaggacctctgccttctagcctggatgacttaaaggtatcagaactgaagacagaactgaagttaaggggtctgccagtgtcaggcaccaaaccggacctcattgagcgcctaaaaccctaccaggaagtgaacagcagcggccttgctgctgggggcatcgtggcagtgtcatcatcagccattgtcaccagtaacccagaagtcactgtggccttgccggttacaacactacacaacactgtgactagctcagtctctactctcaaggcagaattgccacctacaggaaccagcaacgcaacccgtgtggaaaatgttcattcccctctgcccatttcaccatctccctccgaacagtccagtctcagtactgatgacacaaacatggcagacactttcaccgagattatgaccatgatgtcgccttcacagttcttgagttcatctcctttgagaatgacaaataatgaagacagtctgagtcccaccagcagcactctgtcaaacctggaactggatgcagccgaaaaggatcgcaagcttcaggagaaagagaagcaaatcgaagagctgaagaggaaactggaacaagagcagaagctcgtggaagtgctgaaaatgcaacttgaggttgaaaaacgagggcagcagcagcggcccctggaagcccagcccagtgccccaggtcattctgtcaagtcagatcagaagcacggcagccttggctcctccatcaaagatgaggcctcactccctgactgctccagctccaggcagcccatcccagtagccagccacgctgtaggccagcccgtctctacaggtggccagacccttgttgccaaaaaggctgtagttatcaagcaagaggtccctgtgggccaggcagagcagcagagtgtcgtctcgcagttttatgtgagttcccagggacagccaccgcctgctgttgttgctcagccccaggctttactgaccacgcagactgctcagctgctgctcccagtgtccatccagggctcgagtgtcacctcagtgcaactccctgtaggcagcctcaaactccagacttcaccacaagcaggaatgcagactcagcctcagatagcaactgctgcacaaataccaactgctgccttggcctcaggcttggccccaactgtacctcagacacaagacacgttcccgcagcatgtgctcagtcagcctcaacaagtcagaaaggttttcacaaactcagcatcatcaaatacagttcttccatatcagagacatcctgccccagctgtccagcagccctttatcaataaggcctccaacagtgttcttcaatccagaaatgctccgcttccatccctgcaaaatggacctaacacacccaacaagcctagttcacccccgccaccccagcaatttgtcgtccagcactctctatttgggagtccagtcgccaagacaaaagatcccccccgctatgaggaggccatcaagcagacacgcagcacacaggcccctctgccagagatttccaacgctcacagtcagcagatggatgacctctttgatatcctcattaagagtggagagatctccctccccataaaagaagaaccttctcctatttccaaaatgagaccagtgacagccagcatcaccacaatgccagtgaatacagtggtgtcccggccaccaccccaagtccaaatggcaccacctgtatctttagaacctatgggcagtttatctgccagcttagagaaccaactagaagctttcttggatggaactttaccctcagccaatgaaattcctccactacaaagcagcagtgaagacagagagcccttctctctgatcgaggacctccagaatgatctgctgagtcactcaggtatgctggaccattcacactcacccatggagacttccgagacccagtttgctgcaggtactccctgtctgtctctcgacctgtcagactcaaacttggacaacatggagtggttggacattaccatgcccaactcctcttcaggactcactcctctcagcaccaccgcgccgagcatgttctctgctgactttctagacccacaggacctaccgctgccatgggactaacgtcacagatttcttttctgagagttgatgaggtttaagaacatgaagattctaaaaggtcagtttttagagatagatctatagttgcattgttgcaatcaaaatatgttgtcacagaaagaataggtggaaggtcatagcctggaacccaagtttgaaaacatttcattgtgttcagtagtgaatttctacagttta

SEQ ID NO: 1295 - DNA, 2180 bp, Homo sapiens
gtatttgcaggtcaagctgggaactaaagggtaatggctgccttcagctgcttaaagacataattggccagtgattggggtattgtggggagcaaccagggacccagggaccagagtgttctgcgcaccgcacttcgctcttctgcaaattaagcttttctcctgcttgatgctgcctgtcttcagaagcctctcaccatgatcgatagctccaagaagcagcaacagggcttcccagagattttaactgctggggattttgaaccattaaaagaaaaggaatgccttgaggggagcaaccagaaaagtctcaaggaagtgctccagctgaggctgcaacaaaggaggacgagagaacaactagtggaccagggcatcatgccacctttgaagagcccagcggcattccatgaacagataaaaagcttggaacgagccagaactgaaaactttttgaaacacaagattcggagtcgaccagatcgttctgaacttgtcaggatgcacattttagaagaaacatttgcagagccatccctgcaggctactcagatgaagttgaaaagagctcgactagcagatgatctgaatgaaaagattgctcaaagacctggtcctatggagctggtagagaaaaacatccttcctgtggactccagtgttaaagaagcaattataggcgttgggaaggaggactatccccacactcagggcgatttctcatttgatgaagacagcagtgacgctttgtctccggaccagcctgcgagtcaggagtcacaggggtcagccgcgtccccaagtgagccaaaagttagtgaatcgccatctcctgtgactacaaacactccagcgcagtttgcttcagtgtccccaacagttcctgaattcttgaaaactcctccaactgcagatcagcctcccccacggcctgcagctcctgtcctccccacaaacactgtgtcctcagcaaagcctggcccagcactggtgaagcaaagccatcccaagaatccaaatgacaaacaccgtagcaaaaagtgcaaagatcccaaaccacgggtaaagaagttaaagtaccaccaatacattccaccagatcagaagggtgagaagaatgagccgcagatggactctaactacgcccgcctgctccagcagcagcagctgttcctgcaactgcagatcctgagtcagcagaagcagcactacaactaccagaccatcctgcctgcaccattcaagtacggcggggcccatgctatcctcaacgcggggttttctgtgtttatgaggaactataagttaccaaaagttgaatgttgtcatttatttgtgctcagtaatgattttcatttctttgttatcagagcttatcacacagtgtctgaagtccacatggtgagagtggcctgcattccattccagtttctgtcctccaaaataggttctgaatttttacaagttagaaatgccttttcacaattattcatccagatttgcctattattagaacaccaaaatagtactagatgctctgagaaaagcgtaagtagtataatacctggcataaacagctaaaagaagagaaggatgggcatgaaagctggagtggtcaaaggaaagcctggtggaaaagacaggatctttgtatatagaaggctcgagaagggcctttccaggcacaggggaatgctgtgagcactagtacagaggaaggaatagagtaagtagtgcctcttcattggaaggtgagaaaaattgcctaaacaaagaatctgattaatttttaagtaaaaagtggaagacaaaaatcgagtacagccaatgtctaaggggacttgaagctgggcagaagaccttactcaacacagcagatagacaacggagtgcttcagagcaggctgctgacgcagtgaggccaaaatataagaaaaaacagctggatgctggtgttgaagggacgtctggagacaatgaagagctctggcagcagagtgagtgtttcagaagacagttaaaggccttggtgacgaacaactgcggagaaggaaggtgttttcaaagtttgaacccaactgtgggggacggaagggagtgaattctgacaatttctgaaactgaattcacagcaagacatcaatggctaattttaattacgtaataaagaaaatttctgg

SEQ ID NO: 1296 - DNA, 8643 bp, Homo sapiens
gtttgcggtttagaccccaaagattcctgttggtggtctgggtcacaggaggcaggtttcgggagctggaaatgtgagcgggtacgacaggcaccgcgggtaaccgacgccccgggtccttgctgcagccgggtacgcgggataccggcaccccgccttctccgcccgagtgctgccaggcgtgggcctggaatctcttcacaccttctctttggagcccttaatgatacgacgaaccccaagtgtttcagaacatgaagtaaacaatggagaactgttctgctgcatcgacgttcctgactgacagcttagagctggagctggggacggaatggtgcaaacctccttacttttcttgtgctgttgacaacagaggaggaggaaaacatttttctggagaatcctacctctgcagcggagcccttaagcgattgattttgaatcttgaccctttaccaactaattttgaagaagataccttggaaatatttggcattcagtgggttactgaaacagcattagtgaattcatctagagaactctttcatttattcaggcaacaactgtacaacttggaaaccttgttacagtccagttgtgattttgggaaggtatcaactctacactgcaaagcagacaatattaggcagcagtgtgtactatttctccattatgttaaagttttcatcttcaggtatctgaaagtacagaatgctgagagtcatgttcctgtccatccttatgaggctttggaggctcagcttccctcagtgttgattgatgagcttcatggattactcttgtatattggacacctatctgaacttcccagtgttaatataggagcatttgtaaatcaaaaccagattaagctttttccaccgtcatggcatttattacatctccacttggatatacattggctggtgctagaaattctttacatgctgggtgaaaaattgaaacaagttgtatatggtcatcagtttatgaatctggcaagtgacaatttaaccaacatcagcctatttgaagaacattgtgaaactctcctttgtgatttaataagcctgtcactcaacaggtacgacaaggttaggtcttctgaatcattaatgagtgaccagtgtccatgtttatgcattaaagaattatgggttctacttattcatcttctagaccacagaagtaaatggtttgtctcggaatcattttggaactggttgaataaactacttaaaacactgcttgaaaaatcaagtgaccgaagaagatcctctatgcctgtaatccagtccagggatccattaggttttagttggtggattattactcatgtagcatcattttacaagtttgatcgccatggagtaccagatgaaatgagaaaagtggaatcaaattggaactttgtagaagaactgctgaaaaagtccatcagtgttcagggtgtcattctagaagaacaattacgaatgtatcttcactgttgtttgacactttgtgatttctgggagccaaacattgcaattgttaccattttatgggaatattatagtaagaacctgaatagttccttcagtatttcttggcttccttttaaaggccttgctaataccatgaagtcacccttgtctatgcttgaaatggtgaagacttgctgttgcgataaacaagatcaggaactatataaatccagcagtagttatactatttttctttgtattctggcaaaagttgttaaaaaagcaatgaagagcaatggccctcatccttggaaacaagtcaaaggaagaatatattcaaaattccatcaaaaaagaatggaagaactaactgaagttggtctacagaacttttttagcctttttctactgttagcagctgttgcagaggtagaagatgttgcaagtcatgttttagacctcctgaatttcctcaagcctgcttttgtaacgtctcagagagccctcatttggaagggtcacatggccttcctcttgatgtatgcccagaaaaatctggacattggtgttttggctgagaaattttcatgtgctttccgggagaaagcaaaggaattcttggtgtctaagaatgaggaaatggtacagagacagactatctggacccttctttccatatacattgatggtgttcaagaagtgtttgagaccagctattgcttgtatccttcccatgaaaaactgcttaatgatggatttagtatgcttctgcgagcatgtcgagaatctgaacttaggacagtattgagcttcctacaagctgttctggccagaatcaggagtatgcatcaacaattgtgtcaggaacttcaaagggacaatgtggacctatttgtacagtcttcattatcggctaaagagcgccaccttgctgcagttgccagtgcactgtggagacatttcttttcatttttgaagagtcagagaatgtcacaggtagtgcctttctcacaacttgcggatgcagctgcagactttactttgctagcaatggacatgccaagcacagctccatcagattttcagcctcagccagttatatcaattattcaactttttggttgggatgatatcatctgccctcaagttgtagcaagatatttaagtcatgtcctacaaaatagcacattatgtgaagcactttctcattcaggctatgtatcttttcaagccttaaccgtaagatcatggattcgttgtgttttgcaaatgtatattaaaaacctctctgggcctgatgatttgctcatagataaaaatctggaagaggcagttgaaaaagagtacatgaaacagttggtcaaactgacaagattactatttaatctctcagaagtaaagagtattttctcaaaggcccaagttgaatatttatccatctcagaagaccctaaaaaagcacttgttcgattctttgaggctgttggtgtaacttacgggaacgtccagacactttctgataaatctgccatggtcacaaagtccttggaataccttggtgaagtattaaaatatattaagccttatttgggaaaaaaagttttcagtgcagggctgcagctgacttatggaatgatgggaattcttgtgaaatcatgggcacaaatctttgccacttctaaagcccaaaaattactattccggatcatagattgtttactgctgccacatgcagtattacagcaagagaaggaactgcctgcacctatgttgtcagcaattcagaaaagtcttcctttgtatctccagggcatgtgtatcgtgtgttgtcaatctcaaaatccgaatgcctatttgaatcaattgctagggaatgttattgagcagtatattgggcgatttcttccagcttcaccatatgtttcagatcttggacaacatcctgttttgctggcattgagaaacacagccactattccaccaatatcatctctaaagaaatgcattgtgcaagtcataaggaaatcctaccttgagtataaggggtcctcacctcctcctcgcttagcatccattctggccttcatcctccaactcttcaaggaaactaacacagacatttatgaagttgaactactcctccctggcattttaaaatgcttggtgttagtcagtgaaccacaagttaaaaggctggccacagagaacctgcaatacatggtaaaagcctgccaagtggggtcagaagaagaaccttcctcccagctgacttctgtgtttaggcagtttatccaggattatggtatgaggtactattaccaggtttacagcattttagaaacagtagcaacattggaccagcaggttgtcatccacttgatttctacccttactcagtctctgaaggattcagagcagaaatggggccttggcaggaatatagcacaaagggaagcctatagcaaacttttgtctcaccttggacagatgggacaagatgagatgcagagactggaaaatgataatacttaatatattttgtgattcatcctgtctattaattatcagtatctaaagccacattgttccactctaattcctacttttaattaattgtataatgttctgtttaaaataatttctaggattttttttccttttatatctgtaagtaaaaaatgtataaataaggaactgaaggttaattagcaactgtgtaataggatccttggaactttttacaaaactgcattctaccttgatgaaattttagttaaactaaattaaagaaacattttctgagagtgttttctgtgtgtgagtattaagcagatacttcatccatagactttttgttgtagtatgacttcctgcctccctgccttgtgactgatttgtcatgtttattttttatttttacaataatagttatgttttaaaatgatactttttcaaagtacctggctaccctatactgtgtttttggtgggggaaaggtgttgggaaatgtgactgtgtatttgtttttcttttttatatgtgtgaggcaagttaacaaagaaaacccttacaaagcacacttaactgtgttaggaatgagactgaatctggctaaaggattatacagctgatatccaaaaagaagtgtaaacatgccaacagggtttatatttaggttccaagagttgccaaattttttttttattcatcctttcttttggagttgtcattaaaaaaaaaatcatatcaggaggaggaaataaaggagactttaagaggagagtaaataaaaatattctagaaaagtaacaatagtagtggtctgagaagtcagctgatccatcttcttgctctttagccagagcttcttataacttagcattttatccaagaaacctgtttagtttcctttaacaacattgtttctcaacttttgaactcttaactcatccagattgttttaccagttggagcttgtccttgactccttttcctattgagcattatttggttgaaagagctccagtcctagttttgggaacccacctgggtctcaaactcagctttgctttatgatcttgagctagttacgtaacctttctcagtctagtttcttcatggagaagaaaagaagaatccctttactatttgacagtgttgttgtgagaatcaatgggataatgtacgtgaaaatatttggtggcccaaattctgttgggaaatgtacagacacgattagtttattactcgtgcacaattaaggcaaagaacacctctcaattttatctttctctaatgatatgtcccagatgaatgatcccactttccaatgttttcttacatcatgttttctaactttgaagtactttgtttccttcttgggattatagtctttatcatggttctactcttccttcaagaaaacatttcaacccttctctggctcaaggagtatctttaaaaatgaaatactttgcaatcagtattctgtagttaatagcgttctcttaattataatctgtgaaatccaaaggagtgtctgttattttcataacatataaatggtccttctctcaaatcagcttcatcaaagggaataaatgaaagcttaaggctgtttaatagacttcataacactgaatttcttttcatcatgatagtgacttactaaacaaataatgtatggcttggaaagttccagcagtcactaaggagttttatctatttaaggtgatgcctttaaagaggttatttatgtgtatatgtgtttttgtgtgtgtgtgtgtgtgtgtgtgtgtgtgtgtgtgtgtgtgggttttttttttccaaaggagattgataaagatacctttgagaatcttgctccttagagtatgaaaacgtttaaaggataggaaaagctgctactgaatcatgctttaggacatatatctatagatactaagaataactaaaatttgtacttaagaatggtaacaacaaagtgtgtaacaatatgtgtgtgtattatatgttttgtatttatgtataagtaactttttttaaagcttttttttaaattgaaaaaagaagaaaatttatggctcagttccttttttttaaaatcttcactgatccttcacttattactacaatcttgccctctttcattcccagacttggagtcccttatacctgcttctttaatagccactttccctaaataccctgtaatttctgaggctgctgcttctaccagtgtaatacaagccattgtcttttggtcaaatctgagtttgttctcctttctcatgttctttgtcctctctgtgacaattgtattttcttttatcttcccatcatttccacaatggtactgctccttcctacatatacagttgacccttgagcaacacaagtttgaactgtgcaggtccacttatatgtggatctaaaatacagtatttgtgggatgcaaaatctgagtatatggaggaccaactttttgtagaggcaggttcctcagggttaactgcaggacttgagtaagtgcagattatggtatgcacaggggatcctggaaccagtccccagaccaaaaatgaccactgtatcttgagagcaccttcatggtcttctttcctgtccccagtcgtaagatacgacccttcatctgctttgtctcaacattctgttagtggtgaactgataactccagcttttctctctctttttttttttttttttttttttgttgttgttgttgttgttgttttgaggcagagtcttgctctgtcgcccaggctggagtgcagtggcacgatctcggctcactgcaagctctgcctcccgggttcacgccattctcctgcctcagcctcccaagtagctgggactacaggtgcccgccaccacgcccggctaattttttttgtatttttagtagagacggggtttcaccatgttgggctcgatctcctgacctcatgatccgcccgcctcggcctcccaaagtgctgggattacaggcgtgatgagccacctagtgctaattcatctctaaacctctgtagttggagtctcctgaaatctcagactacctcctgctttcattttctacccagggaatacactattgtcctaagttatttagccttgaaatgtcagaggcattttaggttcttcatgtttctcccactttcagttgattaccattacaggatcttaggcttctttttatctttttgcagtgccttgcatccactggttgtttgttttttctgttgggcactacttatttccttacctctggtttcttctcctacagcttatgttctgaaatgtgtattcctaaaatactgttttcctcttgttacttttctgctcgaggacttccagtaacttaccattgtttataaggtgatgttcaaacccttcagtctggagactttctgccacctatctgactgtacctttatcttcaagcttatctctttccaaacaagaggctcatttagcagctttctctgattgccatgttcatcctacactcagcctcattcagtttacagcatggaaactgtataggacctctttcctatagaaattgaagacacttaaataggaagaaaattaaaatatacatttggatacatgagtattccagtcaaataatatctataaaataccagatagagtataaaagacaactgaaggacaacagagtgatgaaaggactttattaggcatttggatttggttatgatttaaatttcaatttaattagaacgtttccatggcaaggaaggaagcatggaggactgtggaaaagtcattcagtattgagttcatttgcattagaggaatttcatagtttaaaacttgtatatctttacctatccttcgtatgttttcttcttaagcatatttgactttttctacctcagcatctgtataagaaaatatttgtgagtcagatgtttgtgggttttccttacctattattattttcttccatgctttacaacacattttttaaactaccttgttcttaaataattacacggacctgcttctgtgtactttcacagaatctttgacagttaaaaattgtatgttatataaaaatttgacaagcttctacagttaggaaaagcctttagaaatctgccttccccaaaccgtatgttatcatagcactcatgtctccccatgtctaaaaggtaaatagatacagaaacctcaccaaaagttgaatcatctgtactaaaccactgcttttttatccagactttttatataaatcttttattttccaaaaaactgatcttttacctacccctcttagagttaaaaatattgcctgtcaggcaagagtatagtatgccaatataaataatatgctttatttggttagaaacagttggtttgggaagctagcaacatagcatattctttacaaatttaataaggtgtattttgatactgtgataacctgcattgtaaattaccaaatggttggaattgaccagtttatacttattaaaatttttgatgtgccaatggctatccaattcattgcatttgtgaattgtgcttttagaaaaattgtggacattttagttttatatacatatttatgagttatttgtgcatatgataaaattatatataataataaaagtatatatgtaactta

SEQ ID NO: 1297 - DNA, 1824 bp, Homo sapiens
gaactttctggaaaattaacagtgcgtatttgcctgaagaaggtcagtgtgcttgcttggagatcaggacgcaaaggtcaccatcagaaaagctaagtttgctgtatagtgaggatcaggagatctgatcctgattgcagaaccttccctgattacagaatcttgggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaagt

SEQ ID NO: 1298 - DNA, 1808 bp, Homo sapiens
actatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttgggattgttgagaggattacatgtaaagtaccaggacagtgcatggcacatgttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagc

SEQ ID NO: 1299 - DNA, 2744 bp, Homo sapiens
ttcttggaacgctcatcatctttggcatccaaaataacattcttctaattctgttatggctactcttaacatttttgtttcatttgtggtctctgtgcatcccttaaatgcctttcgtccttaggttttccagaattccatacttgaagttcttcctctcttctccctgatttcattggccctcgtagtgtccactaccagctatgtgatgttactctcagatctccatttctggcttttacttctcacccgagctttatttttttttttttgttttgggttgtggggtgggtacccagttagctggacaaaactgagctttacaattttatgtttaactgtacatctcacacacaataggcccaacacaacttttcctccaatccattttctccacctgtaaatggaggagtattatcatttggtgataatactaataacctaatcacccatacctgggagtcatcactgactcctccctcaccaatcttttttttaccttcttaaacaatcactgacagtggtgtcatgtaccatttcttgtgtctgctcccaaactattttgtgcctataactgtcattatactaaccttatcgttttataattgtcactttagatatttggatctctagcaactaccatagtacttgtcccaaagcagatatgcagtaatgtataatgacaaactgaatagattaatgaatggatgaattacctatgttctgtcattttatttctgattccaaactaaaccctaaattcagtgctttcattaagttcattaattacccaggcttgaaattgcagattcctccctcctttggttactatattcttcatgatttctgtattcttcagtttctcttgactctgtcatcatcctaattcaggcctttctggactaatacaagaacctttactgttactcattttgcccttagtcaattaaatataaccttccctattccatattgtcatttctcctgttcaaaagtcttaaatttcaactccactgtcttttatagtttttcatttaattccttctttcttgaaaattgctttcctatcttgtgagtggcatcaacagagtaatttatgggtagttgtgatgagtatttgggtgagatgagagtagtggctggtagtgaggatcagagagagggaaaggaggtaaaaaaataaaaaatcacttataaagggtcctgaaataggatttgaaatccagattttaagggagttagaatgtgttattctctgatgggcctttatgaaacatagttaaaggttgccatagaaaacaaccaagtaaaatattttatatattacagtggttggaataaaaacagggttgaatgagttccagaaagcagggttctcaacctcgtggacagcaatctgcagaagaagagaacccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagc

SEQ ID NO: 1300 - DNA, 849 bp, Homo sapiens
gcgtatttgcctgaagaaggtcagtgtgcttgcttggagatcaggacgcaaaggtcaccatcagaaaagctaagtttgctgtatagtgaggatcaggagatctgatcctgattgcagaaccttccctgattacagaatcttgggattgttgagaggattacatgtaaagtaccaggacagtgcatggcacatgttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatat

SEQ ID NO: 1301 - DNA, 2032 bp, Homo sapiens
ttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttgggattgttgagaggattacatgtaaagtaccaggacagtgcatggcacatatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagc

SEQ ID NO: 1302 - DNA, 562 bp, Homo sapiens
ggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttgggattgttgagaggattacatgtaaagtaccaggacagtgcatggcacatatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccc

SEQ ID NO: 1303 - DNA, 2749 bp, Homo sapiens
accaatgaaataatttgttatttgggaattgcctcaaaatagcagagattgtaattttcctatattgaaaagttaaataaaaggtggggggggggggagtgcaagaaagaaagagatggagaacgagagcgagctggagatgaaccacatgcgatgagtaggccttgtttggatcctgaatcgaacacaccaactgtaaaaatatgtttaagacgcatcgggaaaattgggacacggattcgatatttgatgttttttagggaattgatgtcagtttttttaggcgtcacagtagtattgtgattatgttttcaaattgtccttttttgtagagacatacgaaaatatttacggattaaataatgtctgggattggcttctaaatacattaatgactaggatttgcttcaaaataatctcagcggtagggggaaatggggaggggtatagatgaaacaaaattggccctaaattaataatatttttttgctgagtgataggcagtgggttgcgtatattaatctgctttccttggtatacgtttaaatttttctataataaaatacagaagtcagatattccggtgagcttgaaaaagtcgggggtgggggggagcagtgggtggggttatagatgaaacaagatggccttcagttggtaattgttgaaagctggatgatggattcgtgtaggtttataatactatttcttttttatttcatccatttgaaattatatttaaggaaagttaaaaaacaaatttgtcagaaattatacaaatgtacaataaattaaatttgaaaatgtggccacaagaaaggaaaaagaaacacttgtacattatttatcagctttggtgtcctttgtgtgtgatgaaattgcattggctgatgtagaagaaagccatatctcatatctttttattttatgttctttcttgtccttttgtttgaccttctaggtcaccatcagaaaagctaagtttgctgtatagtgaggatcaggagatctgatcctgattgcagaaccttccctgattacagaatcttgggatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttc

SEQ ID NO: 1304 - DNA, 2014 bp, Homo sapiens
aaaatcccagaatcccagggaccaaacagccaatcctttgctgggatttggcggcatctagtggcagactcgagaggtataaaccttactcacagaactttctggaaaattaacagtgcgtatttgcctgaagaaggtcagtgtgcttgcttggagatcaggacgcaaaggtcaccatcagaaaagctaagtttgctgtatagtgaggatcaggagatctgatcctgattgcagaaccttccctgattacagaatcttgggattgttgagaggattacatgtaaagtaccaggacagtgcatggcacatatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagc

SEQ ID NO: 1305 - DNA, 899 bp, Homo sapiens
tatttgcctgaagaaggtcagtgtgcttgcttggagatcaggacgcaaaggtcaccatcagaaaagctaagtttgctgtatagtgaggatcaggagatctgatcctgattgcagaaccttccctgattacagaatcttgggattgttgagaggattacatgtaaagtaccaggacagtgcatggcacatatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgc

SEQ ID NO: 1306 - DNA, 1828 bp, Homo sapiens
cacgtcggctgctgggaagatctggattctcgtttcaggtcaccatcagaaaagctaagtttgctgtatagtgaggatcaggagatctgatcctgattgcagaaccttccctgattacagaatcttggatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttc

SEQ ID NO: 1307 - DNA, 869 bp, Homo sapiens
acctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttgggattgttgagaggattacatgtaaagtaccaggacagtgcatggcacatatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaatt

SEQ ID NO: 1308 - DNA, 1885 bp, Homo sapiens
ttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttggcatagttaaaggttgccatagaaaacaaccaagtaaaatattttatatattacagtggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctctttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagc

SEQ ID NO: 1309 - DNA, 2484 bp, Homo sapiens
aggtcaggggcgtggcgaaggtcgctgctttcctgctacaacgggcctactttagctaaaacagaaacgtaaggccaggacgggtcaccctttgtgggcccctgaaaaatacaaaacgaagtttggagagagttgaaaggcgtttgggctgaccatggagatttttgtttcccaccctcctgcgaaagcgctcgcgctgccattggctctggctgagggcgagtccggaacctgtgcgccgcggaactttcggctctgaaatccaagttgcgctgggcgcatctttgccgcgcggtttccgggcggctcccttcccttgcatgctgcattgtgtcgggagttgctgacagccatggcgccgcaggtctggcgtcgacggaccctggagcggtgtctgacggaagtcggcaaagccacgggtcggcccgagtgcttcctcacgattcaagagggattggcatcaaagttcacttctttaacaaaagtgctttatgactttaataaaatattagagaatggtaggatccatggaagccccttgcaaaaacttgtgatagaaaattttgatgatgagcagatttggcaacaactggaattgcaaaatgaaccaattttacaatactttcagaatgcagttagtgaaacaattaatgatgaagatatcagtcttctcccagagagtgaagaacaggaacgtgaagaggatggttcagagatagaggctgatgacaaggaggacctagaagatttagaggaggaggaagtgtccgacatgggtaatgatgatcctgaaatgggtgagagagctgaaaactcaagcaaatctgatctgaggaaaagccccgttttcagtgatgaggattctgaccttgactttgatatcagcaaattggaacagcagagcaaggtgcaaaacaaaggacagggaaaaccaagagaaaagtccatagtagatgataaattcttcaaactctctgaaatggaggcctatttagaaaacatagaaaaagaagaggaacgaaaagatgataatgatgaggaggaggaagatattgatttttttgaagatattgattctgatgaagatgaagggggactgtttggaagtaaaaaacttaagtcaggtaaaagttccagaaatctgaaatacaaagatttttttgatccagttgaaagtgatgaagacataacaaatgttcatgatgatgagctggattcaaacaaagaagatgatgaaattgctgaagaagaagcagaagaactaagtatttcggaaacggatgaagatgatgaccttcaagaaaatgaagacaataaacaacataaagaaagcttgaaaagagtgacctttgctttaccagatgatgcggaaactgaagatacaggtgttttaaatgtaaagaaaaattctgatgaagttaaatcctcctttgaaaaaagacaggaaaagatgaatgaaaaaattgcatctttagaaaaagagttgttagaaaaaaagccgtggcagcttcagggggaagtgacagcacagaagaggccagagaacagcctcctggaggagaccctacactttgaccatgctgtccggatggcacctgtgattacagaggaaaccacccttcaactggaagatatcattaaacagaggataagagatcaggcttgggatgatgtagtacgtaaagaaaaacctaaagaggatgcatatgaatataaaaagcgtttaaccttagaccatgagaagagtaaattgagccttgctgaaatttatgaacaggagtacatcaaactcaaccagcaaaaaacagcagaagaagaaaatccagaacatgtagaaattcagaagatgatggattccctcttcttaaaattggatgccctctcaaacttccactttatccctaaaccgcctgtaccagagattaaagttgtgtcaaatctgccagccataaccatggaggaagtagccccagtgagtgttagtgatgcagctctcctggccccagaggagatcaaggagaaaaataaagctggagatataaaaacagctgctgaaaaaacagctacagacaagaaacgagagcgaaggaaaaagaaatatcaaaagcgtatgaaaataaaagagaaggagaagcggagaaaactgcttgaaaagagcagtgtagatcaagcagggaaatacagcaaaacagtagcttcggagaagttaaaacagctgaccaaaactggcaaagcttccttcataaaggatgaaggtaaagacaaggccttaaagtcctctcaagcattcttttctaaattacaagatcaagtaaaaatgcaaatcaatgatgcaaagaaaacagaaaagaaaaagaagaaaagacaggatatttctgttcataaattaaagctgtaatatattttgaatataatgtaaatattaatgtgtaagcttatattgtgtcattgttctgttttataataaaattcttgagaaccttc

SEQ ID NO: 1310 - DNA, 2315 bp, Homo sapiens
tcccggcatgcaccgcgccgcgggctccgcctccgcgggaccacagagctgggatagcgcgcgaggccctcggtcggacgggacgctcgggattcagggactgcctcggcacacgggaagttgccctacaggcgcgggagaaagcgcaggcggcggcttggcagggagaggcaggctgcagtgcacattgggtcaggcacacgcgaggggcagcccccgagggccgtcccagagtcccccgcgccgccggggtcctaacggggtgcaccgtcttccgccgcacgtggattcagcgcgatgcccaaatccaagcgcgacaagaaagtctccttaaccaaaactgccaagaaaggcttggaattgaaacaaaacctgatagaagagcttcggaaatgtgtggacacctacaagtaccttttcatcttctctgtggccaacatgaggaacagcaagctgaaggacatccggaacgcctggaagcacagccggatgttctttggcaaaaacaaggtgatgatggtggccttgggtcggagcccatctgatgaatacaaagacaacctgcaccaggtcagcaaaaggttgaggggtgaggtgggtctcctgttcaccaaccgcacaaaggaggaggtgaatgagtggttcacgaaatacacagaaatggactacgcccgagctggtaacaaagcagctttcactgtgagcctggatccagggcccctggagcagttcccccactccatggagccacagctcaggcagctgggcctgcccaccgccctcaagagaggtgtggtgactctgctgtctgactacgaggtgtgcaaggagggcgatgtgctgaccccagagcaggctcgcgtcctgaagctttttgggtatgagatggctgaattcaaggtgaccatcaaatacatgtgggattcacagtcgggaaggttccagcagatgggagacgacttgccagagagcgcatctgagtccacagaagagtcagactcagaagatgatgactgaaagggactcgggactgaaggtctcctggaagcttctgggtctcactggaccatcaggactgctgccgcccctctggagagagcagctttttatttgtctgtagacagggaacatgatgggcactgacctcctgtaaagaataaaactgtgggccgggcgcggtggctcacgcctggaatcccagcactttgggaagccgaggtgggcagatcataaggtcgggagattaagaccatcctggctaacacggtgaaaccccgtctctactaaaaatagaaaaaaaaactagttgggcatagtggcatgtgcctgtagtcccagctactcaggaggctgaggcaggagaatcacttgaacccgggaggtggaggttgccgtgagttgagattggaccactgctctccagcctgggcaacagagtaaaactctgtcccaaaaaaaaaaaaagaatacaaccttgcaggatgtctctcctggagacagcaagagggagaggagggagagggctctttcttagaaaagaggcctttggtgagcccagaagtttgaaaccagcctgggcaattcagcaagatcccgtctctacaaaaaataaaaaaaaattagtcgtggtgccacttgcctgtggtccccactgcttgggaggctgaggtgggagaattgcttaagcctgagagttggaggctcagtgagccatgatcatgccactgcactccagcctgggtggccattgaattctgcgtggattgcctcagtttgccttgtcagccaacttccactggctgccttggcactgccatgacagcacagctccacaccagagctggggtttctcttcagtcctgggtaccccttggcagagggatttgctgaggaaaattaggtatccttcctagccctccacacacttccaaaccagggctgcggatctgatggatgccaggaagacagccttgggctgagagtgacatcactgcaagagttgagagccagcgtctaaagtgtccacggcatcctgggaggttttatccttggtgactctaatggtagatttttgtccaccttgttctatttgcttttgtttgtttttgatttttctgttttaaaattttaaggagagatggggtttcaccatgttgcccaggctggtctcaaactcctgagctcaagcgatctacccaccttggcctcccaaagtgctgggattataggtgtgagccaccgcatccagcccacattgttctatttgtatttcatgaaagcagttctgaatgagagtaaatcagcttcagggtgta

SEQ ID NO: 1311 - DNA, 2023 bp, Homo sapiens
tttgttccaaggagtacagatagccttttcaaaaggcgcagcttaccgcggtgcgcgcggattctggacttgggcgccaactcgtagtccacgctccccggggtcagcagaggggcgctcacgctctcgccacccacctcgctttctcaccccgcgcttcccggcctgggtttttagtcttccttggagcgctctctggcctccgcctccgccagggagcggaaggcggagacagcgagactggccaggggggaggaaagaggacgcgtgtgggcaagggggacaacgggatgtccacgggctcggtgagtgatccggaggagatggagcttcgggggctgcagcgggagtacccggtccccgcctccaagaggccgcccctccgcggcgtagagcgcagctacgcctcgcccagtgacaactcgtcggcagaggaggaggaccccgacggcgaggaggagcgctgcgctctgggcacagccggcagcgcggaaggctgcaagaggaagcggccccgtgtggctgggggcggcggcgcaggtggtagcgcgggcggtggtggcaagaagcccctcccggccaagggctcagccgcagagtgcaagcagtcgcagcggaacgcggccaacgcccgtgagcgtgcccggatgcgcgtgctgagcaaagccttctccaggctcaagaccagcctgccctgggtgccccccgacactaagctctccaagctggacacgctccggctggcttccagttacatcgctcacctgcggcagctgttgcaggaggaccgctatgagaacggctacgtgcacccagtgaacctgacatggccattcgtggtctcgggaagaccggactctgacaccaaagaagtttccgcagccaacagactatgtggaaccaccgcttaaatcggactggaactcacttgatgggattattcgttaaatgcgagtgtttgggggccacggagagaagggagagctcgtgagatgggaagaagtttccgctggattctccttgacccttcccctttccctggaactgtgatcgtgacaggtggcgggtgtggctgtcactgcacagcgcccacggctacagctgcgccggatctgggcgaccacgttttgcctctccaaaaagagcttcctttcgtgacgagacgcggacgcaggtccaccctcgggccctagctctgtagactaactctcggctgctgccccagcccgcgccagacagcccacggatccgttctcagcggagccagattcatcgcacacgtgcgggacggttccacacagccccggcctttcgcggtgacacaatggttagggaacggttagaacgcgctctacatccgctttaaagacagaggtctagacgtgagatccgcgtcgggacagggttttaagtgacaaagaagggcgagtggcttctctgggccgggttcgtactccagcacagcgcccttctaacgggcgggaggaaggccgctgctcgcagggctaggtggagacacacttcccagatcaccgcaggcgggttttacccggagagctctgggccgttcggcctccctgccgggtggcttcttcaatcccgtctccttcccaagctcccggctttttctaatcaggcaggcgtctgtcaaccctctccacttctgggctgaagcctccccaagccccgctgcgccaacctgtgtggggtcttcttcgggcctccctctccgccccgctcctgctcctacctgcagcacccccagctccgactccagactctctgcatcaggtctccccactccacgctccgggcgccccaactccaacaccacgtcctgccgcgcaggttcttccccgcgcggaggagcgcgcagggtgggcggcttaccatagcaagtgatcctgcgatagggaacgcgcccttgccccgaggctgcactaccacaggaaataacatatgtaaataaatttatttttttatgaataataaaacgcgctgtaaaaaccgtgtgccccttgga

SEQ ID NO: 1312 - DNA, 721 bp, Homo sapiens
gggtctctgcagccatctgctttcatcagggctgcagcccccaggcagcagtactgggagcccctctcatctccgagaataaactctgaagccagcgaccctgcggacctgaatcatcagggagcctgtcagaggaggggcagtgactctgcgggacaagcaagcaggctatataagtttcagaaggctgggctccactcagatcttttccagcagctgctgcctgccagagaggcgccttcagagacccagcgcttacacaatacccaccatgtcccaggctggtgctcaggaagcccctatcaagaagaagcgcccccctgtgaaggacgaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagcctttcccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagc

SEQ ID NO: 1313 - DNA, 2708 bp, Homo sapiens
gcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccagcaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 1314 - DNA, 2669 bp, Homo sapiens
gcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacacccccaggagatttaagatttaccccgattccactgctgatcccctcccaggttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccagcaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 1315 - DNA, 2823 bp, Homo sapiens
agcggttaggagggcggggcgcgtgcgcgcgcacctcgctcacgcgccggcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacacccccaggagatttaagatttaccccgattccactgctgatcccctcccaggttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttg

SEQ ID NO: 1316 - DNA, 2775 bp, Homo sapiens
ggttaggagggcggggcgcgtgcgcgcgcacctcgctcacgcgccggcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 1317 - DNA, 3094 bp, Homo sapiens
agcggttaggagggcggggcgcgtgcgcgcgcacctcgctcacgcgccggcgcgctccttttgcaggctcgtggcggtcggtcagcggggcgttctcccacctgtagcgactcaggttactgaaaaggcgggaaaacgctgcgatggcggcagctgggggaggaggaagataagcgcgtgaggctggggtcctggcgcgtggttggcagaggcagagacataagacgtgcacgactcgccccacagggccctcagaccccttccttccaaaggagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaagatattgtttctttagtctcaaaacaagagactaggaaagatccaaaacacagagcaggagtccacaggggaacctgccctgcctcagtaaaaatacagtgttgttgctgtaggaagactcccggattctaccccaggatacttcatgagaacgaacc

SEQ ID NO: 1318 - DNA, 2348 bp, Homo sapiens
agcggttaggagggcggggcgcgtgcgcgcgcacctcgctcacgcgccggcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttggattggccaagggtttcaggacaggaaggaggtgattga

SEQ ID NO: 1319 - DNA, 1000 bp, Homo sapiens
aaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtatacttatctcctcaggtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctggggg

SEQ ID NO: 1320 - DNA, 2704 bp, Homo sapiens
gtgatagaaatcatatagaaatacagaaaattgcttgatatttcccccactcttttttttttgagacagagtcttgctctgtcaccaggctggagtgcagtggcacaatcttggctcactgcaacctccacctcccgggttgggtttcaagtgattctcctgcctcagcctcccgagtagctgggactataggcgtgtgccaccatgcctggctaatttttgtatttttagtagagacagggtttcaccatgatggccaggatggtcttgatctcttgacctcgtgatccacccgcctcggcctcccaaagtgctgggattacaggtgtgagccaccgcgcccggccctgatagccaatgaggtttttttgtcattgttcttcttgtatcattacagactcatggccttttgtagctatatttctctttctcccgactctgtacaaactcctttgttttagagtttgcacaaccctctatcaaagcacctaccacctcacttttaaatcttctgcatgtatttctgtcttccttcctagactgtgagcacatctgggacagggaccatatctttttttgtttatttgttttgttttgagacagagtctcgctctgtcggccaggctggagtgcaatggcgtgatctggctataacctccacctcccgggttcaagagattctcctgcctcagcctcccaagtagctggaattacatgtgcatgccaccaagcccagttaatttttgtattttgagtagagacagggtttcaccatgttggtgaggctgatctcgaactcctgacctcaggtgatctacccacctcagcctcccaaagtgctgggattacaggcatgagccactgtgcctggccaggaccatatcttaattgtctttgtagtttcagtgtttggtacagtgcctctcactgtttctttttgcctttgagatcttccctctttgttactgtgatcttccctactggtctttgttcttctgagtctgtccctatcaccacctcaacccgagctggatgtggcctgtcctcctttttgtgtttctctcacagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacttttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacagctgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 1321 - DNA, 2729 bp, Homo sapiens
gcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacttttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacagctgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 1322 - DNA, 2708 bp, Homo sapiens
gcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacttttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccagcaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacagctgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 1323 - DNA, 694 bp, Homo sapiens
gcgccggcgcgctccttttgcaggctcgtggcggtcggtcagcggggcgttctcccacctgtagcgactcagggccctcagaccccttccttccaaaggagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaaga

SEQ ID NO: 1324 - DNA, 694 bp, Homo sapiens; identical to SEQ ID NO: 1323

SEQ ID NO: 1325 - DNA, 2729 bp, Homo sapiens
gcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 1326 - DNA, 694 bp, Homo sapiens; identical to SEQ ID NO: 1323

SEQ ID NO: 1327 - DNA, 1879 bp, Homo sapiens
gactcatctggtgaacatagatcaagacacttacaggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctaga

SEQ ID NO: 1328 - DNA, 2708 bp, Homo sapiens; identical to SEQ ID NO: 1313

SEQ ID NO: 1329 - DNA, 1000 bp, Homo sapiens; identical to SEQ ID NO: 1319

SEQ ID NO: 1330 - DNA, 2708 bp, Homo sapiens; identical to SEQ ID NO: 1313

SEQ ID NO: 1331 - DNA, 2666 bp, Homo sapiens
gcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacacccccaggagatttaagatttaccccgattccactgctgatcccctcccaggttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 1332 - DNA, 2704 bp, Homo sapiens
gtgatagaaatcatatagaaatacagaaaattgcttgatatttcccccactcttttttttttgagacagagtcttgctctgtcaccaggctggagtgcagtggcacaatcttggctcactgcaacctccacctcccgggttgggtttcaagtgattctcctgcctcagcctcccgagtagctgggactataggcgtgtgccaccatgcctggctaatttttgtatttttagtagagacagggtttcaccatgatggccaggatggtcttgatctcttgacctcgtgatccacccgcctcggcctcccaaagtgctgggattacaggtgtgagccaccgcgcccggccctgatagccgatgaggtttttttgtcattgttcttcttgtatcattacagactcatggccttttatagctatatttctctttctcccgactctgtacaaactcctttgttttagagtttgcacaaccctctatcaaagcacctaccacctcacttttaaatcttctgcatgtatttctgtcttccttcctagactgtgagcacatctgggacagggaccatatctttttttgtttatttgttttgttttgagacagagtctcgctctgtcggccaggctggagtgcaatggcgtgatctggctataacctccacctcccgggttcaagagattctcctgcctcagcctcccaagtagctggaattacatgtgcatgccaccaagcccagttaatttttgtattttgagtagagacagggtttcaccatgttggtgaggctgatctcgaactcctgacctcaggtgatctacccacctcagcctcccaaagtgctgggattacaggcatgagccactgtgcctggccaggaccatatcttaattgtctttgtagtttcagtgtttggtacagtgcctctcactgtttctttttgcctttgagatcttccctctttgttactgtgatcttccctactggtctttgttcttctgagtctgtccctatcaccacctcaacccgagctggatgtggcctgtcctcctttttgtgtttctctcacagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 1333 - DNA, 2729 bp, Homo sapiens; identical to SEQ ID NO: 1325

SEQ ID NO: 1334 - DNA, 2884 bp, Homo sapiens
cgctccttttgcaggctcgtggcggtcggtcagcggggcgttctcccacctgtagcgactcaggttactgaaaaggcgggaaaacgctgcgatggcggcagctgggggaggaggaagataagcgcgtgaggctggggtcctggcgcgtggttggcagaggcagagacataagacgtgcacgactcgccccacagggccctcagaccccttccttccaaaggagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 1335 - DNA, 694 bp, Homo sapiens; identical to SEQ ID NO: 1323

SEQ ID NO: 1336 - DNA, 2669 bp, Homo sapiens; identical to SEQ ID NO: 1314

SEQ ID NO: 1337 - DNA, 616 bp, Homo sapiens
actgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 1338 - DNA, 2884 bp, Homo sapiens
cgctccttttgcaggctcgtggcggtcggtcagcggggcgttctcccacctgtagcgactcaggttactgaaaaggcgggaaaacgctgcgatggcggcagctgggggaggaggaagataagcgcgtgaggctggggtcctggcgcgtggttggcagaggcagagacataagacgtgcacgactcgccccacagggccctcagaccccttccttccaaaggagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacttttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacagctgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 1339 - DNA, 2884 bp, Homo sapiens; identical to SEQ ID NO: 1334

SEQ ID NO: 1340 - DNA, 616 bp, Homo sapiens
actgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacagctgctgccacaagggcccctggtgcagtatttggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 1341 - DNA, 2666 bp, Homo sapiens
gcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacacccccaggagatttaagatttaccccgattccactgctgatcccctcccaggttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacttttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacagctgctgccacaagggcccctggtgcagtatttgaccatggagacctgtgaggatggcaacgatcttgtcttcttctatcaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaa

SEQ ID NO: 1342 - DNA, 3986 bp, Homo sapiens
ggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacacccccaggagatttaagatttaccccgattccactgctgatcccctcccaggttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaagatattgtttctttagtctcaaaacaagagactaggaaagatccaaaacacagagcaggagtccacaggggaacctgccctgcctcagtaaaaatacagtgttgttgctgtaggaagactcccggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaagttctccccaagtccactgaacaaggctagttcctgcaccacccaggattcaaaggaaagacgaagggagcagaacttgtggcagcaacaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagcatgtttattgaaactgtccttcagccttaaatacaaaaataaaactgaaactgctccagaaagcagctttctcc

SEQ ID NO: 1343 - DNA, 1879 bp, Homo sapiens; identical to SEQ ID NO: 1327

SEQ ID NO: 1344 - DNA, 944 bp, Homo sapiens
cttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacaggctggagtgcaatggtgcgatctcggctcaatgcaacctctgcctcctgggttcaagcgattctcctgcctcagcctcctgagtaactgggattacaggcacctgccaccacacccagctaatttttgtatttttagtagagacggggtttcaccatgttgcccaggctggtcttgaactcctgacctca

SEQ ID NO: 1345 - DNA, 2348 bp, Homo sapiens
agcggctaggagggcggggcgcgtgcgcgcgcacctcgctcacgcgccggcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacctttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacaactgctgccacaagggcccctggtgcagtatttggattggccaagggtttcaggacaggaaggaggtgattga

SEQ ID NO: 1346 - DNA, 1879 bp, Homo sapiens; identical to SEQ ID NO: 1327

SEQ ID NO: 1347 - DNA, 2348 bp, Homo sapiens; identical to SEQ ID NO: 1345

SEQ ID NO: 1348 - DNA, 944 bp, Homo sapiens
cttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacaggctggagtgcaatggtgcgatctcggctcaatgcaacctctgcctcctgggttcaagcgattctcctgcctcagcctcctgagtaactgggattacaggcacctgccaccacgcccagctaatttttgtatttttagtagagacggggtttcaccatgttgcccaggctggtcttgaactcctgacctca

SEQ ID NO: 1349 - DNA, 944 bp, Homo sapiens; identical to SEQ ID NO: 1348

SEQ ID NO: 1350 - DNA, 1879 bp, Homo sapiens
gactcatctggtgaacatagatcaagacacttacaggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacttttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacagctgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctaga

SEQ ID NO: 1351 - DNA, 3987 bp, Homo sapiens
ggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacacccccaggagatttaagatttaccccgattccactgctgatcccctcccaggttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcaggctatggttcacacgtccgactcatgacctgggggagctcagttctcgtctggacgtcattcagttttttctgctgccccagaatctggacatggctcagatgctgcatcggctcctgggtcacatcaagaacgtgcctctgattctgaaacgcatgaagttgtcccacaccaaggtcagcgactggcaggttctctacaagactgtgtacagtgccctgggcctgagggatgcctgccgctccctgccgcagtccatccagctctttcgggacattgcccaagagttctctgatgacctgcaccatatcgccagcctcattgggaaagtagtggactttgagggcagccttgctgaaaatcgcttcacagtcctccccaacatagatcctgaaattgatgagaaaaagcgaagactgatgggacttcccagtttccttactgaggttgcccgcaaggagctggagaatctggactcccgtattccttcatgcagtgtcatctacatccctctgattggcttccttctttctattccccgcctgccttccatggtagaggccagtgactttgagattaatggactggacttcatgtttctctcagaggagaagctgcactatcgtagtgcccgaaccaaggagctggatgcattgctgggggacctgcactgcgagatccgggaccaggagacgctgctgatgtaccagctacagtgccaggtgctggcacgagcagctgtcttaacccgagtattggaccttgcctcccgcctggacgtcctgctggctcttgccagtgctgcccgggactatggctactcaaggccgcgttactccccacaagtccttggggtacgaatccagaatggcagacatcctctgatggaactctgtgcccgaacttttgtgcccaactccacagaatgtggtggggacaaagggagggtcaaagtcatcactggacccaactcatcagggaagagcatatacctcaaacaggtaggcttgatcacattcatggccctggtaggcagctttgtgccagcagaggaggccgaaattggggcagtagacgccatcttcacacgaattcatagctgcgaatccatctcccttggcctctccaccttcatgatcgacctcaaccaggtggcgaaagcagtgaacaatgccactgcacagtcgctggtccttattgatgaatttggaaagggaaccaacacggtggatgggctcgcgcttctggccgctgtgctccgacactggctggcacgtggacccacatgcccccacatctttgtggccaccaactttctgagccttgttcagctacagctgctgccacaagggcccctggtgcagtatttgaccatggagacctgtgaggatggcaacgatcttgtcttcttctatcaggtttgcgaaggtgttgcgaaggccagccatgcctcccacacagctgcccaggctgggcttcctgacaagcttgtggctcgtggcaaggaggtctcagacttgatccgcagtggaaaacccatcaagcctgtcaaggatttgctaaagaagaaccaaatggaaaattgccagacattagtggataagtttatgaaactggatttggaagatcctaacctggacttgaacgttttcatgagccaggaagtgctgcctgctgccaccagcatcctctgagagtccttccagtgtcctccccagcctcctgagactccggtgggctgccatgccctctttgtttccttatctccctcagacgcagagtttttagtttctctagaaattttgtttcatattaggaataaagtttattttgaagaaagatattgtttctttagtctcaaaacaagagactaggaaagatccaaaacacagagcaggagtccacaggggaacctgccctgcctcagtaaaaatacagtgttgttgctgtaggaagactcccggattctaccccaggatacttcatgagaacgaaccccttcagagaggccctacaaaacagattagagggaagacagaggggtccaagggagatggtctctcttctcaagtaggaacaccccagcctcagacagacacagcaggaaggggcctgagaggctgacagaggcaggatgggtgcaaggcaggggtggaggggagggaccagcccgggctgcaccagtgggagtggctccacccttcccacctcagagccatggggagccagggctctggcggggtgcccttggtgcaggctccctacacagtcctgctgctgccgctggggacaagccgccaagacccaggggcccagagcttcttcctttggctacgcaggatgcaggctctggagagagaacaggatgccctgtggcagggtctggagctgctacagcatggccaggcctggtttgaagaccatctgagggaggcacagcgacagcagctgcatctaggggcccttggtgagaattttctaacagatttacactcagagcctggtcgccccccgttagcccagattcaaaaggtgaacatctgtttgcagaatctgattcatgagaagttctccccaagtccactgaacaaggctagttcctgcaccacccaggattcaaaggaaagacgaagggagcagaacttgtggcagcaacaggagttgtcaaggcagcagaaaggagtcacccagccaaaggaggagatggctcagcggggctgcaccaaggggccaagaggccctacccgtgtctaaaccctcctctcactcccctaagcctggtgaaagagtcagaagccccaggctcctttttctgtttcttaactcaacagctaaaaaatggctccaggtagtgagtcaatgaagttcagacatgttggtgtaaagtttctcctctgctcctgaaaacttcatcttcttggtgtctcatgtcctcattctcccctatatgacatgcaaaaacgatctttctttgaaatccctctgggaagaagacatgtttattgaaactgtccttcagccttaaatacaaaaataaaactgaaactgctccagaaagcagctttctcc

SEQ ID NO: 1352 - DNA, 1883 bp, Homo sapiens
cgagccctgacccaccggcggctgcggcggagccgcgccggcgccccccatgcgccagacggcaggacggcggcgtcggggggcgccatggcctcggcggcggcgggcgaagcggaggaaaccacccggttgcgcaagccgcgcttctcattcgaagagaaccagatcctgatccgcgaggtgcgcgcccactacccgcagctctacggcgcgcagagccgtcgggtgagcgtggcagagcggcggcgcgtgtgggacggcatcgccgccaagatcaacggtatcaccagctggaagcgcacgggccaggaggtgcagaagcgctggaacgacttcaagcgccgcaccaaggagaagctcgctcgcgtgccgcactccacgcagggcgccgggcccgccgcggaggacgctttctccgcggaagaggagaccatttttgccatcctggggccaggtgtggcggcgccgggggcaggtgctggggcggaggagccccctgcggccccctcttcacagccgccgcccccaagcgcctgccctcagcgctacgtgttgtcggaagaccgccgggaggaccgacgtgcagatacatcagcccacagcaaggcgggctccagcagcccggagccatgggcccggccctcctgcactccccaggaagggggctgcccacggcccaaggagcgtgagtcaccacccccttcggccctgcagccggtccagctgcctcgcctggccttgtctccaccacccccagcccctccactgccacccccaccgccactggcccaagtggcaccctcaccccctagccccccaccccctcctcggcctccacccacgctctcggcctcagacccctccctggacttcctgcgggcccagcaggagactgccaacgccatccgggagctggccggcacccttcgacagggactggccaaactgagcgaggccctcagcgctctgctgccccttctgccaggaaccccagttgactccctgcctccacctctgcccccacccccacccccaccgccacctcccaggcctgtcctgcccccaccggcccccaaggtggagatcaccccagagcccgtgtccgtggtggctgctgtggtggacggggcagtggtggcagccaggggagtgatcattgccccaaggagcgaggagggggcaccccggccccccccagccccgctccctccgcacgactcccccccacacaagcggagaaaaggtttccctacacggaaaaggcgcggccgatggaaatctccgtgaaatctactatctatgatcctgcctgcaacccctctccccagcttggcgcagtcgaggggggcgatgctctctgcccatcccagctgcaccctagctccctgctccagggatgtgagcacccactccctgtgctagttagtgcctgattctctggggggggcctcagtaatgggcccccccaacccctttctctggtacagtgctgtctgcctggctgcctcccttaaccctgacttctaagccatcaatttcatgttatttattattgccctatgtggggtggggagggaacctctcgggtctgcacatctccccttccctaacagttcctgttcttgacttgaagagaattgacccgtgggggactccccacctccccaacccagactttggagcgggtgggagttgtaagacaaatcaaaatacggatgacaaagaggatatagccgtgtataccccagggagaggaggcgccgagttctgatgggagaggtacaggttgggttctctgcctaccattgctgtctctgacttccagagctcaaccccctcctttctcccagtggtgacaagatatcaataaacttatttttaat

SEQ ID NO: 1353 - DNA, 3030 bp, Homo sapiens
ttccttttatgcgaacacaagtatatgaggggttgtgtaaaaattatttttctcttgctgtactacaaagagatagaatcaaactgctttttttcgacatactggtttttctttctgtttttcttctctttcttctatttcttgtggatattatggctaataacacaacaagtttagggagtccatggccagaaaacttttgggaggaccttatcatgtccttcactgtatccatggcaatcgggctggtacttggaggatttatttgggctgtgttcatttgtctgtctcgaagaagaagagccagtgctcccatctcacagtggagttcaagcaggagatctaggtcttcttacacccacggcctcaacagaactggattttaccgccacagtggctgtgaacgtcgaagcaacctcagcctggccagtctcaccttccagcgacaagcttccctggaacaagcaaattcctttccaagaaaatcaagtttcagagcttctactttccatccctttctgcaatgtccaccacttcctgtggaaactgagagtcagctggtgactctcccttcttccaatatctctcccaccatcagcacttcccacagtctgagccgtcctgactactggtccagtaacagtcttcgagtgggcctttcaacaccgcccccacctgcctatgagtccatcatcaaggcattcccagattcctgagtagggtggcttttggtttttgtttctttcttgtcttgtcttttattgaaaggaaatcaaaaataggctaaacagaattttgagggcatggcccaaataactcatgagttccaagttgaaacatggttgtgcaagttggacattacaatgtaaaacacattttcttcaaacacgttttcccttttgtttcaaaaaatgtaatattttcccccaagcgttttatatttatgtattttgtattcaatgtgaggcttattaaaaatagtgattctaatgtaagaatcagctaagatgcattatatatattttaattaaaattaaaacttcagatatttgtggattacaatcctcatttacttccaatgtgactaaaaagagaaaaaaaatcactgtgtcactttaaagaaaaatcttctaagggatttggattttactttctttagaatgacaagtgaatcatattgacattttacaatcttagatttttctttttttttcttttgagacagggtcttgatccgtcgcccaggcgggagttgcagtagcatgatcaggactcactgcagcctctatctcccaggctcaagtaatcctcccatcttagtgccccaagtagctgggactacaggggtgcactaccacaccgggttgaatttttttttaattttagtagagatgaagtgtcactatgttaccaaggctggtctcaaactcctaaactcagatgatcctcctgcctcggcctcccaaagtgctggaattagcctggccaatcttggatttttaatggaatatgtgggcacaaaatgacagaacataggacattctaaagttccttgatttgatcattataagaagtgtgggactcaagcacaggaaactgaactcttttggtgtcattggatgtttcatttttgacactaattttttctggacaaactctttatgtgtttttcccaagaatagttatctacttcctggaggcaaaatccttggatttactaacatgatgatttaccttttcttcaccgttgtcgttacattgttagaaaagcaacaggaaaaaatccaattcatttgacctaaaaacaagcctcaagtttaaaaccaagctcacgtttttcttaagggaaaaattttctttcttaaacttacatctagcaacttggaaagcactttctctggggatcttcttttgtaactttgcagacaaataagtatgagtcactggggagagagtttgttattgaaatagatgttgcccatgaagaattctccttcctggattgactcttaatcatcaggcatcattcctggtttgcttctctacgaatctcaattccaacttctctgcagagtctgtacagtgattaagccatgccagatggtctttggtgcacacagttatttaagaatccacttccacaggtggctgcccttgtaaggaagaatgcatccctaaatgtggccaccagagagttccagtgggcagatgtctgtggctgcccttctcatttaaggacatgagttcactggagtattactcaaaaagtctgtggttcatttccagtattgtgaatatttagtttatgtggccgtttctttgtttctttgaacagtgggattttcagtgaaaaagtaccctctttttcatttcctattgcagtggtcacagctaatagtgtctgaacatggttcaagaataagagattccatgtagcattttctttattattttcatttcccttatattatccatcattccttaaggacaattattcttaataatgcttatagaaaatgttctctaattaaacatgccaaaaggaaaaagtaagagaaagagggagcaagaagaaaatggaagaaaaagggaaaaaagctaaccggataaccaatttgttataagttggttttcaacaaagaaatttagcagccaagtaaggtttcaagggaatattaacttggtatcagggctacttttttttttttttttttacttgcatgtcatccttaatgtctaacatgaaaaatcagcaaagagtatggtttttatcaagaatttgtgttgggagtaaaaactgctttatagctcccaaattaggaagagaagagcagaaatcctctggggcatttaaccatctggcagaattgttgctgcacccttatcccagttataagacagtcaaaatgactatttcctaaatattgtgagtgtatgaaatgtgaaattaaagcaaaaactggagacttttaatgtatttctttaatttgaaatgttttgtggattgtgaaataaaaataaatttatgtc

SEQ ID NO: 1354 - DNA, 2389 bp, Homo sapiens
aaagagatagaatcaaactgctttttttcgacatactggtttttctttctgtttttcttctctttcttctatttcttgtggatattatggctaataacacaacaagtttagggagtccatggccagaaaacttttgggaggaccttatcatgtccttcactgtatccatggcaatcgggctggtacttggaggatttatttgggctgtgttcatttgtctgtctcgaagaagaagagccagtgctcccatctcacagtggagttcaagcaggagatctaggtcttcttacacccacggcctcaacagaactggattttaccgccacagtggctgtgaacgtcgaagcaacctcagcctggccagtctcaccttccagcgacaagcttccctggaacaagcaaattcctttccaagaaaatcaagtttcagagcttctactttccatccctttctgcaatgtccaccacttcctgtggaaactgagagtcagctggtgactctcccttcttccaatatctctcccaccatcagcacttcccacagtctgagccgtcctgactactggtccagtaacagtcttcgagtgggcctttcaacaccgcccccacctgcctatgagtccatcatcaaggcattcccagattcctgaggtcttgatccgtcgcccaggcgggagttgcagtagcatgatcaggactcactgcagcctctatctcccaggctcaagtaatcctcccatcttagtgccccaagtagctgggactacaggggtgcactaccacaccgggttgaatttttttttaattttagtagagatgaagtgtcactatgttaccaaggctggtctcaaactcctaaactcagatgatcctcctgcctcggcctcccaaagtgctggaattagcctggccaatcttggatttttaatggaatatgtgggcacaaaatgacagaacataggacattctaaagttccttgatttgatcattataagaagtgtgggactcaagcacaggaaactgaactcttttggtgtcattggatgtttcatttttgacactaattttttctggacaaactctttatgtgtttttcccaagaatagttatctacttcctggaggcaaaatccttggatttactaacatgatgatttaccttttcttcaccgttgtcgttacattgttagaaaagcaacaggaaaaaatccaattcatttgacctaaaaacaagcctcaagtttaaaaccaagctcacgtttttcttaagggaaaaattttctttcttaaacttacatctagcaacttggaaagcactttctctggggatcttcttttgtaactttgcagacaaataagtatgagtcactggggagagagtttgttattgaaatagatgttgcccatgaagaattctccttcctggattgactcttaatcatcaggcatcattcctggtttgcttctctacgaatctcaattccaacttctctgcagagtctgtacagtgattaagccatgccagatggtctttggtgcacacagttatttaagaatccacttccacaggtggctgcccttgtaaggaagaatgcatccctaaatgtggccaccagagagttccagtgggcagatgtctgtggctgcccttctcatttaaggacatgagttcactggagtattactcaaaaagtctgtggttcatttccagtattgtgaatatttagtttatgtggccgtttctttgtttctttgaacagtgggattttcagtgaaaaagtaccctctttttcatttcctattgcagtggtcacagctaatagtgtctgaacatggttcaagaataagagattccatgtagcattttctttattattttcatttcccttatattatccatcattccttaaggacaattattcttaataatgcttatagaaaatgttctctaattaaacatgccaaaaggaaaaagtaagagaaagagggagcaagaagaaaatggaagaaaaagggaaaaaagctaaccggataaccaatttgttataagttggttttcaacaaagaaatttagcagccaagtaaggtttcaagggaatattaacttggtatcagggctacttttttttttttttttttacttgcatgtcatccttaatgtctaacatgaaaaatcagcaaagagtatggtttttatcaagaatttgtgttgggagtaaaaactgctttatagctcccaaattaggaagagaagagcagaaatcctctggggcatttaaccatctggcagaattgttgctgcacccttatcccagttataagacagtcaaaatgactatttcctaaatattgtgagtgtatgaaatgtgaaattaaagcaaaaactgga

SEQ ID NO: 1355 - DNA, 5300 bp, Homo sapiens
ggcttcaggagagaggcccgcggtgctgtgctgccgggcctcggcgcagagccccggcagagcgccagacgctgactgccggcaccagaatgctcgcgatgaggaagacaggcggagcgctgcgagctagcgagccctcagctctcgtatccatgacgcctgctgcttcgggggacccctggcatgctggggagtgggtctctgtggtacatcctgtaccgccctggccggcgccggacccccatggccccagaacctcccgcactgccacgggaagacagagccggacgtgacgccaccgtggaaggaagggaggggcggagcgtggctcggtgacgtcctcccaagatggcggagacagagtgaagaaactgtgttccccccttgggttgctatcgatcaagggtaaaattccattctgatatcaaaatgcagtattcgcaccactgtgagcaccttttagagagactgaacaaacagcgggaagcaggttttctctgtgactgtaccatagtgattggggaattccagtttaaagctcataggaatgtgctggcctcctttagtgagtattttggtgcgatctacagaagcacttctgagaacaatgtctttcttgatcagagtcaggtgaaggctgatggatttcagaaactgttggagtttatatacacaggaactttaaatcttgacagttggaatgttaaagaaattcatcaggctgctgactatctcaaagtggaagaggtggtcactaaatgcaaaataaagatggaagattttgcttttattgctaatccttcttctacagagatatctagtattactggaaacattgaattgaatcaacagacttgtcttcttactctgcgagattataataatcgagagaaatcagaagtatctacagatttgattcaggcaaatcctaaacaaggcgcgttagcgaaaaagtcatctcaaacgaaaaagaagaagaaggctttcaactccccgaaaacagggcagaataaaacagtgcaatatcccagtgacatcttagagaatgcatctgttgaattattcctagatgcaaataaactgcccacacctgtagtagaacaagttgcacaaataaatgataattcagaactcgagttgacatcagttgtggaaaatacttttccagcacaagatattgtgcacactgttacagtgaaacggaaacgtggaaaatcacagccaaactgtgctctgaaagaacactctatgtctaatatagccagcgtcaagagtccttatgaggcggagaactccggggaagagctggatcagaggtattccaaggccaagccaatgtgtaacacatgtgggaaagtgttttcagaagccagcagtttgagaaggcacatgagaatacataaaggagtcaaaccttacgtctgccacttatgtggaaaggcatttacccaatgtaaccagctgaaaacgcatgtaagaactcatacaggtgagaagccatacaaatgtgaattgtgtgataaaggatttgctcagaaatgtcagctagtcttccatagtcgcatgcatcatggtgaagaaaaaccctataaatgtgatgtatgcaacttacagtttgcaacttctagcaatctcaagattcatgcaaggaagcatagtggagagaagccatatgtctgtgataggtgtggacagagatttgctcaagccagcacactgacctatcatgtccgtaggcatactggagaaaagccttatgtatgtgatacctgtgggaaggcatttgctgtctctagttctcttatcactcattctcgaaaacatacaggtgaaaaaccatacatatgtggtatttgtgggaaaagttttatttcctcaggagagctcaacaaacactttcggtcccatacaggagaaagaccatttatctgcgaattatgtggaaattcttacacagatattaaaaatttaaagaagcacaaaacaaaagtccattctggtgcagataaaactctagactccagtgcagaggatcatactttgagtgaacaggattccatacaaaaaagtcctttatcagaaactatggatgtgaagccttctgatatgactttaccattagctcttccacttgggactgaggaccatcacatgcttctgcctgtcacggatactcagtctcctacatcagatacattgttgaggtcaactgtgaatgggtattcagaaccacagttgatttttttacaacaattatactgactttgtaaggaatatggaattgctaagatatcattggtagcaaacatctctggtaaggtgcatatattcatattaaattcccattcatttgagttgtgaccattatttttcattcactgaagtaaaagcacctgatgctgcatcacaactgcaatgtttgtttttatttttggctttatgtctatactccacagagagctttttaagtaatgaattatgtagcactattttgggtggatgagttttattttcttttaaagctgccttaattccatttttattttgcattttagaattgcccttcatttactaaatcagccagttaatgtgattcagttgtgacctgtgggattttaaaattttcctgccctcataatttaagcaaaatccacgatagtatcagcccaagagtgtgttgctatttgtaagccccatggatcaatacataaactatgcataaaaataaaatttcatattttcgctcgtaaaaatttaggcgctgaataagaattgtgctatttctctattaatatattgttagaaataacttttctaatgaaacaaaaatgtttctcaaaatctagaaaagtgcatataaatttttgttcatttagaactgagtattctggagaaaaccaatggtcagcacttttggtttgagttatctgagattgtattttcaaaatgaattttaagtagatatttggtgtttttatcttgtcaaagacagtttcaaaatttgattcagtttatgttttattccgttctaaaatattggagatgaggaaaatgtacttgagttttgaaatattttggtaagcctctcttactcctgttatgcactttttaaaataaatactgaattccagaaagaattttctagatataaacttaatgcatactagaaatcacttggcttctaaatttggtacattatattgcataaagagttaagaaattaacctcaattataagtaaacattttgagttaccagaaagccaactatagttaaatattttatatctgagttttctataagtttggggtttgttaattttataaattaaaccacaacttttggtggtggttgtagtttcacaatggtccttttccttccaaatgaatgtagaaaattcgttattatcctgatatttgcaccactcatccccatgccacttttcccacatattaatttatttcactgcctgatctttggatatgaaattatgagttccacaaagtcaatttttatagtgccaatcaaacagcatggtgatattctttttctttttttttccccccacaaggctgttgttcagtgtgagatgacatcatttcttatttctgccatgctgtggcttttttgtgttctgcttttaaactacacctgtagtacagttaatatgttttttattggtattgatttctttaattcattaattttctctatttgggacccaagtcataagaaccaattagaggacataataaaaacacttaatgcttgtagtctgtagagatcttcaccatttcacagcacacacattattttcataataaattgccactggtgggacatgggactgacttatttgaatagagtttgaaataccacctttgtatgatgcaaacaatatttgattattttatctaagaaatctatgcatgtgtatcaagttaaaatagtgggtttaaatacaatttacaaagcattagaatgttacctaatctcttctgggttaaatgtgataggaatgtattggaatgtgaagaaattatagaaaattaaaagactcagcctctttaggaagtttgctaaaatggagaggttatgtttaatttatttatatcttcgttaatccaagcatctaatgaacaaaaaactgctacagtgacgtcataattctataagggcaatagttgccaaatttcctctggtattattagcattctgcctttgcatagattagccttcaaatttattatttttagtattatttgatacgattgaagtggctaagattgattgagcttttcttgatcacattttctgcttcttagctaaagtaattttatttaaattgacatggcttgagttgtcatcattttctgctcttctagaatgatgtgtagagaaaacttgaagatactatcccttctttggcattcttctcttaatgctatgctattatttatcataatatgcatatatttagttgtatctggtatcattctaacactcataactaccattttagttaagtccaactttatatttgttacaatgcagtgttttgggaaaggtctattagtaattatttaagtattacatatttttatggaagtctttagaaggtgaagatcttactgagaaactattttctaaataaatttaattttcttttgtatttgtatcagatcatgcctactgtatgttagattttagactattttaaaagaaaccgtagattatataaaaatttttttgctgtttttaaatggcatttgtcttatgtttaatttcacaggatgattttgatagacaaattttagaaaaccttttttcaaaggtaatggttctatcagtttcattccaacagtagctaatttctgtgtttcagtcctacagaaattgtgtgagtagttgaaataatgtacatgtactagtttttttaagtattctaaatagttctaacatttaatgcatatcagaaacatgcttaagaaataacaatatccaggcccaccccacctattgaatcagacagttcccagggcatatatatgctggggaagccccataggtgattttaatgtataccaaacatgtagagtctcactctgttgcccaggctggagtgcaatgacgtgatctcagctaactgcaacctctgcctcctggattcaagcaattctccggcctcagcctcctgagtagctggtactacaggtgcgcgccaccacacctgactaatttttgttagagatggggtttcattctgttggccaggctggtctcgaactcctgacctcaggt

SEQ ID NO: 1356 - DNA, 5367 bp, Homo sapiens
ggcttcaggagagaggcccgcggtgctgtgctgccgggcctcggcgcagagccccggcagagcgccagacgctgactgccggcaccagaatgctcgcgatgaggaagacaggcggagcgctgcgagctagcgagccctcagctctcgtatccatgacgcctgctgcttcgggggacccctggcatgctggggagtgggtctctgtggtacatcctgtaccgccctggccggcgccggacccccatggccccagaacctcccgcactgccacgggaagacagagccggacgtgacgccaccgtggaaggaagggaggggcggagcgtggctcggtgacgtcctcccaagatggcggagacagagtgaagaaactgtgttccccccttgggttgctatcggtggtagaagtgttgccattcaccgtcacttattgatgtgtccaaaggattgtgttagttgatcaagatcaagggtaaaattccattctgatatcaaaatgcagtattcgcaccactgtgagcaccttttagagagactgaacaaacagcgggaagcaggttttctctgtgactgtaccatagtgattggggaattccagtttaaagctcataggaatgtgctggcctcctttagtgagtattttggtgcgatctacagaagcacttctgagaacaatgtctttcttgatcagagtcaggtgaaggctgatggatttcagaaactgttggagtttatatacacaggaactttaaatcttgacagttggaatgttaaagaaattcatcaggctgctgactatctcaaagtggaagaggtggtcactaaatgcaaaataaagatggaagattttgcttttattgctaatccttcttctacagagatatctagtattactggaaacattgaattgaatcaacagacttgtcttcttactctgcgagattataataatcgagagaaatcagaagtatctacagatttgattcaggcaaatcctaaacaaggcgcgttagcgaaaaagtcatctcaaacgaaaaagaagaagaaggctttcaactccccgaaaacagggcagaataaaacagtgcaatatcccagtgacatcttagagaatgcatctgttgaattattcctagatgcaaataaactgcccacacctgtagtagaacaagttgcacaaataaatgataattcagaactcgagttgacatcagttgtggaaaatacttttccagcacaagatattgtgcacactgttacagtgaaacggaaacgtggaaaatcacagccaaactgtgctctgaaagaacactctatgtctaatatagccagcgtcaagagtccttatgaggcggagaactccggggaagagctggatcagaggtattccaaggccaagccaatgtgtaacacatgtgggaaagtgttttcagaagccagcagtttgagaaggcacatgagaatacataaaggagtcaaaccttacgtctgccacttatgtggaaaggcatttacccaatgtaaccagctgaaaacgcatgtaagaactcatacaggtgagaagccatacaaatgtgaattgtgtgataaaggatttgctcagaaatgtcagctagtcttccatagtcgcatgcatcatggtgaagaaaaaccctataaatgtgatgtatgcaacttacagtttgcaacttctagcaatctcaagattcatgcaaggaagcatagtggagagaagccatatgtctgtgataggtgtggacagagatttgctcaagccagcacactgacctatcatgtccgtaggcatactggagaaaagccttatgtatgtgatacctgtgggaaggcatttgctgtctctagttctcttatcactcattctcgaaaacatacaggtgaaaaaccatacatatgtggtatttgtgggaaaagttttatttcctcaggagagctcaacaaacactttcggtcccatacaggagaaagaccatttatctgcgaattatgtggaaattcttacacagatattaaaaatttaaagaagcacaaaacaaaagtccattctggtgcagataaaactctagactccagtgcagaggatcatactttgagtgaacaggattccatacaaaaaagtcctttatcagaaactatggatgtgaagccttctgatatgactttaccattagctcttccacttgggactgaggaccatcacatgcttctgcctgtcacggatactcagtctcctacatcagatacattgttgaggtcaactgtgaatgggtattcagaaccacagttgatttttttacaacaattatactgactttgtaaggaatatggaattgctaagatatcattggtagcaaacatctctggtaaggtgcatatattcatattaaattcccattcatttgagttgtgaccattatttttcattcactgaagtaaaagcacctgatgctgcatcacaactgcaatgtttgtttttatttttggctttatgtctatactccacagagagctttttaagtaatgaattatgtagcactattttgggtggatgagttttattttcttttaaagctgccttaattccatttttattttgcattttagaattgcccttcatttactaaatcagccagttaatgtgattcagttgtgacctgtgggattttaaaattttcctgccctcataatttaagcaaaatccacgatagtatcagcccaagagtgtgttgctatttgtaagccccatggatcaatacataaactatgcataaaaataaaatttcatattttcgctcgtaaaaatttaggcgctgaataagaattgtgctatttctctattaatatattgttagaaataacttttctaatgaaacaaaaatgtttctcaaaatctagaaaagtgcatataaatttttgttcatttagaactgagtattctggagaaaaccaatggtcagcacttttggtttgagttatctgagattgtattttcaaaatgaattttaagtagatatttggtgtttttatcttgtcaaagacagtttcaaaatttgattcagtttatgttttattccgttctaaaatattggagatgaggaaaatgtacttgagttttgaaatattttggtaagcctctcttactcctgttatgcactttttaaaataaatactgaattccagaaagaattttctagatataaacttaatgcatactagaaatcacttggcttctaaatttggtacattatattgcataaagagttaagaaattaacctcaattataagtaaacattttgagttaccagaaagccaactatagttaaatattttatatctgagttttctataagtttggggtttgttaattttataaattaaaccacaacttttggtggtggttgtagtttcacaatggtccttttccttccaaatgaatgtagaaaattcgttattatcctgatatttgcaccactcatccccatgccacttttcccacatattaatttatttcactgcctgatctttggatatgaaattatgagttccacaaagtcaatttttatagtgccaatcaaacagcatggtgatattctttttctttttttttccccccacaaggctgttgttcagtgtgagatgacatcatttcttatttctgccatgctgtggcttttttgtgttctgcttttaaactacacctgtagtacagttaatatgttttttattggtattgatttctttaattcattaattttctctatttgggacccaagtcataagaaccaattagaggacataataaaaacacttaatgcttgtagtctgtagagatcttcaccatttcacagcacacacattattttcataataaattgccactggtgggacatgggactgacttatttgaatagagtttgaaataccacctttgtatgatgcaaacaatatttgattattttatctaagaaatctatgcatgtgtatcaagttaaaatagtgggtttaaatacaatttacaaagcattagaatgttacctaatctcttctgggttaaatgtgataggaatgtattggaatgtgaagaaattatagaaaattaaaagactcagcctctttaggaagtttgctaaaatggagaggttatgtttaatttatttatatcttcgttaatccaagcatctaatgaacaaaaaactgctacagtgacgtcataattctataagggcaatagttgccaaatttcctctggtattattagcattctgcctttgcatagattagccttcaaatttattatttttagtattatttgatacgattgaagtggctaagattgattgagcttttcttgatcacattttctgcttcttagctaaagtaattttatttaaattgacatggcttgagttgtcatcattttctgctcttctagaatgatgtgtagagaaaacttgaagatactatcccttctttggcattcttctcttaatgctatgctattatttatcataatatgcatatatttagttgtatctggtatcattctaacactcataactaccattttagttaagtccaactttatatttgttacaatgcagtgttttgggaaaggtctattagtaattatttaagtattacatatttttatggaagtctttagaaggtgaagatcttactgagaaactattttctaaataaatttaattttcttttgtatttgtatcagatcatgcctactgtatgttagattttagactattttaaaagaaaccgtagattatataaaaatttttttgctgtttttaaatggcatttgtcttatgtttaatttcacaggatgattttgatagacaaattttagaaaaccttttttcaaaggtaatggttctatcagtttcattccaacagtagctaatttctgtgtttcagtcctacagaaattgtgtgagtagttgaaataatgtacatgtactagtttttttaagtattctaaatagttctaacatttaatgcatatcagaaacatgcttaagaaataacaatatccaggcccaccccacctattgaatcagacagttcccagggcatatatatgctggggaagccccataggtgattttaatgtataccaaacatgtagagtctcactctgttgcccaggctggagtgcaatgacgtgatctcagctaactgcaacctctgcctcctggattcaagcaattctccggcctcagcctcctgagtagctggtactacaggtgcgcgccaccacacctgactaatttttgttagagatggggtttcattctgttggccaggctggtctcgaactcctgacctcaggt

SEQ ID NO: 1357 - DNA, 1932 bp, Homo sapiens
ggcttcaggagagaggcccgcggtgctgtgctgccgggcctcggcgcagagccccggcagagcgccagacgctgactgccggcaccagaatgctcgcgatgaggaagacaggcggagcgctgcgagctagcgagccctcagctctcgtatccatgacgcctgctgcttcgggggacccctggcatgctggggagtgggtctctgtggtacatcctgtaccgccctggccggcgccggacccccatggccccagaacctcccgcactgccacgggaagacagagccggacgtgacgccaccgtggaaggaagggaggggcggagcgtggctcggtgacgtcctcccaagatggcggagacagagtgaagaaactgtgttccccccttgggttgctatcgatcaagggtaaaattccattctgatatcaaaatgcagtattcgcaccactgtgagcaccttttagagagactgaacaaacagcgggaagcaggttttctctgtgactgtaccatagtgattggggaattccagtttaaagctcataggaatgtgctggcctcctttagtgagtattttggtgcgatctacagaagcacttctgagaacaatgtctttcttgatcagagtcaggtgaaggctgatggatttcagaaactgttggagtttatatacacaggaactttaaatcttgacagttggaatgttaaagaaattcatcaggctgctgactatctcaaagtggaagaggtggtcactaaatgcaaaataaagatggaagattttgcttttattgctaatccttcttctacagagatatctagtattactggaaacattgaattgaatcaacagacttgtcttcttactctgcgagattataataatcgagagaaatcagaagtatctacagatttgattcaggcaaatcctaaacaaggcgcgttagcgaaaaagtcatctcaaacgaaaaagaagaagaaggctttcaactccccgaaaacagggcagaataaaacagtgcaatatcccagtgacatcttagagaatgcatctgttgaattattcctagatgcaaataaactgcccacacctgtagtagaacaagttgcacaaataaatgataattcagaactcgagttgacatcagttgtggaaaatacttttccagcacaagatattgtgcacactgttacagtgaaacggaaacgtggaaaatcacagccaaactgtgctctgaaagaacactctatgtctaatatagccagcgtcaagagtccttatgaggcggagaactccggggaagagctggatcagaggtattccaaggccaagccaatgtgtaacacatgtgggaaagtgttttcagaagccagcagtttgagaaggcacatgagaatacataaaggagtcaaaccttacgtctgccacttatgtggaaaggcatttacccaatgtaaccagctgaaaacgcatgtaagaactcatacaggtgagaagccatacaaatgtgaattgtgtgataaaggatttgctcagaaatgtcagctagtcttccatagtcgcatgcatcatggtgaagaaaaaccctataaatgtgatgtatgcaacttacagtttgcaacttctagcaatctcaagattcatgcaaggaagcatagtggagagaagccatatgtctgtgataggtgtggacagagatttgctcaagccagcacactgacctatcatgtccgtaggcatactggagaaaagccttatgtatgtgatacctgtgggaaggcatttgctgtctctagttctcttatcactcattctcgaaaacatacaggtgaaaaaccatacatatgtggtatttgtgggaaaagttttatttcctcaggagagctcaacaaacactttcggtcccatacagttgtttggagtatgaattaa

SEQ ID NO: 1358 - DNA, 4815 bp, Homo sapiens
atcaagggtaaaattccattctgatatcaaaatgcagtattcgcaccactgtgagcaccttttagagagactgaacaaacagcgggaagcaggttttctctgtgactgtaccatagtgattggggaattccagtttaaagctcataggaatgtgctggcctcctttagtgagtattttggtgcgatctacagaagcacttctgagaacaatgtctttcttgatcagagtcaggtgaaggctgatggatttcagaaactgttggagtttatatacacaggaactttaaatcttgacagttggaatgttaaagaaattcatcaggctgctgactatctcaaagtggaagaggtggtcactaaatgcaaaataaagatggaagattttgcttttattgctaatccttcttctacagagatatctagtattactggaaacattgaattgaatcaacagacttgtcttcttactctgcgagattataataatcgagagaaatcagaagtatctacagatttgattcaggcaaatcctaaacaaggcgcgttagcgaaaaagtcatctcaaacgaaaaagaagaagaaggctttcaactccccgaaaacagggcagaataaaacagtgcaatatcccagtgacatcttagagaatgcatctgttgaattattcctagatgcaaataaactgcccacacctgtagtagaacaagttgcacaaataaatgataattcagaactcgagttgacatcagttgtggaaaatacttttccagcacaagatattgtgcacactgttacagtgaaacggaaacgtggaaaatcacagccaaactgtgctctgaaagaacactctatgtctaatatagccagcgtcaagagtccttatgaggcggagaactccggggaagagctggatcagaggtattccaaggccaagccaatgtgtaacacatgtgggaaagtgttttcagaagccagcagtttgagaaggcacatgagaatacataaaggagtcaaaccttacgtctgccacttatgtggaaaggcatttacccaatgtaaccagctgaaaacgcatgtaagaactcatacaggtgagaagccatacaaatgtgaattgtgtgataaaggatttgctcagaaatgtcagctagtcttccatagtcgcatgcatcatggtgaagaaaaaccctataaatgtgatgtatgcaacttacagtttgcaacttctagcaatctcaagattcatgcaaggaagcatagtggagagaagccatatgtctgtgataggtgtggacagagatttgctcaagccagcacactgacctatcatgtccgtaggcatactggagaaaagccttatgtatgtgatacctgtgggaaggcatttgctgtctctagttctcttatcactcattctcgaaaacatacaggtgaaaaaccatacatatgtggtatttgtgggaaaagttttatttcctcaggagagctcaacaaacactttcggtcccatacaggtgcagataaaactctagactccagtgcagaggatcatactttgagtgaacaggattccatacaaaaaagtcctttatcagaaactatggatgtgaagccttctgatatgactttaccattagctcttccacttgggactgaggaccatcacatgcttctgcctgtcacggatactcagtctcctacatcagatacattgttgaggtcaactgtgaatgggtattcagaaccacagttgatttttttacaacaattatactgactttgtaaggaatatggaattgctaagatatcattggtagcaaacatctctggtaaggtgcatatattcatattaaattcccattcatttgagttgtgaccattatttttcattcactgaagtaaaagcacctgatgctgcatcacaactgcaatgtttgtttttatttttggctttatgtctatactccacagagagctttttaagtaatgaattatgtagcactattttgggtggatgagttttattttcttttaaagctgccttaattccatttttattttgcattttagaattgcccttcatttactaaatcagccagttaatgtgattcagttgtgacctgtgggattttaaaattttcctgccctcataatttaagcaaaatccacgatagtatcagcccaagagtgtgttgctatttgtaagccccatggatcaatacataaactatgcataaaaataaaatttcatattttcgctcgtaaaaatttaggcgctgaataagaattgtgctatttctctattaatatattgttagaaataacttttctaatgaaacaaaaatgtttctcaaaatctagaaaagtgcatataaatttttgttcatttagaactgagtattctggagaaaaccaatggtcagcacttttggtttgagttatctgagattgtattttcaaaatgaattttaagtagatatttggtgtttttatcttgtcaaagacagtttcaaaatttgattcagtttatgttttattccgttctaaaatattggagatgaggaaaatgtacttgagttttgaaatattttggtaagcctctcttactcctgttatgcactttttaaaataaatactgaattccagaaagaattttctagatataaacttaatgcatactagaaatcacttggcttctaaatttggtacattatattgcataaagagttaagaaattaacctcaattataagtaaacattttgagttaccagaaagccaactatagttaaatattttatatctgagttttctataagtttggggtttgttaattttataaattaaaccacaacttttggtggtggttgtagtttcacaatggtccttttccttccaaatgaatgtagaaaattcgttattatcctgatatttgcaccactcatccccatgccacttttcccacatattaatttatttcactgcctgatctttggatatgaaattatgagttccacaaagtcaatttttatagtgccaatcaaacagcatggtgatattctttttctttttttttccccccacaaggctgttgttcagtgtgagatgacatcatttcttatttctgccatgctgtggcttttttgtgttctgcttttaaactacacctgtagtacagttaatatgttttttattggtattgatttctttaattcattaattttctctatttgggacccaagtcataagaaccaattagaggacataataaaaacacttaatgcttgtagtctgtagagatcttcaccatttcacagcacacacattattttcataataaattgccactggtgggacatgggactgacttatttgaatagagtttgaaataccacctttgtatgatgcaaacaatatttgattattttatctaagaaatctatgcatgtgtatcaagttaaaatagtgggtttaaatacaatttacaaagcattagaatgttacctaatctcttctgggttaaatgtgataggaatgtattggaatgtgaagaaattatagaaaattaaaagactcagcctctttaggaagtttgctaaaatggagaggttatgtttaatttatttatatcttcgttaatccaagcatctaatgaacaaaaaactgctacagtgacgtcataattctataagggcaatagttgccaaatttcctctggtattattagcattctgcctttgcatagattagccttcaaatttattatttttagtattatttgatacgattgaagtggctaagattgattgagcttttcttgatcacattttctgcttcttagctaaagtaattttatttaaattgacatggcttgagttgtcatcattttctgctcttctagaatgatgtgtagagaaaacttgaagatactatcccttctttggcattcttctcttaatgctatgctattatttatcataatatgcatatatttagttgtatctggtatcattctaacactcataactaccattttagttaagtccaactttatatttgttacaatgcagtgttttgggaaaggtctattagtaattatttaagtattacatatttttatggaagtctttagaaggtgaagatcttactgagaaactattttctaaataaatttaattttcttttgtatttgtatcagatcatgcctactgtatgttagattttagactattttaaaagaaaccgtagattatataaaaatttttttgctgtttttaaatggcatttgtcttatgtttaatttcacaggatgattttgatagacaaattttagaaaaccttttttcaaaggtaatggttctatcagtttcattccaacagtagctaatttctgtgtttcagtcctacagaaattgtgtgagtagttgaaataatgtacatgtactagtttttttaagtattctaaatagttctaacatttaatgcatatcagaaacatgcttaagaaataacaatatccaggcccaccccacctattgaatcagacagttcccagggcatatatatgctggggaagccccataggtgattttaatgtataccaaacatgtagagtctcactctgttgcccaggctggagtgcaatgacgtgatctcagctaactgcaacctctgcctcctggattcaagcaattctccggcctcagcctcctgagtagctggtactacaggtgcgcgccaccacacctgactaatttttgttagagatggggtttcattctgttggccaggctggtctcgaactcctgacctcaggt

SEQ ID NO: 1359 - DNA, 5760 bp, Homo sapiens
agagagaagatacttcctctcgtagtggacacttgtcttttcagaagatttatacgactgagagtcaaaacttttaccagagactttcatagtcagtttgaattctgcaaaatttctctttatcttctggaatgtatgctctagacttggagtggctcaagctcttcgatgtgatcctatcaatgtcaagagaaagaagcactgaagagtcataattgtgtcctgatttataaatcggagacagagggagacgaaaaccacactccagaaagtagcttaatcggactcactactaagatgttaaaagtgaagaggctggaagaattcaacacgtgttataacagcaaccagctggagaaaatggccttttttcagtgcagggaagaggtggagaaagtgaagtgttttctggaaaaaaattctggggaccaggattcaagatctggacataatgaggcgaaggaggtgtggtcaaacgccgacctgacggaaaggatgcccgtcaaaagcaaaaggacatcagccctcgcagttgacatcccggctcctccggccccatttgatcatcgtattgtgacagccaagcaaggagcggtcaacagcttctatactgtgagcaagacagaaatcctaggaggagggcgtttcggccaggttcacaagtgtgaggagacggccacaggtctgaagctggcagccaaaatcatcaagaccagaggcatgaaggacaaggaggaggtgaagaacgagatcagcgtcatgaaccagctggaccacgcgaacctcatccagctgtacgatgccttcgagtctaagaacgacattgtcctggtcatggagtatgtggatggtggggagctgtttgaccgcatcatcgatgagagctacaatttgacggagcttgataccatcctgttcatgaagcagatatgtgaggggataaggcacatgcatcagatgtacattctccacttggacctgaagactacatcatttcagtgttcacgatttttgatcgacacgtccatccttccactttgtctcttaaattgcagatacaaacccagagagaagctgaaggtgaactttggaaccccagaatttctcgcccctgaagttgtgaactatgattttgtttcatttcccactgacatgtggagtgtgggggtcatcgcctatatgctacttagcggtttgtcgcctttcctgggtgacaatgatgctgagacgctgaacaacatcctggcctgcaggtgggacttagaggatgaagaatttcaggacatctcggaggaggccaaggagttcatctctaagcttctgattaaggagaagagttggcgaataagtgcaagcgaagctctcaagcacccctggttgtcagaccacaagctccactccagactcaatgcccagaagaagaagaatcgtggctctgatgcccaggactttgtgaccaaatagtctacaggaggcagccatttggaaggaaaactgctgtggttgctgctgcttcgagaaaattttttgaaaaatcagcagttctgatgccttgacccctgtgatgacctggtagtcttagcagggggagccctcgaccctgaatgtgaacttgaactggagtgcctctgctgcgctcagaggaacacccagcgctgcggtctggtctcagggcgcaaacacatccctgcacccggtggtggtgatgttgggaagatgtttccctgccatcttgagattttttacttttttaaaaaaattttttgatcttagtcactggggcagggggtgcattatgtctgccatttctcaaatgactacagctgtgacacttaagattgattggagattttaaaactggaggatgcatttagagggagaaagctacttccagccattagactatgcctttggaaggggcaattagatggccagaaagaattctgactcccatgcacccttggagacttagtttcacagactctgtcattttgatttggtctgtggtcacgtgactacaatggataaataatttgtttgctggaacagaagccgtctttgaattctccaacaagaggcatcagccactgtgtctttcatttattctgaattgtccccagcgtgcgttttcttccatgtagctgattctgtttttcacatctatactccctgcacccttctgactgacagttcatccccacaaaacacattggttttgagaggtgatgcaaaaagtatctgtttatggttggactttgaaattctgacctttgaaataatgtcaacagtcacaacaggtttcctcaagccccatttgtcaactaaaagagacggatctgcacctcctggagcaagatagcactgagctttcaacattgaagtgacttgggaaataacattcaagcttctgggtaaacacatacaaacagtggcaaagaccaagtacagtctctcgcctgtgctgtctcatgggactcaatggtggtgaagaaatctcaatcggacaccagaggtgggggcaactctgcaagctcacctgctggacgtgagaatgttggaacgttccagttggaaggttcctatgcctagcctgtgtgccatttcatggcagatatgtaagaaaggaaatggccctactgtagacagcttatggggcccagaaaggcactgggctttaaagagcgaaatgagtgtgtcatttccacatgaaggagaggcaaggaaaagccccacaaaattcctgttacccgctgaactccaagctcaccaaccagattcatgagctttctcacattttccatttccaaataactgttgtgttgaatcagctgtgttaatgcctttattctttgttttttttttttagacggagtctcgctctgtcacgaggctggagtgcagtggccccatctcggctcactgcaacctccgcctcccaggttcaagcgattctcctgcagcctcccgagtagctgggattacaggcgcacgccaccacgcacggctgatttttgcatttttagtagagatggggtttctccatgttggccagaatggtctcaattactgttgtcgcaatagcaatgaaaggcataagaattacttggtggcctcatgagggatggcagtttcactttgcatcagctttcccccattatctctcagatccacttaaggaatccttacagcatgccgtgaatgtgtgcaacatccttattctcatctttaaggtaaggaggaagtagagatagaaggaaatacgtgatttggtgaaggccacatgcgaattttgtggtcgtgttagttataaaactgactcctttccagcctttgctcttacattatgatgcgtttctttttctcctttggccttgcatttatccgaggttggtttcttatgttcctgtgatgtgactatgcttaagtgtttaatttagtttgcttaaaacacacacaccacacacacacacacacacaaaaccctgtgactggagtgttatattactatgctatctttagctgatgatattcattgagcctggaaaaatacaagccagtgcatgcattaatacttagttagaccgcagagagctggcattcactcaaatgctaaacaggacacaggggtctgatttgaagcccctcgtggcagggcgttttctgtcctgtggtgtgcattctctaccaaatcaagcaggagatcttttgcacgacgtgcaatttgcatccaccttcccttctgactcaggttggcagataaactgtccccagaccctgccacacatggaagagacagctcaggccaaatacaggcatgatttctttgccaagttaatgcactgatgaccctgcagtgagtgggtgtgatttttgttttgttttgaggtttagaaaggagactgtactttgaaaatggatcttgtttgattctgtagttaaatttccacatttggaatgggaaggcatctccatgccagcagggtgccttttatatgagtgctgagggtagtttgcattgcagagttcatgattacagtctagagttacttgaaatgggagattatcagtctagtgttcatcccgcccctgctccatgtccttgtgtggctgctccagcgagagctggtaactaggtagactgctgctctaatggggaaagggggctttgcaaagccgaggaatcaagccagatgcgagcatggactcagaaaagctgagtctggctagaccagggctatggagatcaatttttccaacaggtcattaggatttgggaggctgtatttctcctccaccctcttaatggatggtatggctttgctcactcactaggcagttcccactttctttagcaaatggaggaaattaagcaccgatgtagcacttcccactgcctggagagaaataaacctcgcaagttattaaggagaaggcatgcctcattggtaatttggaagacaccaacacttacccagaatctgttgctatttaaaaatcagggagaggagggcacatgtccccatttgctacattacaaactttggacgagactctcatctgaactaacttggggaaacaatttctaggttgaagctggtaacactcatgtctgttgagtgccataagtttgttttcagttatttcctctaacttgatattaatttgctttctttcctcaaaaatgtaagtaggcatgttgccattgttgtggcttgctttgatgtatgtttggaaagatgtgtgaatacttaatttttatccattttatggaaattagcttagcaatttttttttctcttttaagaatcaaaatatggatttgatactaggaacagaatctgctctttatttcattccttttttgtctcttctgcttcctctgcccctcccccagccacgcagcacgggtgccagtgtgcatgcgtgtgctgggggccaaatgacagaaccccggttgaaagtccgcttgtaaaagcacaagtgagaggcagcatcaggcccctggagggctgtggtcctcggactcggttctttcctgtcccctggccgtcctgtcatccctgtgtgctgcagcatcaccacggcctacttcccaatatccacaaagcttcgcctttgcttttgcactctcttttacatttttttacttctttcctttttcttaagttcggatccaagtttgtcttcttatccatcaccatgctccctgaaagcctttttgagattaagaaattttcttaccaggaggcaactttccgtctgtcctaaagggaagtgggtgctggatttattagatattgggttcctggattaagatgacttcctcacatagcttggagtctgcagtttctcagttagaagtgttctatatttctttttgctccattttagtgcgctgtgctttgtataagtggtctttctatgggcagtttcaccttccatgaaggcttataactcaaccactactacccattcagaagagcagaaagcatctgctgtgtgagcgttcatatgttacctaatgtgtattttgctgtcgtctcagctgatagatgtcagtgagtctttctgactaggtttattggtgttgataagaaattaaaaaaaggattcataacgtggtgattgtgtctatcatgtatattttaaatttctgaacgtactttcatttagctgtttttctttgctttctaaagatgtataacaatcatgtatatgtattatattgaagaataaacatggaccttatttatcttttga

SEQ ID NO: 1360 - DNA, 5798 bp, Homo sapiens
gatcaagagccatattaatttaaacaggggctgaaagtggcatttgagagagaagatacttcctctcgtagtggacacttgtcttttcagaagatttatacgactgagagtcaaaacttttaccagagactttcatagtcagtttgaattctgcaaaatttctctttatcttctggaatgtatgctctagacttggagtggctcaagctcttcgatgtgatcctatcaatgtcaagagaaagaagcactgaagagtcataattgtgtcctgatttataaatcggagacagagggagacgaaaaccacactccagaaagtagcttaatcggactcactactaagatgttaaaagtgaagaggctggaagaattcaacacgtgttataacagcaaccagctggagaaaatggccttttttcagtgcagggaagaggtggagaaagtgaagtgttttctggaaaaaaattctggggaccaggattcaagatctggacataatgaggcgaaggaggtgtggtcaaacgccgacctgacggaaaggatgcccgtcaaaagcaaaaggacatcagccctcgcagttgacatcccggctcctccggccccatttgatcatcgtattgtgacagccaagcaaggagcggtcaacagcttctatactgtgagcaagacagaaatcctaggaggagggcgtttcggccaggttcacaagtgtgaggagacggccacaggtctgaagctggcagccaaaatcatcaagaccagaggcatgaaggacaaggaggaggtgaagaacgagatcagcgtcatgaaccagctggaccacgcgaacctcatccagctgtacgatgccttcgagtctaagaacgacattgtcctggtcatggagtatgtggatggtggggagctgtttgaccgcatcatcgatgagagctacaatttgacggagcttgataccatcctgttcatgaagcagatatgtgaggggataaggcacatgcatcagatgtacattctccacttggacctgaagcctgagaatatcctgtgtgtgaatcgggatgctaagcaaataaaaattattgattttggattggccagaagatacaaacccagagagaagctgaaggtgaactttggaaccccagaatttctcgcccctgaagttgtgaactatgattttgtttcatttcccactgacatgtggagtgtgggggtcatcgcctatatgctacttagcggtttgtcgcctttcctgggtgacaatgatgctgagacgctgaacaacatcctggcctgcaggtgggacttagaggatgaagaatttcaggacatctcggaggaggccaaggagttcatctctaagcttctgattaaggagaagagttggcgaataagtgcaagcgaagctctcaagcacccctggttgtcagaccacaagctccactccagactcaatgcccagaagaagaagaatcgtggctctgatgcccaggactttgtgaccaaatagtctacaggaggcagccatttggaaggaaaactgctgtggttgctgctgcttcgagaaaattttttgaaaaatcagcagttctgatgccttgacccctgtgatgacctggtagtcttagcagggggagccctcgaccctgaatgtgaacttgaactggagtgcctctgctgcgctcagaggaacacccagcgctgcggtctggtctcagggcgcaaacacatccctgcacccggtggtggtgatgttgggaagatgtttccctgccatcttgagattttttacttttttaaaaaaattttttgatcttagtcactggggcagggggtgcattatgtctgccatttctcaaatgactacagctgtgacacttaagattgattggagattttaaaactggaggatgcatttagagggagaaagctacttccagccattagactatgcctttggaaggggcaattagatggccagaaagaattctgactcccatgcacccttggagacttagtttcacagactctgtcattttgatttggtctgtggtcacgtgactacaatggataaataatttgtttgctggaacagaagccgtctttgaattctccaacaagaggcatcagccactgtgtctttcatttattctgaattgtccccagcgtgcgttttcttccatgtagctgattctgtttttcacatctatactccctgcacccttctgactgacagttcatccccacaaaacacattggttttgagaggtgatgcaaaaagtatctgtttatggttggactttgaaattctgacctttgaaataatgtcaacagtcacaacaggtttcctcaagccccatttgtcaactaaaagagacggatctgcacctcctggagcaagatagcactgagctttcaacattgaagtgacttgggaaataacattcaagcttctgggtaaacacatacaaacagtggcaaagaccaagtacagtctctcgcctgtgctgtctcatgggactcaatggtggtgaagaaatctcaatcggacaccagaggtgggggcaactctgcaagctcacctgctggacgtgagaatgttggaacgttccagttggaaggttcctatgcctagcctgtgtgccatttcatggcagatatgtaagaaaggaaatggccctactgtagacagcttatggggcccagaaaggcactgggctttaaagagcgaaatgagtgtgtcatttccacatgaaggagaggcaaggaaaagccccacaaaattcctgttacccgctgaactccaagctcaccaaccagattcatgagctttctcacattttccatttccaaataactgttgtgttgaatcagctgtgttaatgcctttattctttgttttttttttttagacggagtctcgctctgtcacgaggctggagtgcagtggccccatctcggctcactgcaacctccgcctcccaggttcaagcgattctcctgcagcctcccgagtagctgggattacaggcgcacgccaccacgcacggctgatttttgcatttttagtagagatggggtttctccatgttggccagaatggtctcaattactgttgtcgcaatagcaatgaaaggcataagaattacttggtggcctcatgagggatggcagtttcactttgcatcagctttcccccattatctctcagatccacttaaggaatccttacagcatgccgtgaatgtgtgcaacatccttattctcatctttaaggtaaggaggaagtagagatagaaggaaatacgtgatttggtgaaggccacatgcgaattttgtggtcgtgttagttataaaactgactcctttccagcctttgctcttacattatgatgcgtttctttttctcctttggccttgcatttatccgaggttggtttcttatgttcctgtgatgtgactatgcttaagtgtttaatttagtttgcttaaaacacacacaccacacacacacacacacacaaaaccctgtgactggagtgttatattactatgctatctttagctgatgatattcattgagcctggaaaaatacaagccagtgcatgcattaatacttagttagaccgcagagagctggcattcactcaaatgctaaacaggacacaggggtctgatttgaagcccctcgtggcagggcgttttctgtcctgtggtgtgcattctctaccaaatcaagcaggagatcttttgcacgacgtgcaatttgcatccaccttcccttctgactcaggttggcagataaactgtccccagaccctgccacacatggaagagacagctcaggccaaatacaggcatgatttctttgccaagttaatgcactgatgaccctgcagtgagtgggtgtgatttttgttttgttttgaggtttagaaaggagactgtactttgaaaatggatcttgtttgattctgtagttaaatttccacatttggaatgggaaggcatctccatgccagcagggtgccttttatatgagtgctgagggtagtttgcattgcagagttcatgattacagtctagagttacttgaaatgggagattatcagtctagtgttcatcccgcccctgctccatgtccttgtgtggctgctccagcgagagctggtaactaggtagactgctgctctaatggggaaagggggctttgcaaagccgaggaatcaagccagatgcgagcatggactcagaaaagctgagtctggctagaccagggctatggagatcaatttttccaacaggtcattaggatttgggaggctgtatttctcctccaccctcttaatggatggtatggctttgctcactcactaggcagttcccactttctttagcaaatggaggaaattaagcaccgatgtagcacttcccactgcctggagagaaataaacctcgcaagttattaaggagaaggcatgcctcattggtaatttggaagacaccaacacttacccagaatctgttgctatttaaaaatcagggagaggagggcacatgtccccatttgctacattacaaactttggacgagactctcatctgaactaacttggggaaacaatttctaggttgaagctggtaacactcatgtctgttgagtgccataagtttgttttcagttatttcctctaacttgatattaatttgctttctttcctcaaaaatgtaagtaggcatgttgccattgttgtggcttgctttgatgtatgtttggaaagatgtgtgaatacttaatttttatccattttatggaaattagcttagcaatttttttttctcttttaagaatcaaaatatggatttgatactaggaacagaatctgctctttatttcattccttttttgtctcttctgcttcctctgcccctcccccagccacgcagcacgggtgccagtgtgcatgcgtgtgctgggggccaaatgacagaaccccggttgaaagtccgcttgtaaaagcacaagtgagaggcagcatcaggcccctggagggctgtggtcctcggactcggttctttcctgtcccctggccgtcctgtcatccctgtgtgctgcagcatcaccacggcctacttcccaatatccacaaagcttcgcctttgcttttgcactctcttttacatttttttacttctttcctttttcttaagttcggatccaagtttgtcttcttatccatcaccatgctccctgaaagcctttttgagattaagaaattttcttaccaggaggcaactttccgtctgtcctaaagggaagtgggtgctggatttattagatattgggttcctggattaagatgacttcctcacatagcttggagtctgcagtttctcagttagaagtgttctatatttctttttgctccattttagtgcgctgtgctttgtataagtggtctttctatgggcagtttcaccttccatgaaggcttataactcaaccactactacccattcagaagagcagaaagcatctgctgtgtgagcgttcatatgttacctaatgtgtattttgctgtcgtctcagctgatagatgtcagtgagtctttctgactaggtttattggtgttgataagaaattaaaaaaaggattcataacgtggtgattgtgtctatcatgtatattttaaatttctgaacgtactttcatttagctgtttttctttgctttctaaagatgtataacaatcatgtatatgtattatattgaagaataaacatggaccttattta

SEQ ID NO: 1361 - DNA, 1525 bp, Homo sapiens
gcgccgccgccgcccgcctcagcccaacatggcgatgcacaacaaggcggcgccgccgcagatcccggacacccggcgggagctggcggagctcgtgaagcggaagcaggagctggcggaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacaggattgatctgaagttaaacaaaaaaccacgagctgactattagaagacacattagtgcagaagcttccaggctgtagagccctgcttcccttctctgacctcacaaagataaacatccttcacctgagttcgtggccatccacctctgctctcccagacccagtgcctgtgactttgagtagtttgttctaaatgtggtgacaaacaagtcatttctgtaagacattgggtcttactttatgtcatttttagtaacagaactgcaggaagatgaagacaatgttgtaatcccagcaagttgctaactgtgcgtttctcccttcttagaatgaatgtctcccccaaaactggctggcaccagcttcatctgtgatacccttcaagaaatgttctctggttttgttttatgctgaaagtagaacacaagtcacatttcagatggaggctgtaaatatctggcattttcttatattgttttatgttttcttgtttttctcttgttgtttttatcttattttctttggggtttttttgtaatgcctttgtacagctcatactttcctgctgacatatctgatcatctctttcatgcagttgccaatattcataactgaaaataatctggtttatcataagtaaaatgggaaacttgcctctgttttttgcaaggggaggtaaagagtgtttagtaattacctatcttaaatctttctgagttggtagtagattcatgttcaaggaacaggaaaaatggaaaaacataagtttaaatcagttctttttaaataactttttattcttttgtataaataaaatttcacaggcttcaaattctcatgctttacttttaaacccgagattgttttttcacttatttattcatatcatgccttatggaaatttctttttctgtattttctctctttgctggtattcacctgattaaatattgctctaaaaatca

SEQ ID NO: 1362 - DNA, 603 bp, Homo sapiens
gcccgcctcagcccaacatggcgatgcacaacaaggcggcgccgccgcagatcccggacacccggcgggagctggcggagctcgtgaagcggaagcaggagctggcggaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagaatgaatgtctcccccaaaactggctggcaccagcttcatctgtgataccctt

SEQ ID NO: 1363 - DNA, 2005 bp, Homo sapiens
agggggacccagtcaccccgtctggactttggaggctggtggggagcgtgttctttttggtactgggagtagatccgttgaatggaggtttttgatagacagggttgtgatgtgtttgggaacatctagaaggtgacaggcgagggagaagaacacattccggagaattcagaattgtgacaggcacccaaggcccaatgcactctggtggctaagctcttcctgcccccgcgtctcggcttgggcacccgggaggcccctctcacctgaagctgcccttctaggtttccatagcaactggcagcccggtgtcggcggcctctcttgagcctgcggggaggggagcgagttgacgctgaaaggctgctcacctttccctctcctggtagcgataccttttgtgcgtgggagtggacatcgcccaagttctgcgttagcctgggctcttgactcatggtttccgtgaatcctctaaagtatatgcaaaatttcgcgtgtgtgtgtatttttctggagacatgctttatacattcaggggtccatcacccccaaaggtctagactgtcttagtcctaaacggctcctcctccccgtatcttccatctctccacagggtggtttagtgtgggcaagcttgcgtttacgagtctaatatcaggatttcattttggccagacttaagtgtttgcatttaaaaggtatcattcatgtccttgtttttcatctctcaggaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacaggattgatctgaagttaaacaaaaaaccacgagctgactattagaagacacattagtgcagaagcttccaggctgtagagccctgcttcccttctctgacctcacaaagataaacatccttcacctgagttcgtggccatccacctctgctctcccagacccagtgcctgtgactttgagtagtttgttctaaatgtggtgacaaacaagtcatttctgtaagacattgggtcttactttatgtcatttttagtaacagaactgcaggaagatgaagacaatgttgtaatcccagcaagttgctaactgtgcgtttctcccttcttagaatgaatgtctcccccaaaactggctggcaccagcttcatctgtgatacccttcaagaaatgttctctggttttgttttatgctgaaagtagaacacaagtcacatttcagatggaggctgtaaatatctggcattttcttatattgttttatgttttcttgtttttctcttgttgtttttatcttattttctttggggtttttttgtaatgcctttgtacagctcatactttcctgctgacatatctgatcatctctttcatgcagttgccaatattcataactgaaaataatctggtttatcataagtaaaatgggaaacttgcctctgttttttgcaaggggaggtaaagagtgtttagtaattacctatcttaaatctttctgagttggtagtagattcatgttcaaggaacaggaaaaatggaaaaacataagtttaaatcagttctttttaaataactttttattcttttgtataaataaaatttcacaggcttcaaa

SEQ ID NO: 1364 - DNA, 2147 bp, Homo sapiens
gcccgcctcagcccaacatggcgatgcacaacaaggcggcgccgccgcagatcccggacacccggcgggagctggcggagctcgtgaagcggaagcaggagctggcggaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagcccgtctggcatgtttgattatgactttgagattgatctgaagttaaacaaaaaaccacgagctgactattagaagacacattagtgcagaagcttccaggctgtagagccctgcttcccttctctgacctcacaaagataaacatccttcacctgagttcgtggccatccacctctgctctcccagacccagtgcctgtgactttgagtagtttgttctaaatgtggtgacaaacaagtcatttctgtaagacattgggtcttactttatgtcatttttagtaacagaactgcaggaagatgaagacaatgttgtaatcccagcaagttgctaactgtgcgtttctcccttcttagaatgaatgtctcccccaaaactggctggcaccagcttcatctgtgatacccttcaagaaatgttctctggttttgttttatgctgaaagtagaacacaagtcacatttcagatggaggctgtaaatatctggcattttcttatattgttttatgttttcttgtttttctcttgttgtttttatcttattttctttggggtttttttgtaatgcctttgtacagctcatactttcctgctgacatatctgatcatctctttcatgcagttgccaatattcataactgaaaataatctggtttatcataagtaaaatgggaaacttgcctctgttttttgcaaggggaggtaaagagtgtttagtaattacctatcttaaatctttctgagttggtagtagattcatgttcaaggaacaggaaaaatggaaaaacataagtttaaatcagttctttttaaataactttttattcttttgtataaataaaatttcacaggcttcaaattctcatgctttacttttaaacccgagattgttttttcacttatttattcatatcatgccttatggaaatttctttttctgtattttctctctttgctggtattcacctgattaaatattgctctaaaaatcaccatggcatatggaaagtctcaaaattataccaaaagtgataacttatgtcgttcttaagtggagtgaaaggatagcatcagtgagagccagtgttgcccaccaggtctccctttcttggagggcttgttggggctgaggaatctgctagtaatcgttacctgcctctagtgctgtggtgaacttgcgacagggtctggctgcacattggaatcacctgagaagctttaaaatactcatgcctggatcccatccctagagactggggtacagcctagttattgggaatttctttaaaagagttcctgggattctgataagaagccaggttgagaaccactacattagaagactgaatggtttaatttacatcctatgttatgattggtctaagggataagatttggggtctaacctttcctttcactctagttagtcatagtccttgacttatgcctatatctttgtaagaaatagtatgtttcatttgtgatagtattggtagggctgaatatggatggcatctactgtaaaacaagtctaccttgtcagatgtgcaaaagctttcactcttgttctcaaataaacttttgtgggttttttt

SEQ ID NO: 1365 - DNA, 666 bp, Homo sapiens
atggcgatgcacaacaaggcggcgccgccgcagatcccggacacccggcgggagctggcggagctcgtgaagcggaagcaggagctggcggaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagcccgtctggcatgtttgattatgactttgagtatgtatattaggttaggctgggaagttttttttaaaaacagaaaaacgtgatggaggattgatctgaagttaaacaaaaaaccacgagctgtaagtatcag

SEQ ID NO: 1366 - DNA, 1305 bp, Homo sapiens
gtcaccgctgtgcggcttctgtttggttggccagttcgtcccaatttccgactcacagggctgcggagcagcaactctcacgatatttgctgcgacccgcaggcgctatccgctgccgggttctggcgcgccctttcagttctgcttgctgtcggcaccgctgcgttacccggaaccgccgggccgaacagcatgacgtccgctttggagaactacatcaaccgaactgttgccgttattacatcagatgggagaatgattgtgggaacactgaaaggttttgaccagaccattaatttgattttggatgaaagccatgaacgagtattcagctcttcacagggggtagaacaagtggtactaggattatacattgtaagaggtgacaacgttgcagtcattggagaaatcgatgaagaaacagattctgcgcttgatttggggaatattcgagcagaacctttaaattctgtagcacactgaggaaaaactacatacttggacatctgtaaatctttgtacagaaactgattattctgaggatgatatatggagtttttatgagtgtgtcactggattttgactccttattgattcattgtaatatgtaaattaaaatatttctacattttattgaaaaaaaaacctttttttttgcctaaatataagtttggtagcttggtttcttttttttattaaatagtgtgaaaatataatgggcattttgaaaacttttagaaaaaagtagtactttttgatactttagtatttatggaaactagtggaaaagagaaattagtgtgctatataaatcaggcattcaagtaacagtaatacaggatatatgtgttttctttccctgatgtttaggaaaatcacaggagggtaaatctttgctggagttatctgaatcattggcatttatccgattccactggtggtagtttgctagtgcttctaaaagttgctccctagcactgagaggtgtgggtaggtaaaaatgtgtttgcttgagaaaagcaaaaatgctaacaaggttttgatagattggcccaaaattctaacttgaatattaagaatgactaggaatggtagaattgacagagatgattagtaaagtctcttgatgcccaattggttaggtatgaaagtaatatgaacacattaatgttgaattttacagacagtatatttgaaaaaaattgattccatgtagtcttcaatttttaatttttaagaattggagaatttctaatgttaaagttagtttataaatgtgagtaaataaactctaagtttgtattg

SEQ ID NO: 1367 - DNA, 2077 bp, Homo sapiens
aaagtccatgggagccggagcgccgggacgccaagcacttcctgccgcgggcggcgcgccgcagctgcccaggccggaccgggccgggcgcccgcagatgagccccgctagggccgccccgcgctgagagcccagccccgccgctgcccgcccgccatgtctcagatgctgcacatcgagatccccaacttcgggaacacagtgctgggctgcctgaacgagcagcgcctgctgggcctctactgcgatgtgtccatcgtggtcaagggccaggccttcaaggcccaccgggcggtgctggccgccagcagcctctacttccgcgacctgttcagcggcaacagcaagagcgccttcgagctgcccggctccgtgccgcccgcctgcttccagcagatcctgtccttctgctacacgggcaggctcaccatgacggccagcgagcagctcgtggtcatgtacacggccggcttcctgcagatccagcacatcgtggagcgcggcaccgacctcatgttcaaggtgagctcgccccactgcgactcgcagaccgctgtgatcgaggacgccggctccgagccccagagcccctgcaaccagctgcagccggccgccgccgccgcggccccctacgtcgtgtccccctcggtgcccatcccgctgctgacccgagtaaagcatgaagccatggagctgccgccggccggcccaggcctggcccccaagcgcccgctggagacggggccccgggacggcgtggcggtggccgcgggggctgcggtggcggcgggcacagcccctctcaaactgccccgtgtctcctactacggggtgcccagcctggccaccctcatccccggcatccagcagatgccctacccccagggggagcggaccagtccaggcgccagcagcctgcccaccaccgacagccccacctcgtaccacaacgaggaggacgaggaggacgacgaggcctacgacaccatggtggaggagcagtacggccagatgtacatcaaggcctccggcagctatgcagtgcaagagaagcctgagccagtgccgctggagagccgctcctgcgtcctcatccgccgcgacctcgtggccctacctgccagcctcatcagccagatcggataccgctgccatcccaagctctactcggaaggggaccccggggagaagctggagctggtggcaggctctggggtctacatcacacgcggccagctgatgaactgccacctgtgtgcaggggtgaagcataaggtcttgctgcggaggctcctggccaccttctttgacaggaacacgctggccaacagctgcgggactggcatccgctcgtccaccagcgaccccagccggaagccgctggacagccgggtcctgaacgctgtgaaattgtactgtcagaacttcgcccccagcttcaaggagagcgagatgaacgtgatcgccgcggacatgtgcaccaacgcccgccgcgttcgcaagcgctggctgcccaagatcaagtccatgctgccggagggcgtggagatgtaccgcacggtcatgggctccgccgccgccagcgtgcccctcgaccccgagttcccgcctgccgcggcacaggtgttcgagcaacgcatctacgccgagcggcggggcgacgccgccaccatcgtggctctgagaactgacgccgtgaatgttgacctgagtgccgccgccaaccccgccttcgacgccggcgaggaggtggacggggctggctcggtcatccaggaggtggccgcccccgagccgctgcccgccgatggccagagccccccacagccctttgagcagggcgggggcggccccagcaggccccagacgccggcggccgcggcccggaggccggagggcacctatgcagggaccttgtaagcggagctgggtggctgcgcgagggaccgagtactagagctgcttgcatgcgttactaatacaaacaaatgtgatcaagccacttacctactgaactgctactgttgcctgagaaaaatgtgatttttattctgcttgtatttaaaattgatgaagg

SEQ ID NO: 1368 - DNA, 6802 bp, Homo sapiens
atgagccccgctagggccgccccgcgctgagagcccagccccgccgctgcccgcccgccatgtctcagatgctgcacatcgagatccccaacttcgggaacacagtgctgggctgcctgaacgagcagcgcctgctgggcctctactgcgatgtgtccatcgtggtcaagggccaggccttcaaggcccaccgggcggtgctggccgccagcagcctctacttccgcgacctgttcagcggcaacagcaagagcgccttcgagctgcccggctccgtgccgcccgcctgcttccagcagatcctgtccttctgctacacgggcaggctcaccatgacggccagcgagcagctcgtggtcatgtacacggccggcttcctgcagatccagcacatcgtggagcgcggcaccgacctcatgttcaaggtgagctcgccccactgcgactcgcagaccgctgtgatcgaggacgccggctccgagccccagagcccctgcaaccagctgcagccggccgccgccgccgcggccccctacgtcgtgtccccctcggtgcccatcccgctgctgacccgagtaaagcatgaagccatggagctgccgccggccggcccaggcctggcccccaagcgcccgctggagacggggccccgggacggcgtggcggtggccgcgggggctgcggtggcggcgggcacagcccctctcaaactgccccgtgtctcctactacggggtgcccagcctggccaccctcatccccggcatccagcagatgccctacccccagggggagcggaccagtccaggcgccagcagcctgcccaccaccgacagccccacctcgtaccacaacgaggaggacgaggaggacgacgaggcctacgacaccatggtggaggagcagtacggccagatgtacatcaaggcctccggcagctatgcagtgcaagagaagcctgagccagtgccgctggagagccgctcctgcgtcctcatccgccgcgacctcgtggccctacctgccagcctcatcagccagatcggataccgctgccatcccaagctctactcggaaggggaccccggggagaagctggagctggtggcaggctctggggtctacatcacacgcggccagctgatgaactgccacctgtgtgcaggggtgaagcataaggtcttgctgcggaggctcctggccaccttctttgacaggaacacgctggccaacagctgcgggactggcatccgctcgtccaccagcgaccccagccggaagccgctggacagccgggtcctgaacgctgtgaaattgtactgtcagaacttcgcccccagcttcaaggagagcgagatgaacgtgatcgccgcggacatgtgcaccaacgcccgccgcgttcgcaagcgctggctgcccaagatcaagtccatgctgccggagggcgtggagatgtaccgcacggtcatgggctccgccgccgccagcgtgcccctcgaccccgagttcccgcctgccgcggcacaggtgttcgagcaacgcatctacgccgagcggcggggcgacgccgccaccatcgtggctctgagaactgacgccgtgaatgttgacctgagtgccgccgccaaccccgccttcgacgccggcgaggaggtggacggggctggctcggtcatccaggaggtggccgcccccgagccgctgcccgccgatggccagagccccccacagccctttgagcagggcgggggcggccccagcaggccccagacgccggcggccgcggcccggaggccggagggcacctatgcagggaccttgtaagcggagctgggtggctgcgcgagggaccgagtactagagctgcttgcatgcgttactaatacaaacaaatgtgatcaagccacttacctactgaactgctactgttgcctgagaaaaatgtgatttttattctgcttgtatttaaaattgatgaaggaaacaaatgcattcattatactgtaaacaattaggccactggcagcctcctgcgaggaagttcccagggctcccttttgatattcacaaggtcagcctccaagtgtagcttccctcccccttcttggggagggtgggaggccgccaggcccctggtgcccagccctgccccttcctccctgcccttcctgctcctcctgcccggaagacgaagcaggggccggcggtggtctgtggcgagggggctgggctgtgcgtcactgacccttccttccttccccatggaacctctctggggcgacggggcagggctcaggctccagggcctaactcctcgtttttccttctttcggagactcggggccaggcccaccgggccttccacctgtgtggggtgtgtgcacgagtgtgtgtgtgtgcgtgtgtgtgcaggggtgtggtgagggggcagtgatggctgtggcccacccctcggggtggagaaaagggtactttactctgcccccacaccctgtccttgttctgcccgatccgtctcggctctgcagcccctcggtcccctgacccccagggcaccgctgaccccgcctggcctcccactgtcccgcccgggcccactgtgggacgtgcacagctgatgtagcacacgctgccctctgccgcctcagccactttgggattatgcttgtcttgttttttttaggttttgttgtaatttagatctatttcatatatggtttggaaactttcagactcaatagaacaaaaactttgggtgggatgggtgtccctgtccccagcccaccatggcttggggtgggtcatctgtggccgttagggtgcgtccccctgctcccccgcccagggccagggaccactcgtctcccactgggggaaaaagggggtcccgggtgggcgactagtacgtgtgaagctgagctcagggccggacctggggagcgggggactccgctcgggcaggaggcagcggccagggctgggccagggcgagagtcggtcctcccggtgctgggctccccgtctgccttgaggggtgtgcatggatggagggtgcctgaggctgcaggcaggggatgaccgggacaggcctgggctggggcagttggaggtatgggcactggtaggggacagagggttagggatcatgttggggggccagggacagtggaggaagggcccatggaagatggggctgtttggtttgaggctggagtgcttcctttgaaatttaattactgttttttaagtggtagggctcacagactgtgtgaagtcctgtgtgaagtgctggtgtggccacctacccaggtgtccctcccttttgttttggaggcctgtgtccttgtccaggggcagccctccttcccaggtgtggccagaagaaccccccatcccaagacttgaaatgtctgttgctcacctctgtccctccagaactcggcttccccatcttcacttgcaaaacaagtgcagccctgcgcccatcagcaccccctccggtgtgcacacaggccagtgagcggtggccgaccagcgcaccccactcccccaacctccacaacccatcaagcggaggccgcctccgctaggggaggaccatgtgctgcaccctggcctggggacctacagggtgtgggttagacgcattcccactgggcggctcctttctgccccgaagcccacccctgtggcgaggccctaggagacctcccgtggggccgcctctacagacagcactcagcctcctgggctgcctccagccaggcccagcacatgcctgccctccagaaaaatacgttgctttccagaaggaggtgggggaccatgggcaggcactgtggacgctaacctcggcccctccacccattcctcagggcccacgtccagggggaccaagacctgcattcctagggctgcaggtggctcagtggtgcagaggcatccagaccttctgctgaactaagaaccacccagcctagagggagcctttctctgcctcttcctcccctgtcttgggcacaggtggggttggagcccccatggggcccgctgggaacctggaccaagccttcctcggagatgggaggaagccgcggggtggagcaggggcaggtaggtgaggttgagctgcacttgagttccctctggagtttccttcatctgccccacacccaaatttgcactttaatttgaccatccctgggggcctggctgctgacagaagggctctctctgccctccactccaaagtgggtgcccccccacccttggccaggacagggagggagccgctggctgctgccggaggtggtggctgcacagaggacgcctgactgctgttcaggcccgcacaatgtcccgtgccccttcctcactcgtttgtaatcgccgtctgttttgttctgggtaaggaaggcaagagctatagataaaacttaaataataataatttaatgtgaatgggttctgagctctccctgcgccccgggcgggccaggccgagcattttgcactaatgtgtcccacggtgggcgtgagtcgggagtgtctgtggacgtgcgtggctgctgagcggacctgctgtgtgctccctccacgtcctgaatgtaccgtggggcgggggcggcggcccgggctcagaggggccttccagagtgccttagcatcctttgatcatttttcccaaggaaaccaattaagaaagccggacccttccctcctttgtttacaagatgactaattctagaatccggggttgtcctgtcctgtgagtgtgaccctgactcatccagaccctgtagagagagacgagccactcagtatttatgagatgtctgcacctttatccctaagcctgactattagcaatacgcatatcctatatagaatctattacagagctacgttatctccacaccttttgaggaggacagaagggactggaccgtgttggagctgccgcctggcaggtggtgggcctgggatctagccgcctctcctgccctgccttcctcttccccaaggggatgggcccaggaggcagctgggttgcatggagaggtccaggagggaccggaggtgtgacagatactgtgagcccggcgggccgcgcctggctgggtgcctcggtacttgaattctgtcttgttttccgcattgtgtctgtccacccgagttctctgtcgtcacttaactttgcattggatttggttgttgtactttgcccctgaatgtggacaaagctgtgggcaagaggtcagcaggacccgcctgggggtgccggcgttggtgactgcgggtcggggctcctagaacataggagccggctgcctggcctcctttctcctccaggaagagtcattctttggcatttgtgtttagagccaggaggaaggcggaaggtagggagggagggctggtccccctctgagggggctctagtgcctgaccctgacctgtcctcattcgacagctgaaactgttaagcgctggcccagtccccccaccccacccagccgtgtactgcctgggctcccctcaaagggaaatttttatggaaacatcttggcagcaagtggaaaaagatctatggcccatgaaccaactgaaaactccaagaaccctctgtctgcctctgccagcagcgagtcctaagcgcagaatccagagctcgtagctgtcctcagctgtaactactgtttcagaatgttgctgctgcatacttttgtcatgtcagccagccagctccgtgggtgagagtgtgcgtgtgcgcgtgtctgtgtgtgtgtgcgtgtctgtgtgtgcacgtctgtgcgtctgtgtgtgcgcgtctgtgcatgtgtgtgtctgtgcgtgtgtgcgtctgtgtgtgtgcgtctgtgtgcgcgtgtgtgtgcgcgtctgtgtgtatgtgtgcacgcgcgtctgtgtgcacgtgcgtgtctctgcacgcgtgtctgtgtatgtgtgcacgcgtgtgtctgtgtgtgtgcacgcgcgtgcacgtcaccaccggagcatttagggtttggtacaagatggttctaaaatggcaaaggtttttcgtgtttgtttgttttgtttctttggaaaaagaaaaggaaaggaaaatcatgcagaatcgcaagcattcagactggacgaccggctcgtattccgatcagtcgcttccattgttagcatcgtacacgattgtgatttttatgtcaaaagaagccaaaacttgcaatactatttttagcagacaaaaaaaagaactaagtataaaatgtataaatatttttgacttgaagatttggatggcactgggtgcaagtagagcatccatccttcggatggaatgtttggaaaaaagagacttttaaaaaggagacggttgttttaaagagtctgtttaggggttaaagtactgtaactcacgactgttaaaaaataaattttcctgtgctgtaaaggaaggtttcacagtaccactgagttagatttcagccacagatgcttagctttttttttttgtcttttttttaaggaggaagcctttgttttgttttcctgagccctcactctgtttttgtgctgttactcggtagagtcaagactgttactttttagccatggctgacattgtatcaataactaaaactgaaacattcaaaagcgaacagggaaaccgagggcttcaagcgtgctcagagccgtttcagacagtggaaatccatgacaaacaaaaggatgtgatcattaattgtaaagcgctttgtaaaattcacatttacaaaataataaagtcagttcaaacctaa

SEQ ID NO: 1369 - DNA, 4002 bp, Homo sapiens
aatgcgcttgcgcacgtgctgtctaccagttcctgagagggacgcgtgccgcggagccaggcttactacgtgacccggacaccaggcatacgctaggggcagtcagctgtgccttctctttcggagttgttccgtgctcccacgtgcttccccttctccactggctgggatcccccgggctcggggcgcagtaataatttttcaccatgcatcggaaaaaggtggataaccgaatccggattctcattgagaatggagtagctgagcggcaaagatctctctttgttgtagttggggatcgaggaaaagatcaggtggtaatacttcatcacatgttatccaaagcaactgtgaaggctcggccttcagtgctgtggtgttataagaaagagctggggtttagcagtcaccggaagaaaagaatgcgacagctgcagaagaaaataaagaatggaacactgaacataaagcaggacgacccctttgaactcttcatagcagccacaaacattcgctactgctactacaacgagacccacaagatcctgggcaataccttcggcatgtgtgtgctgcaggattttgaagccttaactccaaacttgctggccaggactgtagaaacagtggaaggtggtgggctagtggtcatcctcctacggaccatgaactcactcaagcaattgtacacagtgactatggatgtgcattccaggtacagaactgaggcccatcaggatgtggtgggaagatttaatgaaaggtttattctgtctctggcctcttgtaagaagtgtctcgtcattgatgaccagctcaacatcctgcccatctcctcccacgttgccaccatggaggccctgcctccccagactccggatgagagtcttggtccttctgatctggagctgagggagttgaaggagagcttgcaggacacccagcctgtgggtgtgttggtggactgctgtaagactctagaccaggccaaagctgtcttgaaatttatcgagggcatctctgaaaagaccctgaggagtactgttgcactcacagctgctcgaggacggggaaaatctgcagccctgggattggcgattgctggggcggtggcatttgggtactccaatatctttgttacctccccaagccctgataacctccatactctgtttgaatttgtatttaaaggatttgatgctctgcaatatcaggaacatctggattatgagattatccagtctctaaatcctgaatttaacaaagcagtgatcagagtgaatgtatttcgagaacacaggcagactattcagtatatacatcctgcagatgctgtgaagctgggccaggctgaactagttgtgattgatgaagctgccgccatccccctccccttggtgaagagcctacttggcccctaccttgttttcatggcatccaccatcaatggctatgagggcactggccggtcactgtccctcaagctaattcagcagctccgtcaacagagcgcccagagccaggtcagcaccactgctgagaataagaccacgacgacagccagattggcatcagcgcggacactgtatgaggtttccctccaggagtcaatccgatacgcccctggggatgcagtggagaagtggctgaatgacttgctgtgcctggattgcctcaacatcactcggatagtctcaggctgccccttgcctgaagcttgtgaactgtactatgttaatagagataccctcttttgctaccacaaggcctctgaagttttcctccaacggcttatggccctctacgtggcttctcactacaagaactctcccaatgatctccagatgctctccgatgcacctgctcaccatctcttctgccttctgcctcccgtgccccccacccagaatgcccttccagaagtgcttgctgttatccaggtgtgccttgaaggggagatttctcgccagtccatcttgaacagtctgtctcgaggcaagaaggcttcaggggacctgattccatggacagtgtcagaacagttccaagatccagactttggtggtctgtctggtggaagggtcgttcgcattgctgttcacccagattatcaagggatgggctatggcagccgtgctctgcagctgctgcagatgtactatgaaggcaggtttccttgtctggaggaaaaggtccttgagacaccacaggaaattcacaccgtaagcagcgaggctgtcagcttgttggaagaggtcatcactccccggaaggacctgcctcctttactcctcaaattgaatgagaggcctgccgaacgcctggattacctgggtgtttcctatggcttgacccccaggctcctcaagttctggaaacgagctggatttgttcctgtttatctgagacagaccccgaatgacctgaccggagagcactcgtgcatcatgctgaagacgctcactgatgaggatgaggctgaccagggaggctggcttgcagccttctggaaagatttccgacggcggttcctagccttgctctcctaccagttcagtaccttctctccttccctggctctgaacatcattcagaacaggaacatggggaagccagcccagcctgccctgagccgggaggagctggaagcactcttcctcccctatgacctgaagcggctggagatgtattcacggaatatggtggactatcacctcatcatggacatgatcccggccatctctcgcatctatttcctgaaccagctgggggacctggccctgtctgcggctcagtcggctcttctcttggggattggcctgcagcataagtctgtggaccagctggaaaaggagattgagctgccctcgggccagttgatgggacttttcaaccggatcatccgcaaagttgtgaagctatttaatgaagttcaggaaaaggccattgaggagcagatggtggcagcgaaggatgtggtcatggagcccacgatgaagaccctcagtgacgacctagatgaagcagcaaaggaatttcaggagaaacacaagaaggaagtagggaagctgaagagcatggacctctctgaatacataatccgtggggacgatgaagagtggaatgaagttttgaacaaagctgggccgaacgcctcgatcatcagcctgaaaagtgacaagaaaaggaagttagaggccaaacaagaacccaaacagagcaagaagttgaagaacagagagacaaagaacaaaaaagatatgaaactgaagcggaagaaatagtgaagagaaactcgggcatctgtgtttgatcatgggaagatactctcactaactgaaccctctctggctggactgttaaaagcaacgagaggccccggcacacctggaagctggccgcgaattcggcctctgggcctgtgtgtctgtgagctcaacctggctaaaggcagagtcactcccaaatgggtctctttagaacttgatggctgggcactgccatctctagaattgccacgagtctctctcttcctgcccagtccagggccctcctttcctataagttcatattttgctttgagccagctttttagtctcattcccacacatgtggaagccacgttgcctctcgaccgcctgaggcccttaagtacatcgctttctggtggtgcccaggaggctgctgctgggccgctgggtctctctttgtggacttgtacctggagcaggaggaactccagtccgtcccggcatccatggcagcccgcggttaggtgcgccagggtttgctgatgttgtcttgtgctgttccactcttggctccagcagacccactgtcccagaaaagcctgatcctgtagtttatgtagaatgccacatctgcgtcctcaagacctgtttcatccatttgggaaaagatgttgggaaaggccactttgctcgcaggggtgaggggaaggatagagaatctatttttaataaataacattctagaaagatc

SEQ ID NO: 1370 - DNA, 3436 bp, Homo sapiens
gtgctgtctaccagttcctgagagggacgcgtgccgcggagccaggcttactacgtgacccggacaccaggcatacgctaggggcagtcagctgtgccttctctttcggagttgttccgtgctcccacgtgcttccccttctccactggctgggatcccccgggctcggggcgcagtcaccggaagaaaagaatgcgacagctgcagaagaaaataaagaatggaacactgaacataaagcaggacgacccctttgaactcttcatagcagccacaaacattcgctactgctactacaacgagacccacaagatcctgggcaataccttcggcatgtgtgtgctgcaggattttgaagccttaactccaaacttgctggccaggactgtagaaacagtggaaggtggtgggctagtggtcatcctcctacggaccatgaactcactcaagcaattgtacacagtgactatggatgtgcattccaggtacagaactgaggcccatcaggatgtggtgggaagatttaatgaaaggtttattctgtctctggcctcttgtaagaagtgtctcgtcattgatgaccagctcaacatcctgcccatctcctcccacgttgccaccatggaggccctgcctccccagactccggatgagagtcttggtccttctgatctggagctgagggagttgaaggagagcttgcaggacacccagcctgtgggtgtgttggtggactgctgtaagactctagaccaggccaaagctgtcttgaaatttatcgagggcatctctgaaaagaccctgaggagtactgttgcactcacagctgctcgaggacggggaaaatctgcagccctgggattggcgattgctggggcggtggcatttgggtactccaatatctttgttacctccccaagccctgataacctccatactctgtttgaatttgtatttaaaggatttgatgctctgcaatatcaggaacatctggattatgagattatccagtctctaaatcctgaatttaacaaagcagtgatcagagtgaatgtatttcgagaacacaggcagactattcagtatatacatcctgcagatgctgtgaagctgggccaggctgaactagttgtgattgatgaagctgccgccatccccctccccttggtgaagagcctacttggcccctaccttgttttcatggcatccaccatcaatggctatgagggcactggccggtcactgtccctcaagctaattcagcagctccgtcaacagagcgcccagagccaggtcagcaccactgctgagaataagaccacgacgacagccagattggcatcagcgcggacactgtatgaggtttccctccaggagtcaatccgatacgcccctggggatgcagtggagaagtggctgaatgacttgctgtgcctggattgcctcaacatcactcggatagtctcaggctgccccttgcctgaagcttgtgaactgtactatgttaatagagataccctcttttgctaccacaaggcctctgaagttttcctccaacggcttatggccctctacgtggcttctcactacaagaactctcccaatgatctccagatgctctccgatgcacctgctcaccatctcttctgccttctgcctcccgtgccccccacccagaatgcccttccagaagtgcttgctgttatccaggtgtgccttgaaggggagatttctcgccagtccatcttgaacagtctgtctcgaggcaagaaggcttcaggggacctgattccatggacagtgtcagaacagttccaagatccagactttggtggtctgtctggtggaagggtcgttcgcattgctgttcacccagattatcaagggatgggctatggcagccgtgctctgcagctgctgcagatgtactatgaaggcaggtttccttgtctggaggaaaaggtccttgagacaccacaggaaattcacaccgtaagcagcgaggctgtcagcttgttggaagaggtcatcactccccggaaggacctgcctcctttactcctcaaattgaatgagaggcctgccgaacgcctggattacctgggtgtttcctatggcttgacccccaggctcctcaagttctggaaacgagctggatttgttcctgtttatctgagacagaccccgaatgacctgaccggagagcactcgtgcatcatgctgaagacgctcactgatgaggatgaggctgaccagggaggctggcttgcagccttctggaaagatttccgacggcggttcctagccttgctctcctaccagttcagtaccttctctccttccctggctctgaacatcattcagaacaggaacatggggaagccagcccagcctgccctgagccgggaggagctggaagcactcttcctcccctatgacctgaagcggctggagatgtattcacggaatatggtggactatcacctcatcatggacatgatcccggccatctctcgcatctatttcctgaaccagctgggggacctggccctgtctgcggctcagtcggctcttctcttggggattggcctgcagcataagtctgtggaccagctggaaaaggagattgagctgccctcgggccagttgatgggacttttcaaccggatcatccgcaaagttgtgaagctatttaatgaagttcaggaaaaggccattgaggagcagatggtggcagcgaaggatgtggtcatggagcccacgatgaagaccctcagtgacgacctagatgaagcagcaaaggaatttcaggagaaacacaagaaggaagtagggaagctgaagagcatggacctctctgaatacataatccgtggggacgatgaagagtggaatgaagttttgaacaaagctgggccgaacgcctcgatcatcagcctgaaaagtgacaagaaaaggaagttagaggccaaacaagaacccaaacagagcaagaagttgaagaacagagagacaaagaacaaaaaagatatgaaactgaagcggaagaaatagtgaagagaaactcgggcatctgtgtttgatcatgggaagatactctcactaactgaaccctctctggctggactgttaaaagcaacgagaggccccggcacacctggaagctggccgcgaattcggcctctgggcctgtgtgtctgtgagctcaacctggctaaaggcagagtcactcccaaatgggtctctttagaacttgatggctgggcactgccatctctagaattgccacgagtctctctcttcctgcccagtccagggccctcctttcctataagttcatattttgctttgagccagctttttagtctcattcccacacatgtggaagccacgttgcctctcgaccgcctgaggcccttaagtacatcgctttctg

SEQ ID NO: 1371 - DNA, 2101 bp, Homo sapiens
ttcattataaatctagagactccaggattttaacgttctgctggactgagctggttgcctcatgttattatgcaggcaactcactttatcccaatttcttgatacttttccttctggaggtcctatttctctaacatcttccagaaaagtcttaaagctgccttaaccttttttccagtccacctcttaaattttttcctcctcttcctctatactaacatgagtgtggatccagcttgtccccaaagcttgccttgctttgaagcatccgactgtaaagaatcttcacctatgcctgtgatttgtgggcctgaagaaaactatccatccttgcaaatgtcttctgctgagatgcctcacacggagactgtctctcctcttccttcctccatggatctgcttattcaggacagccctgattcttccaccagtcccaaaggcaaacaacccacttctgcagagaagagtgtcgcaaaaaaggaagacaaggtcccggtcaagaaacagaagaccagaactgtgttctcttccacccagctgtgtgtactcaatgatagatttcagagacagaaatacctcagcctccagcagatgcaagaactctccaacatcctgaacctcagctacaaacaggtgaagacctggttccagaaccagagaatgaaatctaagaggtggcagaaaaacaactggccgaagaatagcaatggtgtgacgcagaaggcctcagcacctacctaccccagcctttactcttcctaccaccagggatgcctggtgaacccgactgggaaccttccaatgtggagcaaccagacctggaacaattcaacctggagcaaccagacccagaacatccagtcctggagcaaccactcctggaacactcagacctggtgcacccaatcctggaacaatcaggcctggaacagtcccttctataactgtggagaggaatctctgcagtcctgcatgcagttccagccaaattctcctgccagtgacttggaggctgccttggaagctgctggggaaggccttaatgtaatacagcagaccactaggtattttagtactccacaaaccatggatttattcctaaactactccatgaacatgcaacctgaagacgtgtgaagatgagtgaaactgatattactcaatttcagtctggacactggctgaatccttcctctcccctcctcccatccctcataggatttttcttgtttggaaaccacgtgttctggtttccatgatgcccatccagtcaatctcatggagggtggagtatggttggagcctaatcagcgaggtttctttttttttttttttcctattggatcttcctggagaaaatactttttttttttttttttttgaaacggagtcttgctctgtcgcccaggctggagtgcagtggcgcggtcttggctcactgcaagctccgtctcccgggttcacgccattctcctgcctcagcctcccgagcagctgggactacaggcgcccgccacctcgcccggctaatattttgtatttttagtagagacggggtttcactgtgttagccaggatggtctcgatctcctgaccttgtgatccacccgcctcggcctccctaacagctgggatttacaggcgtgagccaccgcgccctgcctagaaaagacattttaataaccttggctgccgtctctggctatagataagtagatctaatactagtttggatatctttagggtttagaatctaacctcaagaataagaaatacaagtacaaattggtgatgaagatgtattcgtattgtttgggattgggaggctttgcttattttttaaaaactattgaggtaaagggttaagctgtaacatacttaattgatttcttaccgtttttggctctgttttgctatatcccctaatttgttggttgtgctaatctttgtagaaagaggtctcgtatttgctgcatcgtaatgacatgagtactgctttagttggtttaagttcaaatgaatgaaacaactatttttcctttagttgattttaccctgatttcaccgagtgtttcaatgagtaaatatacagcttaaacat

SEQ ID NO: 1372 - DNA, 870 bp, Homo sapiens
atgagtgtggatccagcttgtccccaaagcttgccttgctttgaagcatccgactgtaaagaatcttcacctatgcctgtgatttgtgggcctgaagaaaactatccatccttgcaaatgtcttctgctgagatgcctcacacggagactgtctctcctcttccttcctccatggatctgcttattcaggacagccctgattcttccaccagtcccaaaggcaaacaacccacttctgcagagaagagtgtcgcaaaaaaggaagacaaggtcccggtcaagaaacagaagaccagaactgtgttctcttccacccagctgtgtgtactcaatgatagatttcagagacagaaatacctcagcctccagcagatgcaagaactctccaacatcctgaacctcagctacaaacaggtgaagacctggttccagaaccagagaatgaaatctaagaggtggcagaaaaacaactggccgaagaatagcaatggtgtgacgcagggatgcctggtgaacccgactgggaaccttccaatgtggagcaaccagacctggaacaattcaacctggagcaaccagacccagaacatccagtcctggagcaaccactcctggaacactcagacctggtgcacccaatcctggaacaatcaggcctggaacagtcccttctataactgtggagaggaatctctgcagtcctgcatgcagttccagccaaattctcctgccagtgacttggaggctgccttggaagctgctggggaaggccttaatgtaatacagcagaccactaggtattttagtactccacaaaccatggatttattcctaaactactccatgaacatgcaacctgaagacgtgtga

SEQ ID NO: 1373 - DNA, 907 bp, Homo sapiens
atctaccttatctggtcggtcatctctgtaacctccctaccaaggactaattggtctttaaaactcctcaatgcaccgggcgcggtggctcacgcctgtaatcccagcactttgggaggccgaggcgggcagatcacgaggtcaggaaatcgagaccatcttggctaacaagaaacaatcagctatgccttgggatcaagatccagaacaatcaactggaaattacagtgaagatgaacaaaatggaaagcagaaatggagagaagaaggagaagcaggcagaaagagagaacgagaaaaagaagaaaaaaacgaaaaggagctgcaagatgaacaggaaaacaaaaggaaaagggaaaatgagaaacagaaacagtatcccgagaaaagattagtcagcaaatccctcatgcatactctctgggcaaagtttaagttaaacaggtgccccactatacaagagagtctatcactgtcatttgaatttgacatgacacataaacagataagtcaatggttttgtaaaacgaggaagaaatataataaagaaatgtccaagagaaagcataagaaaaaacatatgagatggagatctctgtgttgccaaggctggtctcgaactcctgccctcaagtgatcttcctattttggcctccagaaatgctgtgattacaagcatgagccatcgcactggctaagacattttacatgacaccattctcaccaataaatggagttctgaaaggataaacaagaaaacattaacagtcgttgattccgtggagtagaactaaatgaggggtatgcaaaggagtttttatgtgttttatttttaccctactgtagatttaaagtttttataatggatgttaattgattttatttaagaaaaaaaatcgagtcaagg

SEQ ID NO: 1374 - DNA, 7104 bp, Homo sapiens
ggcccggcccgcggcggcggcaaaggggcggaggggttcgctgccagcaattgccaagctgctgcggtcgtggcgggatggtatagccgggcctgagggcgggcggcggggcgcgggcgggggcgaggcggccgggaagggccgacgccgcctgactggcttgggagcagcggcagcaagctgagggggcgtcgccgccgccggcccccggcgccgccgcgggaggccgcgcccgccatggcggcccgggcggtgctggacgagttcactgcgccagctgagaaggcggagctgctggagcagagccgcggccgtatcgagggcctgtttggcgtgagcctagccgtgctcggcgcgctaggggctgaggagccgctgcccgcgcgcatctggctgcagctctgcggggcgcaggaggcggtgcacagcgccaaggaatatattaaaggaatctgtgaacctgaactagaagaaagagaatgttaccccaaggacatgcactgcatttttgttggggcagagagcctgtttctgaaaagcttgattcaggatacttgtgctgacctctgcattctggacattggccttcttggcatcagaggaagtgctgaggctgtggtcatggctaggagtcacattcaacaatttgtaaagctctttgaaaataaagagaacctacccagtagtcagaaagaatcagaggtgaaaagggaattcaaacaatttgttgaagcccatgcagacaattacacaatggatttgttgattttgcccacttccttgaaaaaagaacttttgacactcacacaaggtgaggagaatctctttgaaacaggagatgatgaggttattgaaatgagagattctcaacaaacagagtttacacagaatgctgccacagggctgaatatttctagagatgaaactgttttgcaggaagaggcaagaaataaagctgggactcctgtttctgagcttacaaaacaaatggacacagtcctttctagctcaccagatgtgctttttgatccaataaatggtctaaccccagatgaagaggcactttccaatgagagaatttgtcagaaaaggagattttctgattctgaagaaaggcatacgaagaagcagttttctttggaaaatgttcaggagggggagattttacacgatgctaagacattggctggaaatgtaatagctgacctatctgattcttctgctgattctgaaaatttaagtccagatataaaagaaactactgaggaaatggaatacaacatcctcgtaaacttttttaaaaccatgggctactcccaagaaattgttgaaaaggtcattaaggtgtatggaccatctactgaaccattattgctcttagaggaaattgaaaaagaaaataaaagattccaagaagacagagaattttcagctggtacagtgtatccagagaccaacaaaaccaaaaataaaggtgtttatagcagcacaaatgagcttacaactgattccactccaaagaaaacacaggctcacacacagcaaaatatggtagaaaaattttctcagttaccattcaaagtggaagctaaaccatgtacctcaaattgtagaattaatactttcagaacagtgccaatagaacagaaacatgaagtctggggttcaaaccagaactacatttgtaacacagaccctgaaactgatggcctttcaccttctgttgcctctccaagtcccaaagaagtcaattttgtttcaaggggagcttcaagtcaccagcccagagttccactttttcctgaaaatggtttacaccagcagccagaacccttgcttccaaataatatgaaatctgcctgtgaaaaacgtttaggatgttgtagttctcctcattctaagccaaattgctcaaccctttctccaccaatgccactgccccagctgttaccttcggttactgatgcaaggtcggcaggaccttctgatcatattgattcctcagttactggggttcaaaggtttcgagatactctaaaaataccctacaagctggaattaaaaaatgaaccagggagaacggatttgaaacacattgttatagatgggagcaatgttgcaattacccatggtctgaaaaagttcttttcttgtcgtggaattgcaattgcagttgaatatttttggaagcttggcaacagaaacatcactgtatttgtccctcagtggagaacaaggcgtgatcctaatgtcacagaacagcacttcttaacccagctccaggagctcggaatattatctttaactcctgcccggatggtctttggagaaagaattgcttctcatgatgacaggtttctactacacttagcggacaaaactggtggcataattgtgacaaatgataatttcagagaatttgtgaatgagtcagtctcttggagagaaattattacaaaaaggctgctgcagtacacgttcgtgggggacatatttatggttcccgatgatcctctgggaagaagtggacctcgattagaggagtttcttcagaaggaagtctgtcttagagatatgcagcccctactcagtgccctgccaaatgtgggcatgtttgaccccagcttcagagtccctggcacccaggcagccagcaccagccaccagcctccgacccggattcagggagccccttcaagccactggctccctcagcagccccacttcccactgctgccagccctccccagtctccagcagaacctgcccatgccagctcagagatcttctgcagaaaccaacgagctgagggaagcccttctgaagatcttccctgactcagagcaaagactgaaaatagaccagatcttggtggcccacccatacatgaaagatctaaatgcgctttctgccatggtgttggattgaagattgtgctgagcgctgagcttgcgctcagggctggctgatcaaactcaagctcacacctgtacctgatgggaatgaacataatgtgaagaaacttatttcccagtgtaaacgcagttgtacagaaaaaaaatgttttgggtataaatctgggttttcaaaaccagcttttttctatatataaattatgctgctattacagatttaacattttctgttaaaggaaagtctacattttctgcctgttcagaactgtttaatagcagttactcttgagtgtatttacctttttatgttttttaaactattttccttaaagccgaaaatattgacaaatggatatggttagcctttataaataaataaaaaaaaaagtgttgctttcttaaggaaagcaagacgtcttaaagtatattttcttgagatgagtatgtcccatcactaccatgaagtgtgctcacccttccagcctcctctgccctcacccccggagttaaagtgggtaagagttggtttgttctgcagtctttggttggagtgttgtgaaagtggacccgcggtgccactagatggcacttggtgcctagccatggtgaatgaccagggcgaagttagtctcacagaataccagggctagaagacatcgtggagcccatggagtcccaccctccttcccccttccaccctgcgcaaaaggggacggcccagtgtgcacgccgtccggccatgcccacagccacagccacagctgaggagtggccgggcaggcagcaggctccccagccagggcttgacacgcccacagtcaggggcctccacatgcctggcctggctctggaagtcacgtcttagcttctgaacaccgtagcgggttatgaggaagtttaatgaagagcccggtcactgtggccatcttgtgtccccaactgcaggagacgccctgatgtggagtttgtacagctttgccaaaaaatggttttctattctcaaaagtgacccaagccaataaatagcattagtagcttctgtggggggatcccagagcccctgtatttattttccctgtgtttgtctctagtgtcctcctaaacagcctttcctgtgagtctttctcagaattgatatcttaatattgtctgttctaggtgttgcccaaattcagtgtcagtgaagttcttttcctgggcaatcttaacatctttactcttattgtctggaccttcaaagggctttgtattttacacctgcgcccccaggctgctcacagtcggcttgctgcctgtcctgcctgtccggatcttgtctcctagtcctgaggagcggaggctgagaactcagtgctggtttgtaaatggtgaggggacttgggggcatcccagagtgctccctccaggcctgcttcttggttttgtttgatcactgcgttcttcaagggatgaatccagagccctccatgaggccaagcttgtccttcaatcatgtttcctctcagatgcgtccgtgatgcctcctaatgtggaactggttgtccattgtttgggcctatggccaagtcacccagctgtggaagcagaggtagaagacgaggccagccaggagggcgacttcagtcacagctcccatgcctcagctttgtacctgttttcaaaagcacaactgaggtgtgcgggctggagctgtcttgcagtgattctggccttctggctcatggttcagtccagcagcctggctgacccactatttctcctctgcttcagaggaaacccaggaaatgcccttactgccaggctgagtctccacccatgctggttggtgctggctaggctgagggggccaccacttttcctggctagaagctacttgacctttgatgtttgagttctgtaagtcttcgtgttctgacttactgcttcagagggattggcctgtcccctttccctttctcggctatgggaaggaaggattgctcattggttgccttcatcagttacagcatgagacggaattcatcattccttccgaaacccctgatatttaatatttaatatttaaaaacccaaattatcaaaccattaagaactcattactggttctcagcctcctccagtactagcctcagtgtggctgctgcataagtatctgtagcctgtctacctcctgcagtggggccgctcgcctcttccctgtctactgctcaggctctcccacttcgtggcatccatgtaaagtaggtggcagggcagagatgtcactctcattcaacagggaggatgtctgttgctcagagaggttgtcctgaggggctgggtgattcctgggcctacattcttcccgaggctccaggccgctgtctctggaagtaaaagagccttgtctgaccttaatgcaagcagtctgtttgaacccctgtaggctgcattcaggagacagaaggtgtctgggccatcctgggcggccggtcagcgttgctaggcaggctcggctgtctggccgggacttgggcctgggtggcttttgagaccagtgaagaagggagagccggcctcatgccgatgcggcttgtggcacggctgggatgtgagggaggactcagatctacacacagaaacccctcttctccccgccctcccccagctcctacctgcctcccacgcctcaggtgtggctgcctgtgggaccatcccccaacccctttcctcgcacctccttgtcctcacccagttcctgcagtgtctctgacccacgcctcccgcctcctggccgacttgcccaggaggtgtctctggctcacctccgtctgttcatcaccttcctccccagtgtttccacttatcttggatgttttagattgaaacagcctgattcccggaagaatcctcttcattcattgctagtgcttcccctcacctcccactctccacttcccagtttgcaaatgtggctttcgcccaccaagtgaaagcggactgagagcagcccttggggacggcccggtgcctggctgcaaggccgcgctggggctctgtcttggtgcacatggcttgaccggactttccctgcttcccaccacttccctcactcccagacctccctcattctttttgtctcttctttttgcctaaagccagtccttaacaccctattcttcctctgcaggtggcttgcagacttttccccacctttggggctcgtggtggtggagagggcagctggtgttaagaatgtaggttaccgggcatgacccggcagatgcttgcccagtagttctggaggaaggcccgggaatctgcaaatgagcgcattccccaggcagttcccatgcaggtgatccacggaccacatgttgagaaactgcagtcacccttagggccacaccgtccctctcctcgctgtcccctctctgtagtgactggccctgaccttcaggagtgcactttccactctaccaggaagccctatgacatcctcaggctccccagacctgcagcttgcatggggcccctcccttcttccacacccaccctccgtatggtcccctgctctgccctcgtgctttgctggcccctgcccgctactcccactctcagacacccaggggtggtgggccctaactggctggcccctcccagcgctgccctctgccgtccagatgctgcagtgtggccagatttaccttccagtaacatacttctagtcacccctcctcctgcgaagtgatctgcagtggctgtttgaccagaccacaaagttcacatctcctgagcttagtgtccgtggctgtccacctcccagccatacttgactgtccccaaactctccctgcagccacatgtttcccatgacctgtgggctctgcagatggacctctctccgctagagatgcccttctcccaaatggcttccctcctggaaggcccagcctgagtcctcgtctcctttccagtgcttctgccagaagcatccccatgatgttgtgaccgcacagcactttgtgtctcgctttgagcacttgccactctggctggtgctgctgccactgattgtgtactgtcttgctgccctttctagactgtgagctcctcgtgggcagggaccgcctgtgttctctgtatttcccacggcgcctagcacagtgccttgcacttgataggtgcttaataaatgtctgctcaactg

SEQ ID NO: 1375 - DNA, 3132 bp, Homo sapiens
ggcggccgctgccgcatccgggcactctgctggtcgcggcgggagtggcgtggcgcagggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaaatagctgaaacctttggacttcaagaaaattatatcaaaattgtcataaataagaagcaactacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagcagagacagtggtggatccagaaatgacaccgtacttagacatagctaaccagacaggcagatcaatcagaattcccccatcagaaagaaaagcccttatgttagctatgggatatcatgagaagggcagagctttcctgaaaagaaaagaatatggaatagccttgccatgtctgttggacgctgacaaatatttctgtgagtgttgcagagagctgctggacacagtggataactacgccgtcctccagctggatatagtgtggtgttacttccgcctggaacagctggaatgccttgatgatgcagaaaaaaaattaaacttggcccagaaatgctttaaaaattgttacggagaaaatcatcagagactggtccacataaaaggaaattgtgggaaagagaaggtactgtttctaagactctacttacttcaagggatccgaaactatcacagtggaaatgatgtagaggcttatgagtatcttaacaaggcacgtcagctctttaaagagctatatattgatccatcaaaagtggacaatttgttgcagttggggtttactgcccaggaagcccggcttggcctgagggcgtgtgatgggaacgtggatcatgcggccactcatattaccaaccgcagagaggaactggcccaaataaggaaggaggaaaaagagaagaaaagacgccgcctcgagaacatcaggtttctgaaagggatgggctactccacgcacgcggcccagcaggtactccacgcagccagcgggaacttggatgaggccctgaagattctgctcagcaatcctcagatgtggtggttaaatgattccaatcctgaaaccgacaaccgtcaagaaagtccttcccaggaaaacattgaccgattggtgtacatgggttttgatgcactcgtggccgaagctgcgctgagagtgttcagaggcaacgtccagctggccgcccagacccttgctcacaacggaggaagcctgcctcccgagctgccgctgtcgccagaagactctttgtccccgccagccacgtccccttctgactccgcaggaacctctagtgcctcaacagacgaagacatggagacagaggccgtcaatgagatactggaagacattccagagcatgaggaagactatcttgactcaactctggaagatgaagaaattattattgcagagtacctatcctatgtagaaaataggaagtcagcaacaaagaaaaactaaataatgaacagaaatagcgctaattttctgcttataaatgctatcattatgaaaaggctaatgcagctctttctgttcttactttttatctgaattacaagtcctctttgggtgtaggagggggtgggcaggggacaagtccaggaggggtcccagggccttcatgcgtggtctcggggaagaagcttcctctggcctggcgcaggccgttccatctgcctcccaggtctgcgtccctaaccccttccccagcttggtgttttaccccgaaacaggaaggaacaggggtcctgtagaacaggggtcctggggaaggtgtccagggcagggtcctgggaagggtgtcccgaccgcttcctctccagctgtggctccatctgcccagcttgcctgcctcctgcacccactgccctgaccttcctgcttcccacgctgccatctctgccagggtgccacatgggttcctgtgccaccctttccccgcccctcaaatcgtcctttaagtcttccttccaagtgctgtggggcataacgatgaggcgctggccttgggggccacaccaggtcgcagcaaatggcttcagcctgggacgccagtgttttatgctcttagttcagtaaaatacgcccccgaaattcaagattgagtgtcaggctttatatatattcagcattcctcattacagaaatcttctattgaatgggaaaggtttaaatgctaaccaaagcaatttatttttaattaatatttttagactctgtgctgtcatactgaactcactgctagctaagagacctatcagagatttagatatattttctccaggttttttgtgggttttctttgttgttgttgttgttctagccatgtgacagaggctctttctaaaagtatgtagttcgctgtgtgtcggctccagcagtaaccgtcctcactgcgccacgcactcctctgtagatgtgtgcccagtgggagttccttccagccccaggaccacagcagcagccaggtgccgagtggattgagtgccaggtgcatccaagactttccctcccttccagaaggcactgactgaagacaggatggatcatgcggagccggctgaaatgctccaactttttcaaagtgtgggtggtccagtttggactgatgggaatcttcttgtcattctttttaaacggatgataccgatggaaataaaaggtgggaaatatattcaaaaa

SEQ ID NO: 1376 - DNA, 3180 bp, Homo sapiens
accctctttccaagcggcggcggcggcggcggcgcgaaggcgacagcggcggcgggggcggggctggcctcacccggaatgaaaacaaacggcggccgctgccgcatccgggcactctgctggtcgcggcgggagtggcgtggcgcagggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaaatagctgaaacctttggacttcaagaaaattatatcaaaattgtcataaataagaagcaactacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagcagagacagtggtggatccagaaatgacaccgtacttagacatagctaaccagacaggcagatcaatcagaattcccccatcagaaagaaaagcccttatgttagctatgggatatcatgagaagggcagagctttcctgaaaagaaaagaatatggaatagccttgccatgtctgttggacgctgacaaatatttctgtgagtgttgcagagagctgctggacacagtggataactacgccgtcctccagctggatatagtgtggtgttacttccgcctggaacagctggaatgccttgatgatgcagaaaaaaaattaaacttggcccagaaatgctttaaaaattgttacggagaaaatcatcagagactggtccacataaaaggaaattgtgggaaagagaaggtactgtttctaagactctacttacttcaagggatccgaaactatcacagtggaaatgatgtagaggcttatgagtatcttaacaaggcacgtcagctctttaaagagctatatattgatccatcaaaagtggacaatttgttgcagttggggtttactgcccaggaagcccggcttggcctgagggcgtgtgatgggaacgtggatcatgcggccactcatattaccaaccgcagagaggaactggcccaaataaggaaggaggaaaaagagaagaaaagacgccgcctcgagaacatcaggtttctgaaagggatgggctactccacgcacgcggcccagcagattctgctcagcaatcctcagatgtggtggttaaatgattccaatcctgaaaccgacaaccgtcaagaaagtccttcccaggaaaacattgaccgattggtgtacatgggttttgatgcactcgtggccgaagctgcgctgagagtgttcagaggcaacgtccagctggccgcccagacccttgctcacaacggaggaagcctgcctcccgagctgccgctgtcgccagaagactctttgtccccgccagccacgtccccttctgactccgcaggaacctctagtgcctcaacagacgaagacatggagacagaggccgtcaatgagatactggaagacattccagagcatgaggaagactatcttgactcaactctggaagatgaagaaattattattgcagagtacctatcctatgtagaaaataggaagtcagcaacaaagaaaaactaaataatgaacagaaatagcgctaattttctgcttataaatgctatcattatgaaaaggctaatgcagctctttctgttcttactttttatctgaattacaagtcctctttgggtgtaggagggggtgggcaggggacaagtccaggaggggtcccagggccttcatgcgtggtctcggggaagaagcttcctctggcctggcgcaggccgttccatctgcctcccaggtctgcgtccctaaccccttccccagcttggtgttttaccccgaaacaggaaggaacaggggtcctgtagaacaggggtcctggggaaggtgtccagggcagggtcctgggaagggtgtcccgaccgcttcctctccagctgtggctccatctgcccagcttgcctgcctcctgcacccactgccctgaccttcctgcttcccacgctgccatctctgccagggtgccacatgggttcctgtgccaccctttccccgcccctcaaatcgtcctttaagtcttccttccaagtgctgtggggcataacgatgaggcgctggccttgggggccacaccaggtcgcagcaaatggcttcagcctgggacgccagtgttttatgctcttagttcagtaaaatacgcccccgaaattcaagattgagtgtcaggctttatatatattcagcattcctcattacagaaatcttctattgaatgggaaaggtttaaatgctaaccaaagcaatttatttttaattaatatttttagactctgtgctgtcatactgaactcactgctagctaagagacctatcagagatttagatatattttctccaggttttttgtgggttttctttgttgttgttgttgttctagccatgtgacagaggctctttctaaaagtatgtagttcgctgtgtgtcggctccagcagtaaccgtcctcactgcgccacgcactcctctgtagatgtgtgcccagtgggagttccttccagccccaggaccacagcagcagccaggtgccgagtggattgagtgccaggtgcatccaagactttccctcccttccagaaggcactgactgaagacaggatggatcatgcggagccggctgaaatgctccaactttttcaaagtgtgggtggtccagtttggactgatgggaatcttcttgtcattctttttaaacggatgataccgatggaaataaaaggtgggaaatatattcaaaaa

SEQ ID NO: 1377 - DNA, 619 bp, Homo sapiens
actctgctggtcgcggcgggagtggcgtggcgcaggtgaggacacggcggccgagtgtcctcgaccccagcctcagcagcactgcttggcgccccggttcccggtccgactgggcacctctcctggccaggggtggagcggccgcggggcggggggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaaatagctgaaacctttggacttcaagaaaattatatcaaaattgtcataaataagaagcaactacaactagggaaaacccttgaagaacaaggcgtggctcacaatgtgaaagcgatgg

SEQ ID NO: 1378 - DNA, 767 bp, Homo sapiens
cagggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaaatagctgaaacctttggacttcaagaaaattatatcaaaattgtcataaataagaagcaactacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagcagagacagtggtggatccagaaatgacaccgtacttagacatagctaaccagacaggcagatcaatcagaattcccccatcagaaagaaaagcccttatgttagctatgggatatcatgagaagggcagagctttcctgaaaagaaaagaatatggaata

SEQ ID NO: 1379 - DNA, 1013 bp, Homo sapiens
gcggcgggagtggcgtggcgcagggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaggctgtcaggggtggattcaggaagtggcatgcaacacacatgcgtagaagaatagctgaaacctttggacttcaagaaaattatatcaaaattgtcataaataagaagcaactacaactaggcccttatgttagctatgggatatcatgagaagggcagagctttcctgaaaagaaaagaatatggaatagccttgccatgtctgttggacgctgacaaatatttctggtaggcgcttttgtacttggtgaacaccagctttaaggaagatggcccagactatacagaacaccctgccatgcccttgagactgcagactttcatctacaacagtggttaatgtaaaagagtagttatggtgtaaactggtgaatttcttcttccctttgtatttctaattgacctttcctccctgtaaagaaaagaattttcaagcaggtaggatatcctctcttcttctgtacatgtgctatgttgctagtcggaactttccattataaagtttcctgtcagcttttcacctaatggttttggggtagtattgatgattattcctcaaatccgttgtttaagagctgtataatggtgatattattccttctgtacttattttttttgagacagagtctcactctgtcaccca

SEQ ID NO: 1380 - DNA, 3102 bp, Homo sapiens
ccggaatgaaaacaaacggcggccgctgccgcatccgggcactctgctggtcgcggcgggagtggcgtggcgcagggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaaatagctgaaacctttggacttcaagaaaattatatcaaaattgtcataaataagaagcaactacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagcagagacagtggtggatccagaaatgacaccgtacttagacatagctaaccagacaggcagatcaatcagaattcccccatcagaaagaaaagcccttatgttagctatgggatatcatgagaagggcagagctttcctgaaaagaaaagaatatggaatagccttgccatgtctgttggacgctgacaaatatttctgtgagtgttgcagagagctgctggacacagtggataactacgccgtcctccagctggatatagtgtggtgttacttccgcctggaacagctggaatgccttgatgatgcagaaaaaaaattaaacttggcccagaaatgctttaaaaattgttacggagaaaatcatcagagactggtccacataaaaggaaattgtgggaaagagaaggtactgtttctaagactctacttacttcaagggatccgaaactatcacagtggaaatgatgtagaggcttatgagtatcttaacaaggcacgtcagctctttaaagagctatatattgatccatcaaaagtggacaatttgttgcagttggggtttactgcccaggaagcccggcttggcctgagggcgtgtgatgggaacgtggatcatgcggccactcatattaccaaccgcagagaggaactggcccaaataaggaaggaggaaaaagagaagaaaagacgccgcctcgagaacatcaggtttctgaaagggatgggctactccacgcacgcggcccagcagattctgctcagcaatcctcagatgtggtggttaaatgattccaatcctgaaaccgacaaccgtcaagaaagtccttcccaggaaaacattgaccgattggtgtacatgggttttgatgcactcgtggccgaagctgcgctgagagtgttcagaggcaacgtccagctggccgcccagacccttgctcacaacggaggaagcctgcctcccgagctgccgctgtcgccagaagactctttgtccccgccagccacgtccccttctgactccgcaggaacctctagtgcctcaacagacgaagacatggagacagaggccgtcaatgagatactggaagacattccagagcatgaggaagactatcttgactcaactctggaagatgaagaaattattattgcagagtacctatcctatgtagaaaataggaagtcagcaacaaagaaaaactaaataatgaacagaaatagcgctaattttctgcttataaatgctatcattatgaaaaggctaatgcagctctttctgttcttactttttatctgaattacaagtcctctttgggtgtaggagggggtgggcaggggacaagtccaggaggggtcccagggccttcatgcgtggtctcggggaagaagcttcctctggcctggcgcaggccgttccatctgcctcccaggtctgcgtccctaaccccttccccagcttggtgttttaccccgaaacaggaaggaacaggggtcctgtagaacaggggtcctggggaaggtgtccagggcagggtcctgggaagggtgtcccgaccgcttcctctccagctgtggctccatctgcccagcttgcctgcctcctgcacccactgccctgaccttcctgcttcccacgctgccatctctgccagggtgccacatgggttcctgtgccaccctttccccgcccctcaaatcgtcctttaagtcttccttccaagtgctgtggggcataacgatgaggcgctggccttgggggccacaccaggtcgcagcaaatggcttcagcctgggacgccagtgttttatgctcttagttcagtaaaatacgcccccgaaattcaagattgagtgtcaggctttatatatattcagcattcctcattacagaaatcttctattgaatgggaaaggtttaaatgctaaccaaagcaatttatttttaattaatatttttagactctgtgctgtcatactgaactcactgctagctaagagacctatcagagatttagatatattttctccaggttttttgtgggttttctttgttgttgttgttgttctagccatgtgacagaggctctttctaaaagtatgtagttcgctgtgtgtcggctccagcagtaaccgtcctcactgcgccacgcactcctctgtagatgtgtgcccagtgggagttccttccagccccaggaccacagcagcagccaggtgccgagtggattgagtgccaggtgcatccaagactttccctcccttccagaaggcactgactgaagacaggatggatcatgcggagccggctgaaatgctccaactttttcaaagtgtgggtggtccagtttggactgatgggaatcttcttgtcattctttttaaacggatgataccgatggaaataaaaggtgggaaatatattc

SEQ ID NO: 1381 - DNA, 3210 bp, Homo sapiens
agcggcggcggcggcggcggcgcgaaggcgacagcggcggcgggggcggggctggcctcacccggaatgaaaacaaacggcggccgctgccgcatccgggcactctgctggtcgcggcgggagtggcgtggcgcagggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaaatagctgaaacctttggacttcaagaaaattatatcaaaattgtcataaataagaagcaactacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagcagagacagtggtggatccagaaatgacaccgtacttagacatagctaaccagacaggcagatcaatcagaattcccccatcagaaagaaaagcccttatgttagctatgggatatcatgagaagggcagagctttcctgaaaagaaaagaatatggaatagccttgccatgtctgttggacgctgacaaatatttctgtgagtgttgcagagagctgctggacacagtggataactacgccgtcctccagctggatatagtgtggtgttacttccgcctggaacagctggaatgccttgatgatgcagaaaaaaaattaaacttggcccagaaatgctttaaaaattgttacggagaaaatcatcagagactggtccacataaaaggaaattgtgggaaagagaaggtactgtttctaagactctacttacttcaagggatccgaaactatcacagtggaaatgatgtagaggcttatgagtatcttaacaaggcacgtcagctctttaaagagctatatattgatccatcaaaagtggacaatttgttgcagttggggtttactgcccaggaagcccggcttggcctgagggcgtgtgatgggaacgtggatcatgcggccactcatattaccaaccgcagagaggaactggcccaaataaggaaggaggaaaaagagaagaaaagacgccgcctcgagaacatcaggtttctgaaagggatgggctactccacgcacgcggcccagcaggtactccacgcagccagcgggaacttggatgaggccctgaagattctgctcagcaatcctcagatgtggtggttaaatgattccaatcctgaaaccgacaaccgtcaagaaagtccttcccaggaaaacattgaccgattggtgtacatgggttttgatgcactcgtggccgaagctgcgctgagagtgttcagaggcaacgtccagctggccgcccagacccttgctcacaacggaggaagcctgcctcccgagctgccgctgtcgccagaagactctttgtccccgccagccacgtccccttctgactccgcaggaacctctagtgcctcaacagacgaagacatggagacagaggccgtcaatgagatactggaagacattccagagcatgaggaagactatcttgactcaactctggaagatgaagaaattattattgcagagtacctatcctatgtagaaaataggaagtcagcaacaaagaaaaactaaataatgaacagaaatagcgctaattttctgcttataaatgctatcattatgaaaaggctaatgcagctctttctgttcttactttttatctgaattacaagtcctctttgggtgtaggagggggtgggcaggggacaagtccaggaggggtcccagggccttcatgcgtggtctcggggaagaagcttcctctggcctggcgcaggccgttccatctgcctcccaggtctgcgtccctaaccccttccccagcttggtgttttaccccgaaacaggaaggaacaggggtcctgtagaacaggggtcctggggaaggtgtccagggcagggtcctgggaagggtgtcccgaccgcttcctctccagctgtggctccatctgcccagcttgcctgcctcctgcacccactgccctgaccttcctgcttcccacgctgccatctctgccagggtgccacatgggttcctgtgccaccctttccccgcccctcaaatcgtcctttaagtcttccttccaagtgctgtggggcataacgatgaggcgctggccttgggggccacaccaggtcgcagcaaatggcttcagcctgggacgccagtgttttatgctcttagttcagtaaaatacgcccccgaaattcaagattgagtgtcaggctttatatatattcagcattcctcattacagaaatcttctattgaatgggaaaggtttaaatgctaaccaaagcaatttatttttaattaatatttttagactctgtgctgtcatactgaactcactgctagctaagagacctatcagagatttagatatattttctccaggttttttgtgggttttctttgttgttgttgttgttctagccatgtgacagaggctctttctaaaagtatgtagttcgctgtgtgtcggctccagcagtaaccgtcctcactgcgccacgcactcctctgtagatgtgtgcccagtgggagttccttccagccccaggaccacagcagcagccaggtgccgagtggattgagtgccaggtgcatccaagactttccctcccttccagaaggcactgactgaagacaggatggatcatgcggagccggctgaaatgctccaactttttcaaagtgtgggtggtccagtttggactgatgggaatcttcttgtcattctttttaaacggatgataccgatggaaataaaaggtgggaaatatattcaaaaa

SEQ ID NO: 1382 - DNA, 708 bp, Homo sapiens
tgaaccgaaacgcgggagcaaccctgagcctttccggaacccagtgggggggggggggggggtggagccagacagtgacccggaagtagaagtggcccttgcaggcaagagtgctggagggcggcagcggcgaccggagcggtaggagcagcaatttatccgtgtgcagccccaaactggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagtggcaagcagatgaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtctactggtgggagactgtgaggatcccaggattcagtattcctggcccagagggcccttgctggctactgggtgttagtttgcagtcctgtgtgcttccctctcttatgactgtgtccctggttgtcaataaaatatttcctggcctcctggaatcttt

SEQ ID NO: 1383 - DNA, 2287 bp, Homo sapiens
cgcagccactgaaccacaagcagcttcgcgttaactggagtgcctgggagtcgcgtgccaggagccgcacggccagggactgactgacagacagacacgcaccaccaccacaacacacgagacccgggcgggccgccgccgccgccgccggggctcttggcaaactcgccggtcgcagaggtcccccgcggagctgcgccacagtagcgccgggcttgcagctttcacgccgggcgaaggacccggcgctgcgctcgcagctgcgcggagattcccggcacaggccaaagtcacagcaacgctgaggcacagttagagccaactaagatgttcgtcaaatccgagaccttggagttgaaggaggaagaggacgtgttagtgctgctcggatcggcctcccccgccttggcggccctgaccccgctgtcatccagcgccgacgaagaagaggaggaggagccgggcgcgtcaggcggggcgcgtcggcagcgcggggctgaggccgggcagggggcgcggggcggcgtggctgcgggtgcggagggctgccggcccgcacggctgctgggtctggtacacgattgcaaacggcgcccttcccgggcgcgggccgtctcccgaggcgccaagacggccgagacggtgcagcgcatcaagaagacccgtagactgaaggccaacaaccgcgagcgaaaccgcatgcacaacctcaacgcggcactggacgcgctgcgcgaggtgctccccacgttccccgaggacgccaagctcaccaagatcgagaccctgcgcttcgcccacaactacatctgggcactcaccgagaccctgcgcctggcggatcactgcgggggcggcggcgggggcctgccgggggcgctcttctccgaggcagtgttgctgagcccgggaggagccagcgccgccctgagcagcagcggagacagcccctcgcccgcctccacgtggagttgcaccaacagccccgcgccgtcctcctccgtgtcctccaattccacctccccctacagctgcactttatcgcccgccagcccggccgggtcagacatggactattggcagcccccacctcccgacaagcaccgctatgcacctcacctccccatagccagggattgtatctagagctgccatttctgctacccacgccaggccttagtgggttccctttcctgtccccagtcgagccctcctcccttcccctgcccctcctttccacgccctggaaaccatctcacttcacagggcaggtgtagcctttctgattcctcggttgtttcttgcatttcttggctttgggtatccttcattcagacgggctctgatttactgaaggtgtgatggagcttattgtcaaagccaagggtggcgttttgggggcgcttcttgagacgaaaaagaccctgggaagagatgatggtggcatatctaaagagtttgcagagcggactgacgctcctcccctttctctttaacgccgaaggacttggtgcagttcgtgtgaatctcacagggggaatgcaactggttcctgtgatctcttcacctttgcttctacatagagatgttaatgtcgagtagaaagaaatgtatcttagcatctgaatgattttgctggtaataatattatccacagatttgcaatggctggcatctgctttattcccattgctgtctgcaggctgtgggaatttcacctgtcaaaccaaacttccctctctgatgtgcactttgttctgtttcccagattcgtcacaatgcctattgtcctgtccttctctttcctttttcttccccattttgccatctgtctcttatgatttataaggggaaaaaaacttgttttgttagaggggcaggttagaagtcattgtataatttgtaggctttgtaatgattgaatgcaagcgtggaaatttaggctgaactctctatcaaaaggaaaaatgtggaggaaaagggaaaaatcaggagggaggattgcctcatgtattatttatttcgaccttttaggggagaaggaactcccccattctttcaagagattaaaaataaatcaacagtctgaaaacctaagcagacacggagcattatccggatcagccacacacgtgttcccttctatttattataaagaaatttttcatgggaaaatatgtattttttgtatattctacagagtttattctagtatgtatttacatcttgaagaacaagaaagttgttcttgtgattaaactataaataaactatctaattttcataa

SEQ ID NO: 1384 - DNA, 2021 bp, Homo sapiens
atgatggcggcagctcccatccagcagaacgggacccacactggggttcccatagacctggacccgccggactcgcggaaaaggccgctggaagccccccctgaagccggcagcaccaagaggaccaatacgggcgaagacggccagtattttctaaaggttctcatacctagttatgctgctggatctataattgggaagggaggacagacaattgttcagttgcaaaaagaaactggagccaccatcaagctgtctaagtccaaagatttttacccaggtgctgacagctgcagaagaaattgtacatggtgctgtacagaaggtatttctccactgtgccatctgcagagtgaaactgactaggagtactacatagactgtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcaggtaaagattatagttcccaacagcacagcaggtctgataatagggaagggaggtgctactgtgaaggctgtaatggagcagtcaggggcttgggtgcagctttcccagaaacctgatgggatcaacttgcaagagagggttgtcactgtgagtggagaacctgaacaaaaccgaaaagctgttgaacttatcatccagaagatacaagaggatccacaaagtggcagctgtctcaatatcagttatgccaatgtgacaggtccagtggcaaattccaatccaaccggatctccttatgcaaacactgctgaagtgttaccaactgctgcagcagctgcagggctattaggacatgctaaccttgctggcgttgcagcctttccagcagttttatctggcttcacaggcaatgacctggtggccatcacctctgcacttaatacattagccagctatggatataatctcaacactttaggtttaggtctcagtcaagcagcagcaacaggggctttggctgcagcagctgccagtgccaacccagcagcagcagcagccaatttattggccacctatgccagtgaagcctcagccagtggcagcacagctggtggtacggcggggacatttgcattaggtagcctggctgctgctactgctgcaaccaatggatattttggagctgcttctcccctagctgccagtgccattctaggaacagaaaagtccacagatggatccaaggatgtagttgaaatagcagtgccagaaaacttagttggtgcaatacttggcaaaggagggaaaacattagtggaataccaggagttgactggtgcaaggatacagatctccaaaaaaggagaattcgtacctggcacaaggaatcggaaggtaaccattactggaacaccagctgcaacacaggctgctcaatatttaattacacaaaggatcacatatgagcaaggagttcgggctgccaatcctcagaaagtgggttgagtgccccagttacacatcagattgttttaacccctcctttaccccattttcaagaaggatgtactgtactttgcagaagtgaagtttttctgttattaatatataattatgcaaatgaatgcgactatgttgacaatgtgtatatgtaaataatatgtgttttaccagatgtttcatagaaagaattttttcttgatctgttttgttctctatactttgcttgtgtatatttgtcagaggtgtttctagtgtaagatttaagcctgccattttaccagcattattgtagtttaatgattgaatgtagacagggatatgcgtatagttttcagtattagttctagataacactaaattaactactgttaggttgagtatggtggggtcagtgacct

SEQ ID NO: 1385 - DNA, 896 bp, Homo sapiens
aaacatgatggcggcagctcccatccagcagaacgggacccacactggggttcccatagacctggacccgccggactcgcggaaaaggccgctggaagccccccctgaagccggcagcaccaagaggaccaatacgggcgaagacggccagtattttctaaaggttctcatacctagttatgctgctggatctataattgggaagggaggacagacaattgttcagttgcaaaaagaaactggagccaccatcaagctgtctaagtccaaagatttttacccaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcagaagcataatatctcctggatatcatgaagcaagatataagagaagaacaaaacaaaatccgtaattcattgaaagaattgtaatcatcaatctttcatattattaatactttgtaattattttctccccaacagtattttccagtagattctaatcatgtggtagggcagaaggaaatgtgttttttgttgttcatttgtttcttgtcaatagtcctgattaatttagctttgctatactgacttatatctggaagtatataaccaagataagaaaataggttttaatatgatcatcttaagctaattgtaatgaaaagaactaatggactgtcaatattcagaaaaccaaaaataaaaaatacagaaaacta

SEQ ID NO: 1386 - DNA, 3573 bp, Homo sapiens
aaaacaaaagggagaaccttctcccggtagcagcggcaggaactgcaaacatgatggcggcagctcccatccagcagaacgggacccacactggggttcccatagacctggacccgccggactcgcggaaaaggccgctggaagccccccctgaagccggcagcaccaagaggaccaatacgggcgaagacggccagtattttctaaaggttctcatacctagttatgctgctggatctataattgggaagggaggacagacaattgttcagttgcaaaaagaaactggagccaccatcaagctgtctaagtccaaagatttttacccaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaagtaaagattatagttcccaacagcacagcaggtctgataatagggaagggaggtgctactgtgaaggctgtaatggagcagtcaggggcttgggtgcagctttcccagaaacctgatgggatcaacttgcaagagagggttgtcactgtgagtggagaacctgaacaaaaccgaaaagctgttgaacttatcatccagaagatacaagaggatccacaaagtggcagctgtctcaatatcagttatgccaatgtgacaggtccagtggcaaattccaatccaaccggatctccttatgcaaacactgctgaagtgttaccaactgctgcagcagctgcagggctattaggacatgctaaccttgctggcgttgcagcctttccagcagttttatctggcttcacaggcaatgacctggtggccatcacctctgcacttaatacattagccagctatggatataatctcaacactttaggtttaggtctcagtcaagcagcagcaacaggggctttggctgcagcagctgccagtgccaacccagcagcagcagcagccaatttattggccacctatgccagtgaagcctcagccagtggcagcacagctggtggtacggcggggacatttgcattaggtagcctggctgctgctactgctgcaaccaatggatattttggagctgcttctcccctagctgccagtgccattctaggaacagaaaagtccacagatggatccaaggatgtagttgaaatagcagtgccagaaaacttagttggtgcaatacttggcaaaggagggaaaacattagtggaataccaggagttgactggtgcaaggatacagatctccaaaaaaggagaattcgtacctggcacaaggaatcggaaggtaaccattactggaacaccagctgcaacacaggctgctcaatatttaattacacaaaggatcacatatgagcaaggagttcgggctgccaatcctcagaaagtgggttgagtgccccagttacacatcagattgttttaacccctcctttaccccattttcaagaaggatgtactgtactttgcagaagtgaagtttttctgttattaatatataattatgcaaatgaatgcgactatgttgacaatgtgtatatgtaaataatatgtgttttaccagatgtttcatagaaagaattttttcttgatctgttttgttctctatactttgcttgtgtatatttgtcagaggtgtttctagtgtaagatttaagcctgccattttaccagcattattgtagtttaatgattgaatgtagacagggatatgcgtatagttttcagtattagttctagataacactaaattaactactgttaggttgagtatggtggggtcagtgacctaaaatggagtgaggccaaagcactgtcctgtaagtcttacttcctgcttagggcacagtgaagtaggaaacaatattttgaaaataagttttaaatttaaaatgatcaaaaagcaatatagttgcataaaagcactgtaaaatatttaaaaggttaaaactgtggaaaattatattggtaagtttacagatcaataaaagcacctgttctccatctgaactagacaatggaaataatgctgcatgctggccatggcccattcttcatcatttgtaagttcaacaaaagttctcacatggagtcccacctcttcagaggtttgtacatttgtttttaagcactgaattcactactgatcccatcgcctggccagtagaacagtcattactccattaacatcctcactgtttagacacataactgtggtacagtgtattggaaattttataaacaaaagtgaaagtgccaacaaattattgatagctgataatgtttcattatctgcaactgcttgataagtatgttgcattttaagagcttataattgtgtataatttgttaacactagaaacctattagtattgtgaatgtagattttactgtgaagctatctgtgatttagctgtttgctcccatgatggagtctttgcagcatggcgctagcagccaatgcagtttctaatactcggtaatttgcatgttttgtggagcatttttatgtcaccaaccagacagtatttcctgcatgcttatttagaagaggcagcttatcttgagaggtagtgttatctacctttgtcaggctttttgacaggtcatttcagagtaagcctttgttcccaagacccaacaactgtcaccctcttctgtacctctcctgagtgccaactgtccaggccatttgacacaccatctgttaacctctgagtttgcccactcaaggccactcataggggcatccatccccaagcacctcctcatgctgtgcatgcagtcttaaattcaatggacaaaaataaaatgctggctacctctggatcatctggctgagcaactgaattacaaaagagaattacttccatctcaacttcaacccattgattacgtccatcctagcaagctaaatggcatcccagctgctcctttctgtgcaaccaattaaagaacaatgagtgtgatgctccatgtctgaatttcgtccagcctctctctgaactgtgatctttgtcctcatgaactttcccttttgttcattgaactatatggactcttcatttcatattgatttactgtgcaatttacttttggacattgagaacttgaaattatttcctgatcccttccccttccactattaataattcatttctgtcaaactgtaagagtagactcatttttttttttttagtttttaacattggactgttatttcatttagagttctctatctctaaatatttatttagagaatgattttaaaagggaatgatatgcttgtttaaatgaaagagaaaagctgtagtaaactgtgttaattggtaatgactatttatcgtcgatactctgtagctgtgtaagttttgacaaatagtgtatctcgtggaatcagtggttagcattgccgctattatatttactcattttatcattataaatgtgcttagttcatcatgtag

SEQ ID NO: 1387 - DNA, 3912 bp, Homo sapiens
ctctcccttctccactctctccccctgtctcctttcttcttcttctttcaccctccgtctctcacaccccctccattcccctgtctcctttctgacactgcactgcagctgctcctcagccctgccccctccccagtgagaacaaaccagcaacattgctttttttcctaaagagatttatattgatccgattaaaaaaaaaaaaccttaagaaaccccaaacgcaaaaaaaaaaaaaaaaaaaaaagaaaaaagaaaagaaaaagccaaaacaaaagggagaaccttctcccggtagcagcggcaggaactgcaaacatgatggcggcagctcccatccagcagaacgggacccacactggggttcccatagacctggacccgccggactcgcggaaaaggccgctggaagccccccctgaagccggcagcaccaagaggaccaatacgggcgaagacggccagtattttctaaaggttctcatacctagttatgctgctggatctataattgggaagggaggacagacaattgttcagttgcaaaaagaaactggagccaccatcaagctgtctaagtccaaagatttttacccaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcaggtaaagattatagttcccaacagcacagcaggtctgataatagggaagggaggtgctactgtgaaggctgtaatggagcagtcaggggcttgggtgcagctttcccagaaacctgatgggatcaacttgcaagagagggttgtcactgtgagtggagaacctgaacaaaaccgaaaagctgttgaacttatcatccagaagatacaagaggatccacaaagtggcagctgtctcaatatcagttatgccaatgtgacaggtccagtggcaaattccaatccaaccggatctccttatgcaaacactgctgaagtgttaccaactgctgcagcagctgcagggctattaggacatgctaaccttgctggcgttgcagcctttccagcagttttatctggcttcacaggcaatgacctggtggccatcacctctgcacttaatacattagccagctatggatataatctcaacactttaggtttaggtctcagtcaagcagcagcaacaggggctttggctgcagcagctgccagtgccaacccagcagcagcagcagccaatttattggccacctatgccagtgaagcctcagccagtggcagcacagctggtggtacggcggggacatttgcattaggtagcctggctgctgctactgctgcaaccaatggatattttggagctgcttctcccctagctgccagtgccattctaggaacagaaaagtccacagatggatccaaggatgtagttgaaatagcagtgccagaaaacttagttggtgcaatacttggcaaaggagggaaaacattagtggaataccaggagttgactggtgcaaggatacagatctccaaaaaaggagaattcgtacctggcacaaggaatcggaaggtaaccattactggaacaccagctgcaacacaggctgctcaatatttaattacacaaaggatcacatatgagcaaggagttcgggctgccaatcctcagaaagtgggttgagtgccccagttacacatcagattgttttaacccctcctttaccccattttcaagaaggatgtactgtactttgcagaagtgaagtttttctgttattaatatataattatgcaaatgaatgcgactatgttgacaatgtgtatatgtaaataatatgtgttttaccagatgtttcatagaaagaattttttcttgatctgttttgttctctatactttgcttgtgtatatttgtcagaggtgtttctagtgtaagatttaagcctgccattttaccagcattattgtagtttaatgattgaatgtagacagggatatgcgtatagttttcagtattagttctagataacactaaattaactactgttaggttgagtatggtggggtcagtgacctaaaatggagtgaggccaaagcactgtcctgtaagtcttacttcctgcttagggcacagtgaagtaggaaacaatattttgaaaataagttttaaatttaaaatgatcaaaaagcaatatagttgcataaaagcactgtaaaatatttaaaaggttaaaactgtggaaaattatattggtaagtttacagatcaataaaagcacctgttctccatctgaactagacaatggaaataatgctgcatgctggccatggcccattcttcatcatttgtaagttcaacaaaagttctcacatggagtcccacctcttcagaggtttgtacatttgtttttaagcactgaattcactactgatcccatcgcctggccagtagaacagtcattactccattaacatcctcactgtttagacacataactgtggtacagtgtattggaaattttataaacaaaagtgaaagtgccaacaaattattgatagctgataatgtttcattatctgcaactgcttgataagtatgttgcattttaagagcttataattgtgtataatttgttaacactagaaacctattagtattgtgaatgtagattttactgtgaagctatctgtgatttagctgtttgctcccatgatggagtctttgcagcatggcgctagcagccaatgcagtttctaatactcggtaatttgcatgttttgtggagcatttttatgtcaccaaccagacagtatttcctgcatgcttatttagaagaggcagcttatcttgagaggtagtgttatctacctttgtcaggctttttgacaggtcatttcagagtaagcctttgttcccaagacccaacaactgtcaccctcttctgtacctctcctgagtgccaactgtccaggccatttgacacaccatctgttaacctctgagtttgcccactcaaggccactcataggggcatccatccccaagcacctcctcatgctgtgcatgcagtcttaaattcaatggacaaaaataaaatgctggctacctctggatcatctggctgagcaactgaattacaaaagagaattacttccatctcaacttcaacccattgattacgtccatcctagcaagctaaatggcatcccagctgctcctttctgtgcaaccaattaaagaacaatgagtgtgatgctccatgtctgaatttcgtccagcctctctctgaactgtgatctttgtcctcatgaactttcccttttgttcattgaactatatggactcttcatttcatattgatttactgtgcaatttacttttggacattgagaacttgaaattatttcctgatcccttccccttccactattaataattcatttctgtcaaactgtaagagtagactcatttttttttttttagtttttaacattggactgttatttcatttagagttctctatctctaaatatttatttagagaatgattttaaaagggaatgatatgcttgtttaaatgaaagagaaaagctgtagtaaactgtgttaattggtaatgactatttatcgtcgatactctgtagctgtgtaagttttgacaaatagtgtatctcgtggaatcagtggttagcattgccgctattatatttactcattttatcattataaatgtgcttagttcatcatgta

SEQ ID NO: 1388 - DNA, 1877 bp, Homo sapiens
ccgccgcagccgccgcagcagcagcagccgccgccccaggccccccccatggagcccgaggccccggattcccgcaagaggcccctcgaaacgccccccgaggtggtctgcaccaagcgcagcaacacgggagaggaaggcgaatacttcctgaaggtgctgatccccagctacgcggcgggctccatcattggcaagggcgggcagaccatcgtgcagctgcagaaggagaccggagccaccatcaagctctccaagtccaaagacttctaccccggaaccacagagcgggtatgcctagtacagggcacggcagaggccttgaatgctgtgcacagctttattgccgagaaggtccgagaaatcccacaagcgatgaccaagcctgaggtggtcaacatccttcaaccccaaaccacgatgaaccccgacagagccaagcaggccaagctgatcgtccccaacagcacggcgggcctgatcatcggcaagggaggcgccacggtgaaagccgtgatggaacagtcaggagcatgggtgcagctgtcccagaagccggagggcatcaacctgcaggagcgcgtggtgacggtcagcggcgagcccgagcaggtgcacaaggccgtgagcgccatcgtgcagaaggtacaagaagacccccagagcagcagctgcctcaacatcagctacgccaacgtggcaggccccgtggccaactccaaccccaccggctctccgtacgccagccccgcggatgtgctgccagccgcggccgcagcgtcggccgccgccgcctccggcctgctgggccccgccgggctggctggcgtgggggcctttcccgccgcgctgcccgccttctcaggcaccgacctgctggccatcagcacggcgcttaacacgctggcaagttacggctacaacaccaactccctgggcctgggcctcaactcggccgcagcttccggcgtcctggccgccgtggccgccggggccaacccagcagccgccgccgccgccaacctcctggcatcctacgcgggcgaggccggggccgggccagccggaggggccgccccgccgccgcccccgcctcccggagccctggggtcctttgcgttggccgcagccgccaacggctacctcggggccggggcgggcggcggggcgggcggagggggcggcccgctggtggccgctgcagccgcggccggggcggccgggggcttcctgacggcggagaagctggcggctgagagtgccaaggagctggtggagattgcggtgcctgagaacctggtgggagccatcctggggaaggggggcaagacgttggtggagtaccaggagctgacgggcgctcgcatccagatctccaagaagggcgagttcctgccaggcacgcggaaccggcgggtcaccatcacgggcagccccgcggccacgcaagccgctcaatacctcatcagtcagcgggtcacctacgagcagggagtgagggcctcaaacccccagaaagtgggatgaggcctgtggtgtgtgctcccacccttttctctcctcccatctcctcctcttccctctcctcctcccccccaactcctgacctcagcttggtgtagtcctgctcctcttgggatggggctggggtaggcccgactgcaccctccccttctggtagtcataggcaggattgagtgacggttgggaagggggctcagaagccccctccccagcccggaactgacccctccttcctccctccctgtgcttggctgggcctgacccttcctgtcccagggcccaggtctgtgtgatatctgtatatattgcattttgttgattttaatagaaaacaaagcgttattttctctttc

SEQ ID NO: 1389 - DNA, 3781 bp, Homo sapiens
gagagtgcgaccgagatgttccactcgctggcgtccgggccgctggtgatctccggtagcactcgggccggcggacagtgagggcgcgacaacaagggaggtgtcacagttttccatttagatcaacaacttcaagttcttaccatggaaaattccgagaagactgaagtggttctccttgcttgtggttcattcaatcccatcaccaacatgcacctcaggttgtttgagctggccaaggactacatgaatggaacaggaaggtacacagttgtcaaaggcatcatctctcctgttggtgatgcctacaagaagaaaggactcattcctgcctatcaccgggtcatcatggcagaacttgctaccaagaattctaaatgggtggaagttgatacatgggaaagtcttcagaaggagtggaaagagactctgaaggtgctaagacaccatcaagagaaattggaggctagtgactgtgatcaccagcagaactcacctactctagaaaggcctggaaggaagaggaagtggactgaaacacaagattctagtcaaaagaaatccctagagccaaaaacaaaagctgtgccaaaggtcaagctgctgtgtggggcagatttattggagtcctttgctgttcccaatttgtggaagagtgaagacatcacccaaatcgtggccaactatgggctcatatgtgttactcgggctggaaatgatgctcagaagtttatctatgaatcggatgtgctgtggaaacaccggagcaacattcacgtggtgaatgaatggatcgctaatgacatctcatccacaaaaatccggagagccctcagaaggggccagagcattcgctacttggtaccagatcttgtccaagaatacattgaaaagcataatttgtacagctctgagagtgaagacaggaatgctggggtcatcctggcccctttgcagagaaacactgcagaagctaagacataggaattctacagcatgatatttcagacttcccatttggggatctgaaacaatctgggagttaataactggggaaagaagttgtgatctgttgcctaaactaaagcttaaaagtttagtaaaaatcgtctgggcacagtggctcacgcctgtaatcccagcactttgggaggctgaggcaggtggatcacggggtcaagagatcgagaccatcctggccaatatggtgaaaccccatctctactaaaaatacaaaaattagctgtgtgtggtggcacgtgcctgtagtcccagctacttgggaggctgaggcaggagaatcacttgaccccaggtggtggaggttgcagtgagccaagattgcaccattgcactccagcctggcgacagagcaagactctgtctcaaaaaaaaaaaaaaatttagtaaaaatcaatggtaagctaaaataagtttttgtttgtttatttgtttttgagatggagtctctactaaaaatacaaaaaattagccaggcatggtgccgcataactataatcccagctacttgggaggctgaggcaggagaatcgcttgaacccgggaggcacaggttccagtgagccaaggttgtgccactgcactccagcctgggcaaaaaagcaaaactccatctcaaagagaaaaaaaaaaaagaccgggtgtggtggctcacacctgtaatcccagcactttgggaggcctaagtgggtggatcacgtgaggtcaagagttcaagaccagcctggccaatatggtgaaaccccatctctactaagaatacaaaaaattagctgagcatggtggtgggctcctgtagtcccagctacttgggaggctgaggcaggagaatcgcttgaacctgggaggcagaggttgcagtaagccaagatcgtgccattgcactccagcctgggtgacagagcgagactccatctcaaaaaaaaaaaaaagcctgacagctagcaggtttcaggatccatctgccaagttagtgaaaggctggagcctcaaatcatacagatgagggtcattttctcctccttagcttcttggagtttaagagttgaaggagtcctgaaaagtaatgatagagcaagatgaagctatcagaactgaatttggacttcctctgggaaactacacctagttcatctgaagtgtcacgtaaactgcagaaagtttccaatgctggaaacttctctcatactatcgtgccttcctactcagaagtgcctgtgccctgctcagctgtgactactgacctcaggacctcactggacaaggcatgtggggacccttgcaggagccctggtaagggtacaatgatcctattgttttttgtttttgagatggagtctcactctgtctcccaggctggagtgcagtggtgcgatctccgctcactgcaacctccgcctcccgggttcaagcaattctcctgcctcagcctgctgagtagctgggattacaggcacccactaccatgtccggctaattttgtatttttagtagagatggggtttcgccatgttagacaggctggtcttgaactcctgacctcaggtgatctgcccacctcggccttccaaagtgctgggattacaggcatgagccactgcacccagcctgatcctattgttgcactatttatggagcaacaactttgtacaaagaacaagctttgtacagagaacaagcttggctttttctcccaacgccgaggatgctgttgatgctgccacgtaatagcataattttgggtgtcctcaaggacagaacttccactttgaataatggaagttagaacaatgaatttcacaggggaataaatattaatgactgacgtgaagaaaatatgccattgtttattccctcctgcatcatttccataatttgcttttgtactgtcaatttagaggaaatgtgtgatgctggtgttttgtttggcctgtttgtttgatgctgggggttttatgtgttgtaccctttaccccttacattgtgtaatttgaaagtggcaaacaaacctgcagtaaaagtccttgattggcatcttcattcggatgatggagagcctttgtggtagtgtttgcttatgtgaacagcaggcctttcagataagagaagtggcttttccttggtgatgaaggggtagagattgagccatggggatggtttaggttaaagaatgcttttttttggccatcatgaggatctaacaacagagtagaaggaaggatgccctaggtcagcatgcagggtggtgggagggctttcatcttccttacccaagcctctcttttcacttttctagaagtccagaagttgttatatgatgaaatagcctcctttaacgtttatttctgggtgccaacggaggcccattcctctaacattctcataatttttctcaaaggcctatgatctaaacatttcaccacggcatccactcagctgtgaggctgcgtacacagtctccacctctgaaatctgaacttcgtttaccagtggtgctgtttgaacttcataatgtcagcacttcctgaacacttactgtgtgcttggcttgtgctcctgagtgccttatatcataaggaaacggcaaaatcaggggactggtataaatggtgagctgagcttgaatctaagctttgtcttcagagccagtacccctaatctctctttctgtaaaatattacttttcaaagaatgaagttgtagccaaatcttgaaatttttcatttaccctaagtgaggacaaataaagctttcaacaaca

SEQ ID NO: 1390 - DNA, 1094 bp, Homo sapiens
gagagtgcgaccgagatgttccactcgctggcgtccgggccgctggtgatctccggtagcactcgggccggcggacagtgagggcgcgacaacaagggaggtgtcacagttttccatttagatcaacaacttcaagttcttaccatggaaaattccgagaagactgaagtggttctccttgcttgtggttcattcaatcccatcaccaacatgcacctcaggttgtttgagctggccaaggactacatgaatggaacaggaaggtacacagttgtcaaaggcatcatctctcctgttggtgatgcctacaagaagaaaggactcattcctgcctatcaccgggtcatcatggcagaacttgctaccaagaattctaaatgggtggaagttgatacatgggaaagtcttcagaaggagtggaaagagactctgaaggtgctaagacaccatcaagagaaattggaggctagtgactgtgatcaccagcagaactcacctactctagaaaggcctggaaggaagaggaagtggactgaaacacaagattctagtcaaaagaaatccctagagccaaaaacaaaagatggagtctcgctctatcacccaggctggagtgcagtggcatgatctcagctcactgcaagctctgcctcctgggttcatgccattctcctgcctcagcctcctgagcagctgggactacaggtgcctgccaccacgcctgtctaatttgtttgtatttttagtagagacggggttgcaccatgttagccaggatggtcttgatctcctgacctcatgatccgcccacctcggcctcccaaagtgctgggattacaggcgtgagccacagcgcctgggccttattttttttgttttatagagatggggtctcactattttggccaggttggtcttgaactcctggccccaagcagtcctcctgccttggcctcccaaagtgttaggattacaggtgtcagccactatgcctggcctttattttcattttatattgcatacttgtgggtgtctggaaaatgccccttgttagttgcatgaagtgaaggagaataaaaggcacttggagctta

SEQ ID NO: 1391 - DNA, 1818 bp, Homo sapiens
agagtgcgaccgagatgttccactcgctggcgtccgggccgctggtgatctccggtagcactcgggccggcggacagtgagggcgcgacaacaagggaggtgtcacagttttccatttagatcaacaacttcaagttcttaccatggaaaattccgagaagactgaagtggttctccttgcttgtggttcattcaatcccatcaccaacatgcacctcaggttgtttgagctggccaaggactacatgaatggaacaggaaggtacacagttgtcaaaggcatcatctctcctgttggtgatgcctacaagaagaaaggactcattcctgcctatcaccgggtcatcatggcagaacttgctaccaagaattctaaatgggtggaagttgatacatgggaaagtcttcagaaggagtggaaagagactctgaaggtgctaagacaccatcaagagaaattggaggctagtgactgtgatcaccagcagaactcacctactctagaaaggcctggaaggaagaggaagtggactgaaacacaagattctagtcaaaagaaatccctagagccaaaaacaaaagctgtgccaaaggtcaagctgctgtgtggggcagatttattggagtcctttgctgttcccaatttgtggaagagtgaagacatcacccaaatcgtggccaactatgggctcatatgtgttactcgggctggaaatgatgctcagaagtttatctatgaatcggatgtgctgtggaaacaccggagcaacattcacgtggtgaatgaatggatcgctaatgacatctcatccacaaaaatccggagagccctcagaaggggccagagcattcgctacttggtaccagatcttgtccaagaatacattgaaaagcataatttgtacagctctgagagtgaagacaggaatgctggggtcatcctggcccctttgcagagaaacactgcagaagctaagacataggaattctacagcatgatatttcagacttcccatttggggatctgaaacaatctgggagttaataactggggaaagaagttgtgatctgttgcctaaactaaagcttaaaagtttagtaaaaatcgtctgggcacagtggctcacgcctgtaatcccagcactttgggaggctgaggcaggagaatcacttgaccccaggtggtggaggttgcagtgagccaagattgcaccattgcactccagcctggcgacagagcaagactctgtctcaaaaaaaaaaaaaaatttagtaaaaatcaatggtaagctaaaataagtttttgtttgtttatttgtttttgagatggagtctctactaaaaatacaaaaaattagccaggcatggtgccgcataactataatcccagctacttgggaggctgaggcaggagaatcgcttgaacccgggaggcacaggttccagtgagccaaggttgtgccactgcactccagcctgggcaaaaaagcaaaactccatctcaaagagaaaaaaaaaaaagaccgggtgtggtggctcacacctgtaatcccagcactttgggaggcctaagtgggtggatcacgtgaggtcaagagttcaagaccagcctggccaatatggtgaaaccccatctctactaagaatacaaaaaattagctgagcatggtggtgggctcctgtagtcccagctacttgggaggctgaggcaggagaatcgcttgaacctgggaggcagaggttgcagtaagccaagatcgtgccattgcactccagcctgggtgacagagcgagactccatctcaaaaaaaaaaaaaa

SEQ ID NO: 1392 - DNA, 1720 bp, Homo sapiens
ctctcacgcagccaacatggctccagtggagcacgttgtggcggatgctggggctttcctgcggcatgcggctctgcaggacatcgggaagaacatttacaccatccgggaggtggtcactgagattcgggacaaggccacacgcaggcggctcgctgtcctgccctacgagctgcggttcaaggagcccttaccggaatacgtgcggctggtgactgagttttcaaagaaaacaggagactaccccagcctctctgccacggacatccaagtgcttgcactcacataccagttggaagcagagtttgttggggtgtctcacctaaaacaagaaccacagaaggttaaggtgagctcatcgattcagcacccagaaacacctctgcacatttctggtttccatctgccctacaagcctaaacccccacaagaaacagaaaaaggacactcagcttgtgagcctgagaacctggaatttagttccttcatgttctggagaaaccctttgcccaacatcgatcatgaactgcaggagctgctgattgacagaggtgaggacgttccaagtgaggaggaggaggaggaagaaaacgggtttgaagacagaaaagatgacagcgatgacgacgggggtggctggataacccccagtaacatcaagcagatccagcaggagctggagcagtgtgacgtccccgaggacgtgcgggttggctgcctgaccacagacttcgccatgcagaatgttctgctgcagatggggctgcacgtgctggcggtgaacggcatgctgattcgtgaggcccggagctacatcttgcgctgccatggctgtttcaagacaacgtctgacatgagccgagtgttctgctcacactgtgggaacaagaccctgaagaaagtgtccgtgaccgtcagcgacgacggcaccctgcacatgcacttctcccgcaaccccaaggtgctgaacccccgcggcctccggtactcgcttcccactcccaaagggggcaaatacgccatcaacccccatctcaccgaggatcagcgcttccctcagctgcgactctcccaaaaggccaggcagaaaaccaacgtgttcgcccctgactacatcgccggggtgtcaccctttgtcgagaatgacatctccagccgctcagctaccctgcaggtccgggacagcaccttgggagctgggcggagacgcttaaatcccaacgcttccagaaagaagtttgtgaagaaaaggtgaagagcgagttcccgcaggcaaattggatgggcgtctggccgccgtggagttccggtgacccatttccccagccgtgtcgtctccaggaccacccgatggaaataacaggcgggcttcacggtgcggctctgtccgcccatgccccgctgggtctgcagggaactggactgtcccatggcctgtgagcaccggagcgcctggctgcctgccaaggaagtgcaattgcataaaaacagaaagaacaacgccctggagccaatcttcaagaaaggaatttccaaaggataatatttttctaataaatgcggctgcaacctcctgtgcatttaattaaataggccaaatttttgctgcttaggtcatctcaaggctgatacttgagctgtgtgcccagagatcatgcatttagatttatatttttgccagaaaatacaaggttataataaaactaagaactaccatttc

SEQ ID NO: 1393 - DNA, 1236 bp, Homo sapiens
atggacgggcgcgccgagctgccggcctttccccgcgctggagccccgccgctcgcggccagcgacactgtgcctgcggcgcccgagggggctggagcggcccggcccgcagcgcccctgcgccccacctccttctcggtactggacatcctggaccccaacaagttcaacagcaggaggcgtcgttgcgtgctgctgggcccagtggctcccgctgcgtgcgccccttgcgcttcggccccatgcgcccctgcacccgccgcctcgggacgcccgccacgcgcggaggagctggagcgccgcgccctcgccggcgccgggggagtcggagccgccggagctgagccgccgaacgccggcgaccccttcaaggcaggggaggccgagaccaacgacaccaacggctacagcagcggcggcggcggccacagcccgagcgcggacagcggggacgaggttcccgacgacgaggacgacgacgaggacgaagcgcccgagacggaggcggcgcgaggcgcggaggaggcgcggggaggcggcggcggcctcggggcccgcgggtcgggttgccagggcgcggctgagaccgacgcgtcccccggagccaccgtcgacgaggcagcggcccccggaccccgcgagaactcgcccgttgcccagggcccaccgggaggtgcagcggcgccggggggcgcggggaccaccccgcagggcacggcgacggcggcgaagcccaagcggaagcgcacggggtccgactccaagtccgggaagccgcggcgagcgcgcaccgccttcacctacgagcagctcgtggcgctggagaacaagttcaaggccacgcgctacctgtcggtgtgcgagcgcctcaacctggcgctgtcgctcagcctcaccgagacgcaggtgaagatctggttccagaaccgccgaaccaagtggaagaagcagaacccgggcgccgacaccagcgctccgaccggcggcgggggcggaccgggaccgggggccgggcctggcacggggctgcccggcggcctcagcccgctcagcccctcgccgcccatgggcgccccgctcggcatgcacggcccggccgggtacccggcgcacggccccggaggcctggtgtgcgccgcgcagctgccgttcctgtcgagcccggcggtgctctcgcccttcgtgctgggctcgcagacctacggggcgcccgccttctacgcgccgcacctctga

SEQ ID NO: 1394 - DNA, 2094 bp, Homo sapiens
agtccctgcagtggctgtaacaaaacccagacccccaggtcccggccaatggaggcgatttagactggagtgggaccgcgtctgtcaaaagcccgactcggcagcagcggcggagtccaggaggagagctggagccgccgcgctgcctccccgcccccgccgggatttattatttggactggacaattaagtggccctgatgatgttaccaagcccggtcacctccacccctttctcagtcaaagacattttgaatctggagcagcagcaccagcacttccatggtgcgcacttgcaggcggacttggagcaccacttccactctgcgccctgcatgctggccgccgctgaggggacgcaattttctgacggaggggaggaggacgaggaagacgagggcgagaaattgtcctatttgaactcactagccgcagcagacggccacggggattcagggctgtgtccccagggctatgtccacacggtcctgcgagactcgtgcagcgagcccaaggaacatgaagaggagcccgaggtcgtgagggaccggagccaaaaaagctgccagctgaagaagtctctagagacggccggagactgcaaggcggcggaggagagcgagaggccgaagccacgcagccgccggaagccccgggtcctcttctcgcaagcccaggtcttcgagctggaacgcaggttcaagcagcagcggtacctgtcggcacccgagcgcgagcacctcgccagcagcctgaagctcacatccactcaggtgaaaatctggttccagaatcgcaggtacaagtgcaagagacagcggcaggacaagtctctggagcttggcgcacacgcgcccccgccgccgccgcgccgcgtggctgtcccggtgctggtgcgggacggcaagccgtgcgtcacgcccagcgcgcaggcctacggcgcgccctacagcgtgggcgccagcgcctactcctacaacagcttccccgcctacggctatgggaactcggccgcggccgccgccgccgccgccgccgccgccgcagcagcggcggcctacagcagcagctatggctgtgcgtacccggcgggcggcggcggcggcggcggcgggacctccgcggcgaccactgccatgcagcccgcctgcagcgcggccggaggcggcccctttgtgaacgtgagcaacctaggaggcttcggcagcggcggcagcgcacagccgttgcaccagggtactgcagccggggccgcgtgcgctcagggcaccttgcagggcatccgggcctggtagggacggggcgggtcacgcggcgggcaccccagcgcagcctggcgccgcgggactgaagctcgagaagggcctgacctaaaggtcaggtcccctcgttaaaaaaatatgtacgtctagctcctcagggcttcggatcgcagctcactcgaggcctggggaaggggactcaggggcgaggaggatgactgggtccggtcgccaggactgtctctgaggcagaaacgccggctgggcgccggggaggacgatggccccgaccctggcagcgagaggagaccaggaggctaggaccctggccgcgcttggttcttccaaagcgagaagggcttctctccctctgcctttccgcggcctccgcgaagcgttggcggggagcccaaggacataacaaattaaaagcatgaaggagagaaaaatgggggtcgtggcttgagaaattccaggccctaccgatcctctgccccctttgcgggcctggagcgccatagcacagtcgatttcgtttcgcagctgtctcccctccgcagcagatacctcggtccagatctccggattgtcgggggacgcaggactcttcgaggaaaaccagccgaatgagatcaaaagttgggggtggggggaggctgaacaaactcaggacctggtggcccaccggaggtgttaccgggtttcctttctgtttcgtattctgtattcagcacatgttatctatctatctatctatataactataaccacacgccgtgtagacacccgctgccacacactacaggagtcaataaacaaggtgcaatattttc

SEQ ID NO: 1395 - DNA, 2707 bp, Homo sapiens
ggcgagctgccgcctcccgcgtggagggtttggacatctctgctgcgcagctaggcgagcaactcccggcagcggcatttttggttcagttggcagctcgcctccgggcgcgccgagtgcctctccgctcgcgccctcggcgcttccggctcctctgagccccgcggggggcaccagccagcgccctcgctgcaaggctacggtctccggcgtggccgtgggatgttagcggtgggggcaatggagggcacccggcagagcgcattcctgctcagcagccctcccctggccgccctgcacagcatggccgagatgaagaccccgctgtaccctgccgcgtatcccccgctgcctgccggccccccctcctcctcgtcctcgtcgtcgtcctcctcgtcgccctccccgcctctgggcacccacaacccaggcggcctgaagcccccggccacgggggggctctcatccctcggcagccccccgcagcagctctcggccgccaccccacacggcatcaacgatatcctgagccggccctccatgcccgtggcctcgggggccgccctgccctccgcctcgccctccggttcctcctcctcctcttcctcgtccgcctctgcctcctccgcctctgccgccgccgcggctgctgccgcggccgcagccgccgcctcatccccggcggggctgctggccggactgccacgctttagcagcctgagcccgccgccgccgccgcccgggctctacttcagccccagcgccgcggccgtggccgccgtgggccggtaccccaagccgctggctgagctgcctggccggacgcccatcttctggcccggagtgatgcagagcccgccctggagggacgcacgcctggcctgtacccctcatcaaggatccattttgttggacaaagacgggaagagaaaacacacgagacccactttttccggacagcagatcttcgccctggagaagactttcgaacaaacaaaatacttggcggggcccgagagggctcgtttggcctattcgttggggatgacagagagtcaggtcaaggtctggttccagaaccgccggaccaagtggaggaagaagcacgctgccgagatggccacggccaagaagaagcaggactcggagacagagcgcctcaagggggcctcggagaacgaggaagaggacgacgactacaataagcctctggatcccaactcggacgacgagaaaatcacgcagctgttgaagaagcacaagtccagcagcggcggcggcggcggcctcctactgcacgcgtccgagccggagagctcatcctgaacgccgccgcccgccgcaccttcccggctccggcctccacctctggggccgcgaggggcgcggggaccgcgtgcacgccgcgcctgcccgctcctcggggcccggaggacccggccctgcctgcggggaccctttgctatttttgagatgtacatatctatttttttaaccttgaagttgtgggaggggatgtaggggagagagactccggggttgataaggcaagaaagaccaccaaatgcactgcgtaaatgtcgctactgaaacccgcagccgggccacggtcccagccgcgtccccataggcgggcagcggcctcagcgcccgggtccccctcgcccccagattttgcccccgcgggcggcggggtagggggcgccgagaggtgctgtggaagggttcacgctcaccgcatgggggacctcggagcgaagcgggcgggcgctgccacagatgggaagagggacgtttccccccccacacactgctgtgcaactaaagtaacctgttgaaggctctttgtaaataaatcgtgagttacactgactagaagttactttattgtgaatatttaaaatgtaaaatgcttttttgaatttcgtataaaaagatggactttcttccttctcctcctcccctttgaagagcgactcaagccacaccttcccttttattttgaacttaatttgagaagcgtagaatagaatgtccccaccttctccgtcccctcctctcgttcctctttcccgtttggatttgcagaatctcacctttgcccttcatctcttctcgccctgccctgccctgcccaccccctggatctacactgcgctcccgccccccggacttgaagtggaagacgtgggaaccagggagggcctctcacctgcctccctgttcctctctgaaattgcacagtcgtttgttgctatttattagtgatttaaagaaaatattggggagggaggggctacaatagcttgtatttaactcctttctgataaaaatgcgtgttaaagtaggtggtgggaattgttacaaccgctctgggtctgaaacataaaaattcatttagttactgtaattgaatttgaagtgttttgtatcataagaatactatagaatatgtaaattgttttctttttacagctaataatggtgatatattagcatctttaacctttattaatttatataaggaattcggtttgtaaagagaagaaaaccccctttgcaagaccagttaaatgtaatgcactttctgtttcaaaggataaatcaaattaaaaaaaacagtttgaagacgtctgttgccttgaatgaaagggtacagatcatctgatctcatcagagatctcaaataataaaagtcaagaccaca

SEQ ID NO: 1396 - DNA, 1061 bp, Homo sapiens
gcagccgacgcccgcccgggccgcgcgcaaacttcccgggccggcgggcaggggcggcggcggcggggcccggatgggagcccgggccggcggcggcggcgcccatggacactaaccgcccgggcgcgttcgtgctgagcagtgccccgctggccgcgctgcacaacatggccgagatgaagacgtcgctgttcccctacgcgctgcagggtccggccggcttcaaggcgcccgcgctggggggcctgggcgcgcagctcccgctcgggaccccgcacggcatcagcgacatcctgggccggcccgtgggcgcggcgggcgggggcctcctgggggggctgccccggctcaacgggctcgcgtcgtccgccggcgtttacttcgggcccgcggccgctgtggcgcgcggctaccccaagcccctggccgagctgccggggcgcccgcccatcttctggcccggcgtggtgcagggcgcgccctggagggacccgcgtctggctggcccggccccggccggcggcgtcctggacaaggacgggaagaagaagcactcgcgcccgaccttctcgggccagcagatcttcgcgctggagaaaaccttcgagcagaccaagtacctggcgggcccggagcgcgcgcgtctcgcctactcgctgggcatgaccgagagccaggtgaaggtctggttccagaaccgccggaccaagtggcgcaagcggcacgcggtggagatggcgtcggccaagaagaagcaggactcggacgccgagaagctgaaggtgggcggctcggacgcggaggacgacgacgaatacaaccggcccctggaccccaactcggacgacgagaagatcacgcggctgctcaagaagcacaaaccctcgaacttggcgctggtcagcccgtgcggcggcggcgcgggggacgccttgtgaggacccgcggggtgggggcgaatctatttttgcagaatccgggggcggccccgggtgggcgcgagtcgctttgtatcatcaataaattatttaacgggtccccgtcggagccgtcgctccgga

SEQ ID NO: 1397 - DNA, 555 bp, Homo sapiens
gagcgcggccggcgctccagcggtcggcatggcagctgctacctcgctgggacaggctctgggcccacgcgtgccgcgcagtccctacagaactgcagttgtcttgtcttctcggagtgctttcggctacttttcccttattactttagctcgatacacgttgggctgcctttcacattcggatattacgctgttcgagtgctgacgggaaaggcagccctttgacacgcacgcgaaatgtcgcctgacgagggcaaaggaacgactcggcgcgcgcgcgggagcgagctttgaaagttgagcacggcggcggcgagccggtgccctgggatcatggtggcgttgcggggccttggtagcggcctgcagccctggtgtccgctggatcttagactcgaatgggttgacacagtgtgggaactggatttcacagagactgagcctttggatcccagcatagaagcagagatcatagagactggattggctgcattcacaaaactctatgaaagccttttaccctttgctactggagaacatggatctatggaggta

SEQ ID NO: 1398 - DNA, 537 bp, Homo sapiens
agttgacaagcgactgtgacaggcctcgccggaggagctgggccctgaatcaccctgctccccggccggctgtcggcgctgggggagggggtcccgggggtcgactcaccgatctgcccgatgaactcgatcttgatgccctggtgctccagccgcttgttggggttcttgagggcaaggctcaccttcccggagaccgtctccccgtcgtagaagaggaaatatttctccttcttcccgtcctccgtcttgtgctcggcccgcttcctactctctgcatcgttcagaaggatttccacctccacgctctgcccgaagccgaagaagctcatcgcaccgccgggccgggcgggtctcggaacgactcggcgcgcgcgcgggagcgagctttgaaagttgagcacggcggcggcgagccggtgccctgggatcatggtggcgttgcggggccttggtagcggcctgcagccctggtgtccgctggatcttagactcgaatgggttgacacagtgtgggaactggatttcacagagact

SEQ ID NO: 1399 - DNA, 5061 bp, Homo sapiens
ggcgcgcgcgcgggagcgagctttgaaagttgagcacggcggcggcgagccggtgccctgggatcatggtggcgttgcggggccttggtagcggcctgcagccctggtgtccgctggatcttagactcgaatgggttgacacagtgtgggaactggatttcacagagactgagcctttggatcccagcatagaagcagagatcatagagactggattggctgcattcacaaaactctatgaaagccttttaccctttgctactggagaacatggatctatggagagtatctggaccttcttcattgagaacaatgtttcccatagtacactggtggcattgttctatcattttgttcaaatagttcataagaagaatgtcagtgtacagtatcgagaatatggccttcatgccgctgggctttactttttgctactagaagtaccaggcagtgtagccaatcaagtattccacccagtgatgtttgacaaatgcattcagactctaaagaagagctggccccaggaatctaacttgaatcggaaaagaaagaaagaacagcctaagagctctcaggctaaccccgggaggcatagaaaaaggggaaagccacccaggagagaagatattgagatggatgaaattatagaagaacaagaagatgagaatatttgtttttctgcccgggacctttctcaaattcgaaatgccatctttcaccttttaaagaattttttaaggcttctgccaaagttttccttgaaagaaaagccacaatgtgtacagaattgtatagaggtctttgtttcattaactaattttgagccagttcttcatgaatgtcatgttacacaagccagagctcttaaccaagcaaaatacataccagaactggcttattatggattgtatttgctgtgctctcccattcatggagaaggagataaggtcatcagttgtgttttccatcaaatgctcagtgtaatattaatgttagaagttggtgaaggatcccatcgtgccccccttgctgttacctcccaagtcatcaactgtagaaaccaggcggtccagtttatcagcgcccttgtggatgaattaaaggagagtatattcccagtcgtccgtatcttactgcagcacatctgtgccaaggtggtagataaatcagagtatcgtacttttgcagcccagtccctagtccagctgctcagtaaacttccttgtggggaatacgctatgttcattgcctggctttacaaatactcccgaagttccaagatcccacaccgggtttttactcttgatgttgtcttagctctgttagaactgcctgaaagagaggtggataacaccctctccttggagcatcagaagttcttaaagcataagttcctggtgcaggaaattatgtttgatcgttgcttagacaaggcgcctactgtccgcagcaaggcactgtccagctttgcacactgtctggagttgactgttaccagtgcgtcggagagtatcctggagctcctgattaacagtcctacgttttctgtaatagagagtcaccctggtaccttactgagaaattcatcagctttttcctaccaaaggcagacatctaaccgttccgaaccctcaggggagatcaacatagacagcagtggtgaaacagttggatctggagaaagatgtgtcatggcaatgctgagaaggaggatcagggatgagaagaccaacgttaggaagtctgcactgcaggtattagtgagtattttgaaacactgtgatgtctcaggcatgaaggaagacctgtggattctgcaggaccagtgtcgggaccctgcagtgtctgtccggaagcaggccctccagtctcttactgaactccttatggctcagcctagatgcgtgcagatccagaaagcctggttgcggggggtggtcccggtggtgatggactgcgagagcactgtgcaggagaaggccctggagttcctggaccagctgctgctgcagaacatccggcatcacagtcattttcactctggggacgacagccaggtcctcgcctgggcgcttcttactctcctcaccaccgaaagccaggaactgagccgatatttaaataaggcttttcatatctggtccaagaaagaaaaattctcacccacttttataaacaatgtaatatctcacactggcacggaacattcggcacctgcctggatgctgctctccaagattgctggctcctcacccaggctggactacagcagaataatacaatcttgggagaaaatcagcagtcagcagaatcccaattcaaacaccttaggacatattctctgtgtgattgggcatattgcaaagcatcttcctaagagcacccgggacaaagtgactgatgctgtcaagtgtaagctgaatggatttcagtggtctctagaggtgatcagttcagctgttgacgccttgcagaggctttgtagagcatctgcagagacaccagcagaggagcaggaattgctgacgcaggtgtgtggggatgtactctccacctgcgagcaccgcctctccaacatcgttctcaaggagaatggaacagggaatatggacgaagacctgttggtgaagtacatttttaccttaggggatatagcccagctgtgtccagccagggtggagaagcgcatcttccttctgattcagtccgtcctggcttcgtctgctgatgctgaccactcaccatcatctcaaggcagcagtgaggccccagcgtctcagccacccccccaggtcagaggttctgtcatgccctctgtgattagagcacatgccatcattaccttaggtaagctgtgcttacagcacgaggatctggcaaagaagagcatcccagccctggtgcgagagctcgaggtgtgtgaggacgtggctgtccgcaacaacgtcatcattgtaatgtgcgatctctgcattcgctacaccatcatggtggacaagtatattcccaacatctccatgtgtctgaaggattccgacccattcatccggaagcagacactcatcttgcttaccaatctcttgcaggaggaatttgtgaaatggaagggctccctgttcttccgatttgtcagcactctgatcgattcacacccagacattgccagcttcggggagttttgcctggctcacctgttactgaagaggaaccctgtcatgttcttccaacacttcattgaatgtatttttcactttaataactatgagaagcatgagaagtacaacaagttcccccagtcagagagagagaagcggctgttttcattgaagggaaagtcaaacaaagagagacgaatgaaaatctacaaatttcttctagagcacttcacagatgaacagcgattcaacatcacttccaaaatctgccttagtattttggcgtgctttgctgatggcatcctacccctggacctggacgccagtgagttactctcagacacgtttgaggtcctcagctcaaaggagatcaagcttttggcaatgagatctaaaccagacaaagacctccttatggaagaagatgacatggccttggcaaatgtagtcatgcaggaagctcagaagaagctcatctcacaagttcagaagaggaatttcatagaaaatattattccaattatcatctccctgaagactgtgctggagaaaaataagatcccagctttgcgggaactcatgcactatctcagggaggtgatgcaggattaccgagatgagctcaaggacttctttgcagttgacaaacagctggcatcagagcttgagtatgacatgaagaagtaccaggaacagctggtccaggagcaggagctagcaaaacatgcagatgtggccgggacggctggaggtgctgaggtggcacctgtggcacaggttgccctgtgtttagaaacagtgccagttcctgctggccaagaaaaccctgccatgtcacctgccgtgagccagccctgcacacccagggcaagtgctggccatgtagcagtatcatctcctacacctgaaacagggccattgcagaggttgctgcccaaagccaggcccatgtccctgagcaccattgcaatcctgaattctgtcaagaaagccgtggagtcaaagagcaggcatcggagtcggagcttaggagtgctgcctttcactttaaattctggaagcccagaaaaaacgtgcagtcaggtgtcttcatacagtttggagcaagagtcgaatggcgagattgagcacgtgaccaagcgggccatcagcacccccgagaagagcatcagtgatgtcacgtttggagcaggggtcagttacatcgggacaccacggactccgtcgtcagccaaagagaaaattgaaggccggagtcaaggaaatgacatcttatgtttatcactgcctgataaaccgcccccacagcctcagcagtggaatgtgcggtctcccgccaggaataaagacactccagcctgcagcaggaggtccctccgaaagacccctctgaaaacagccaactaaacagcgcctcccaccagtgtccaggcaggcaggagcccttgaggaagcagtctcgtgtcctccgtgtgaaggcagctggatcacttcccgcagtccttgggcagcgctttgctgtggaacacgagagctcctcctcaggggcctggcactcaccttctattctgtatgatgtatttggttaaacactgtcaaataatagagatgtgccagatttagattttcttaccctaatctgtttaatattgtaactttattccatttgaaagtgtcaagcccattcagataagctataatctggtctttaaggaacacaactttaaaactgcagctttcttttatataaatcaagcctctgttaacttgaattccttatagtacatattttcccatctgtaatgacgaaattttgattctaatattttttctattatttataagtgcaaattttttaaaaaagtgtacagctttctaaaagtaataaaggtttagcataaataca

SEQ ID NO: 1400 - DNA, 2924 bp, Homo sapiens
atttggaggaaagtggagaaattaaagatatgttacttgagtgcttcataaatattaattatatcaagaaagaagagggaagaagatttcttagttgtctcttcaactggaatatcaacttcatcaaaatgatccacgggaccattaaaaaccagttacagggattacaaaagtctttgatggtatacattgcagaaatttatttcagagcttggaaaaaggcttcagggaaaatactggaggcgattgaaaatgattgcatccaggacttcatgttccacgggatacaccttccgaggaggtctccagtgcattccaaagtgcgggaggttctgagttactttcaccatcaaaagaaagttcggcagggagtggaagagatgctttatagattatataagcccatcctttggagaggattaaaggccagaaactctgaagttcgatcaaatgctgcattgttgtttgttgaagcatttcctattagggatccaaaccttcatgctattgaaatggatagtgaaatccagaaacagtttgaagagctctatagccttttagaagatccttacccgatggtccgttccacagggatccttggtgtttgtaaaataacttctaagtactgggaaatgatgcccccgaccattcttattgacctcctgaagaaggtgactggggaactggcatttgacacgagctcagctgatgttcgttgttctgtctttaagtgtctgccaatgattttggacaacaaactgagccacccattgttagagcagctccttccagctctcagatacagtctccacgacaattcggagaaagtgagggtagcttttgtggacatgctgttgaagatcaaagctgtgagggctgctaagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcgggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatttctctatgaatcatcatcaagaactctgggagaacttttgaattcataaccaagccaacatctccagacatgtaaaaatagggaaaagtgattcaaattgaaatgcctgtgtattttcctattgtttttaatgttaataacccatataatagggaaagggtgggatttttttgtgggaatgtgggaaggtgggggttatggaggagataactcaaaacttcttcaattttgcctagtgcctgcgtaaataatatatttaatataaaggactccaggt

SEQ ID NO: 1401 - DNA, 3930 bp, Homo sapiens
gagagcggcgcctgatgacgaccgggagggcggggcccgtctggggcgccggcgggtgcgtttgaatctggtccgagcgcgggaaacggcgggtccccgagcccagggttacaaaataaatgccatttgaacagtgccatctgtcatggaaaaacgtgagacgtttgtacaagccgtgtctaaggagctggttggagagtttttgcaatttgttcaacttgataaagaggcctctgatcctttcagcctaaatgaattactagatgaattatcaaggaaacagaaagaagaattatggcaaaggctgaagaatttattgacagatgtgttgttagaaagcccagtggatgggtggcaggtagtggaagcccagggtgaagacaatatggaaaccgaacatggctcaaaaatgagaaaaagcatagaaataatttatgcaattacatctgtgattcttgcttctgtgtctgtaataaatgaaagtgagaactacgaagccctactggaatgtgttattatattaaatggtattttatatgcattacctgagtctgaacgaaaactacagagttctattcaggatttgtgtgttacctggtgggagaaaggcctgcctgccaaggaagacacaggaaagacagcctttgtcatgttactaaggaggagtctggagactaagacaggtgcagacgtatgtcggctttggcgtatccatcaagctttatattgctttgattatgatttggaggaaagtggagaaattaaagatatgttacttgagtgcttcataaatattaattatatcaagaaagaagagggaagaagatttcttagttgtctcttcaactggaatatcaacttcatcaaaatgatccacgggaccattaaaaaccagttacagggattacaaaagtctttgatggtatacattgcagaaatttatttcagagcttggaaaaaggcttcagggaaaatactggaggcgattgaaaatgattgcatccaggacttcatgttccacgggatacaccttccgaggaggtctccagtgcattccaaagtgcgggaggttctgagttactttcaccatcaaaagaaagttcggcagggagtggaagagatgctttatagattatataagcccatcctttggagaggattaaaggccagaaactctgaagttcgatcaaatgctgcattgttgtttgttgaagcatttcctattagggatccaaaccttcatgctattgaaatggatagtgaaatccagaaacagtttgaagagctctatagccttttagaagatccttacccgatggtccgttccacagggatccttggtgtttgtaaaataacttctaagtactgggaaatgatgcccccgaccattcttattgacctcctgaagaaggtgactggggaactggcatttgacacgagctcagctgatgttcgttgttctgtctttaagtgtctgccaatgattttggacaacaaactgagccacccattgttagagcagctccttccagctctcagatacagtctccacgacaattcggagaaagtgagggtagcttttgtggacatgctgttgaagatcaaagctgtgagggctgctaagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcggctgctttattctgttcagaggcctcttcatgagttcattactgctgttcagtctcggcacacagacacccctgtgcaccggggtgtactttctactctgatcgctgggcctgtggttgagataagtcaccagctacggaaggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatttctctatgaatcatcatcaagaactctgggagaacttttgaattcataaccaagccaacatctccagacatgtaaaaatagggaaaagtgattcaaattgaaatgcctgtgtattttcctattgtttttaatgttaataacccatataatagggaaagggtgggatttttttgtgggaatgtgggaaggtgggggttatggaggagataactcaaaacttcttcaattttgcctagtgcctgcgtaaataatatatttaatataaaggactccaggtatgaatggtgtagaaatccatgattccaagaaaaaacacttttctagcaaacctggttgtttttaaaatgacttttatatatgtaatattgcttggaaactatgagtaataaagcaatgacaaca

SEQ ID NO: 1402 - DNA, 5253 bp, Homo sapiens
ggggcccgtctggggcgccggcgggtgcgtttgaatctggtccgagcgcgggaaacggcgggtccccgagcccagggttacaaaataaatgccatttgaacagtgccatctgtcatggaaaaacgtgagacgtttgtacaagccgtgtctaaggagctggttggagagtttttgcaatttgttcaacttgataaagaggcctctgatcctttcagcctaaatgaattactagatgaattatcaaggaaacagaaagaagaattatggcaaaggctgaagaatttattgacagatgtgttgttagaaagcccagtggatgggtggcaggtagtggaagcccagggtgaagacaatatggaaaccgaacatggctcaaaaatgagaaaaagcatagaaataatttatgcaattacatctgtgattcttgcttctgtgtctgtaataaatgaaagtgagaactacgaagccctactggaatgtgttattatattaaatggtattttatatgcattacctgagtctgaacgaaaactacagagttctattcaggatttgtgtgttacctggtgggagaaaggcctgcctgccaaggaagacacaggaaagacagcctttgtcatgttactaaggaggagtctggagactaagacaggtgcagacgtatgtcggctttggcgtatccatcaagctttatattgctttgattatgatttggaggaaagtggagaaattaaagatatgttacttgagtgcttcataaatattaattatatcaagaaagaagagggaagaagatttcttagttgtctcttcaactggaatatcaacttcatcaaaatgatccacgggaccattaaaaaccagttacagggattacaaaagtctttgatggtatacattgcagaaatttatttcagagcttggaaaaaggcttcagggaaaatactggaggcgattgaaaatgattgcatccaggacttcatgttccacgggatacaccttccgaggaggtctccagtgcattccaaagtgcgggaggttctgagttactttcaccatcaaaagaaagttcggcagggagtggaagagatgctttatagattatataagcccatcctttggagaggattaaaggccagaaactctgaagttcgatcaaatgctgcattgttgtttgttgaagcatttcctattagggatccaaaccttcatgctattgaaatggatagtgaaatccagaaacagtttgaagagctctatagccttttagaagatccttacccgatggtccgttccacagggatccttggtgtttgtaaaataacttctaagtactgggaaatgatgcccccgaccattcttattgacctcctgaagaaggtgactggggaactggcatttgacacgagctcagctgatgttcgttgttctgtctttaagtgtctgccaatgattttggacaacaaactgagccacccattgttagagcagctccttccagctctcagatacagtctccacgacaattcggagaaagtgagggtagcttttgtggacatgctgttgaagatcaaagctgtgagggctgctaagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcggctgctttattctgttcagaggcctcttcatgagttcattactgctgttcagtctcggcacacagacacccctgtgcaccggggtgtactttctactctgatcgctgggcctgtggttgagataagtcaccagctacggaaggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatatgaggacttgctgtgttgcccaggctgggctctaactcctggactcctggactcaatctatccttctgcctcagtcccaattggctaggactgcaggcacacaccaccagacccagctaatgtaatttctatctatatgtgtctttatatttaaagtggtttttttatagacagtatataaatgggtcatgttttttgatcttctctgacaatctgtcttaaaattggtgcatatgtaccatattcaaagtgattattgatatagttggattaatatccaccatatttgttattgtcttctatttgttccccttgttatttgttcctatttctgtcttccactccttttctgtcttttgtggttttaactgaacattttatgatgccgttttctttcctagcatatcagttatacttttttttttttaaacctttcttagtggtttctttagagttggaatttttatttgtttttatctttcttagtggttgctttagagttggagttttcatttataactaatccacgtttgctttcagatgacactataccactttgcaggtagggtggtatataataacaaaataatcctaatccttgcctctcgttccttgtatcattgctgtcattcattttgctaaggtataagcagacataagcatacataattgaatatattgttgctattattattttgaacaaactacatcttaggtcatttaagaataagaaaaataaaagtttttatttaccttcacttactccttctttgatgcttctcctttgtttgtgttgatccaaattctgacctatattcttttccttccctccagagaacttcttttaatgcttctttcaaggcatgtctactggcaactaattctcttaattttggtttgtcagagagtcttttacttctactttatttctttgcagggataatgttatgtagtttataattctagttgatgaatttttttctctctgtactttatttaatttattattattattttttgagacagagtcttgctctgttgcctagggtggaacgcagtggtgtgatctcagttcactgcaacctctgcctcctaagttcaaacgattcttgtacctcagcctgctgagtagctggtatacaggcacatcgccgccacacccagctcatttttgtattagtggagacagggcttcaccatgttgcccaggctggtctcgaattcttgatctcaagtgatctactcgcctcagcttctcaaattgctgggattactccccgtgcccggccactctctgtactttaaacatttcgctatactctcttcttggctcgtgtagtatctgagaaataggatataattcttttttgctcctcagtagataaggtgtatttttccctatctggtttctttcaatactttttctttgtttgatttttctgtaggttgaatatgatatgcctaggtgtagttttcttttcttttttttttttttttttggcatttattctattcagtattctatgagcttcctggataaattctcagttattattgtctgaatatttcttctgttcctttctctcttctgaaattcttattatacatgttaacaccttttacagttgtctcacaggtcttggatatttcattctatcaaaacagctgcatttttgaattctgtttgctaatattttatttgagaatgtttgcattaggtttgaaataagattaaatggttgttggttgttttgtt

SEQ ID NO: 1403 - DNA, 3957 bp, Homo sapiens
gagggcggggcccgtctggggcgccggcgggtgcgtttgaatctggtccgagcgcgggaaacggcgggtccccgagcccagtaccagacctcctgtgcgaagagtaacctgctcttcggactgataactggatgggttacaaaataaatgccatttgaacagtgccatctgtcatggaaaaacgtgagacgtttgtacaagccgtgtctaaggagctggttggagagtttttgcaatttgttcaacttgataaagaggcctctgatcctttcagcctaaatgaattactagatgaattatcaaggaaacagaaagaagaattatggcaaaggctgaagaatttattgacagatgtgttgttagaaagcccagtggatgggtggcaggtagtggaagcccagggtgaagacaatatggaaaccgaacatggctcaaaaatgagaaaaagcatagaaataatttatgcaattacatctgtgattcttgcttctgtgtctgtaataaatgaaagtgagaactacgaagccctactggaatgtgttattatattaaatggtattttatatgcattacctgagtctgaacgaaaactacagagttctattcaggatttgtgtgttacctggtgggagaaaggcctgcctgccaaggaagacacaggaaagacagcctttgtcatgttactaaggaggagtctggagactaagacaggtgcagacgtatgtcggctttggcgtatccatcaagctttatattgctttgattatgatttggaggaaagtggagaaattaaagatatgttacttgagtgcttcataaatattaattatatcaagaaagaagagggaagaagatttcttagttgtctcttcaactggaatatcaacttcatcaaaatgatccacgggaccattaaaaaccagttacagggattacaaaagtctttgatggtatacattgcagaaatttatttcagagcttggaaaaaggcttcagggaaaatactggaggcgattgaaaatgattgcatccaggacttcatgttccacgggatacaccttccgaggaggtctccagtgcattccaaagtgcgggaggttctgagttactttcaccatcaaaagaaagttcggcagggagtggaagagatgctttatagattatataagcccatcctttggagaggattaaaggccagaaactctgaagttcgatcaaatgctgcattgttgtttgttgaagcatttcctattagggatccaaaccttcatgctattgaaatggatagtgaaatccagaaacagtttgaagagctctatagccttttagaagatccttacccgatggtccgttccacagggatccttggtgtttgtaaaataacttctaagtactgggaaatgatgcccccgaccattcttattgacctcctgaagaaggtgactggggaactggcatttgacacgagctcagctgatgttcgttgttctgtctttaagtgtctgccaatgattttggacaacaaactgagccacccattgttagagcagctccttccagctctcagatacagtctccacgacaattcggagaaagtgagggtagcttttgtggacatgctgttgaagatcaaagctgtgagggctgctaagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcggctgctttattctgttcagaggcctcttcatgagttcattactgctgttcagtctcggcacacagacacccctgtgcaccggggtgtactttctactctgatcgctgggcctgtggttgagataagtcaccagctacggaaggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatttctctatgaatcatcatcaagaactctgggagaacttttgaattcataaccaagccaacatctccagacatgtaaaaatagggaaaagtgattcaaattgaaatgcctgtgtattttcctattgtttttaatgttaataacccatataatagggaaagggtgggatttttttgtgggaatgtgggaaggtgggggttatggaggagataactcaaaacttcttcaattttgcctagtgcctgcgtaaataatatatttaatataaaggactccaggtatgaatggtgtagaaatccatgattccaagaaaaaacacttttctagcaaacctggttgtttttaaaatgacttttatatatgtaatattgcttggaaactatgagtaataaagcaatgacaac

SEQ ID NO: 1404 - DNA, 2926 bp, Homo sapiens
atttggaggaaagtggagaaattaaagatatgttacttgagtgcttcataaatattaattatatcaagaaagaagagggaagaagatttcttagttgtctcttcaactggaatatcaacttcatcaaaatgatccacgggaccattaaaaaccagttacagggattacaaaagtctttgatggtatacattgcagaaatttatttcagagcttggaaaaaggcttcagggaaaatactggaggcgattgaaaatgattgcatccaggacttcatgttccacgggatacaccttccgaggaggtctccagtgcattccaaagtgcgggaggttctgagttactttcaccatcaaaagaaagttcggcagggagtggaagagatgctttatagattatataagcccatcctttggagaggattaaaggccagaaactctgaagttcgatcaaatgctgcattgttgtttgttgaagcatttcctattagggatccaaaccttcatgctattgaaatggatagtgaaatccagaaacagtttgaagagctctatagccttttagaagatccttacccgatggtccgttccacagggatccttggtgtttgtaaaataacttctaagtactgggaaatgatgcccccgaccattcttattgacctcctgaagaaggtgactggggaactggcatttgacacgagctcagctgatgttcgttgttctgtctttaagtgtctgccaatgattttggacaacaaactgagccacccattgttagagcagctccttccagctctcagatacagtctccacgacaattcggagaaagtgagggtagcttttgtggacatgctgttgaagatcaaagctgtgagggctgctaagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcgggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatttctctatgaatcatcatcaagaactctgggagaacttttgaattcataaccaagccaacatctccagacatgtaaaaatagggaaaagtgattcaaattgaaatgcctgtgtattttcctattgtttttaatgttaataacccatataatagggaaagggtgggatttttttgtgggaatgtgggaaggtgggggttatggaggagataactcaaaacttcttcaattttgcctagtgcctgcgtaaataatatatttaatataaaggactccaggtat

SEQ ID NO: 1405 - DNA, 3606 bp, Homo sapiens
gaatctggtccgagcgcgggaaacggcgggtccccgagcccagtaccagacctcctgtgcgaagagtaacctgctcttcggactgataactggatgggttacaaaataaatgccatttgaacagtgccatctgtcatggaaaaacgtgagacgtttgtacaagccgtgtctaaggagctggttggagagtttttgcaatttgttcaacttgataaagaggcctctgatcctttcagcctaaatgaattactagatgaattatcaaggaaacagaaagaagaattatggcaaaggctgaagaatttattgacagatgtgttgttagaaagcccagtggatgggtggcaggtagtggaagcccagggtgaagacaatatggaaaccgaacatggctcaaaaatgagaaaaagcatagaaataatttatgcaattacatctgtgattcttgcttctgtgtctgtaataaatgaaagtgagaactacgaagccctactggaatgtgttattatattaaatggtattttatatgcattacctgagtctgaacgaaaactacagagttctattcaggatttgtgtgttacctggtgggagaaaggcctgcctgccaaggaagacacaggaaagacagcctttgtcatgttactaaggaggagtctggagactaagacaggtgcagacgtatgtcggctttggcgtatccatcaagctttatattgctttgattatgatttggaggaaagtggagaaattaaagatatgttacttgagtgcttcataaatattaattatatcaagaaagaagagggaagaagatttcttagttgtctcttcaactggaatatcaacttcatcaaaatgatccacgggaccattaaaaaccagttacagggattacaaaagtctttgatggtatacattgcagaaatttatttcagagcttggaaaaaggcttcagggaaaatactggaggcgattgaaaatgattgcatccaggacttcatgttccacgggatacaccttccgaggaggtctccagtgcattccaaagtgcgggaggttctgagttactttcaccatcaaaagaaagttcggcagggagtggaagagatgctttatagattatataagcccatcctttggagaggattaaaggccagaaactctgaagttcgatcaaatgctgcattgttgtttgttgaagcatttcctattagggatccaaaccttcatgctattgaaatggatagtgaaatccagaaacagtttgaagagctctatagccttttagaagatccttacccgatggtccgttccacagggatccttggtgtttgtaaaataacttctaagtactgggaaatgatgcccccgaccattcttattgacctcctgaagaaggtgactggggaactggcatttgacacgagctcagctgatgttcgttgttctgtctttaagtgtctgccaatgattttggacaacaaactgagccacccattgttagagcagctccttccagctctcagatacagtctccacgacaattcggagaaagtgagggtagcttttgtggacatgctgttgaagatcaaagctgtgagggctgctaagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcggctgctttattctgttcagaggcctcttcatgagttcattactgctgttcagtctcggcacacagacacccctgtgcaccggggtgtactttctactctgatcgctgggcctgtggttgagataagtcaccagctacggaaggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatatgaggacttgctgtgttgcccaggctgggctctaactcctggactcctggactcaatctatccttctgcctcagtcccaattggctag

SEQ ID NO: 1406 - DNA, 2270 bp, Homo sapiens
tttgggcgccagagcagaggaagaaggcagaacgtttgcgtttcagtccttatctttgcaagtgcaaggcagacagccatttggttgtgaggtgtctggaaagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcgggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatttctctatgaatcatcatcaagaactctgggagaacttttgaattcataaccaagccaacatctccagacatgtaaaaatagggaaaagtgattcaaattgaaatgcctgtgtattttcctattgtttttaatgttaataacccatataatagggaaagggtgggatttttttgtgggaatgtgggaaggtgggggttatggaggagataactcaaaacttcttcaattttgcctagtgcctgcgtaaataatatatttaatataaaggactccaggtatgaatggtgtagaaatccatgattccaagaaaaaacacttttctagcaaacctggttgtttttaaaatgacttttatatatgtaatattgcttggaaactatgagtaataaagcaatgacaacatc

SEQ ID NO: 1407 - DNA, 2276 bp, Homo sapiens
gcacagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcggctgctttattctgttcagaggcctcttcatgagttcattactgctgttcagtctcggcacacagacacccctgtgcaccggggtgtactttctactctgatcgctgggcctgtggttgagataagtcaccagctacggaaggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaaggatatgaggacttgctgtgttgcccaggctgggctctaactcctggactcctggactcaatctatccttctgcctcagtcccaattggctaggactgcaggcacacaccaccagacccagctaatgtaatttctatctatatgtgtctttatatttaaagtggtttttttatagacagtatataaatgggtcatgttttttgatcttctctgacaatctgtcttaaaattggtgcatatgtaccatattcaaagtgattattgatatagttggattaatatccaccatatttgttattgtcttctatttgttccccttgttatttgttcctatttctgtcttccactccttttctgtcttttgtggttttaactgaacattttatgatgccgttttctttcctagcatatcagttatacttttttttttttaaacctttcttagtggtttctttagagttggaatttttatttgtttttatctttcttagtggttgctttagagttggagttttcatttataactaatccacgtttgctttca

SEQ ID NO: 1408 - DNA, 1996 bp, Homo sapiens
aactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggagctggatcagatctgcatttcttttgacgaaggcaagaccacaatgaacttcattgaggcagcgttgttgatccagggctctgcctgcgtctacagtaagaaggtggaatacctctactcactcgtctaccaggcccttgatttcatctctggaaagaggcgggccaagcagctctcttcggtgcaggaggacagggccaatggggttgccagctccggggtcccccaggaggcagagaatgagttcctgtcgctggatgacttccctgactcccggactaacgtggatctcaagaatgatcagacgcccagtgaggtcctcatcatccccctcctgcccatggccctggtggcccctgatgaaatggagaagaacaacaatcccctgtacagccgtcagggtgaggtcctggccagccggaaggatttcaggatgaacacgtgcgttccccaccccagaggggccttcatgttggagccagagggcatgtcccccatggaaccagcgggcgtttcccccatgccagggacccagaaggacaccgggaggactgaggagcagccaatggaagtttccgtgtgcaggagccctgtcccagcactcggcttctcccaggagccaggcccctctccagaaggcccgatgcccctgggtgggggcgaggacgaggatgcagaggaggcagtagagcttcctgaggcctcggcccccaaggccgctctggagcccaaggagtccaggagcccgcagcagagtgctgccctgcccaggaggtacatgctgcgggagcgggagggggccccagagcctgcatcctgcgtgaaggagactccagacccctggcagagcctggacccctttgactccttggagtctaagcccttcaagaaaggtaggccttactctgtgcccccctgtgtggaggaggctctgggacagaagcgcaagaggaagggcgctgccaagctgcaggacttccaccagtggtacctggctgcctatgcagaccatgccgacagcaggcggcttcggcgaaagggtccgtcctttgcagacatggaggtcctgtactggacacacgtgaaggagcagttggaaactctccggaagctgcagaggagggaggtggctgagcagtggctgcggcctgcagaggaggaccacctggaggattccctggaagacctgggggcagcagcagatgactttctagagcctgaggagtacatggagcccgagggagcagaccccagggaagccgctgaccttgacgcagtgccgatgtccctgagctacgaggagctggttcgaaggaatgtggagctcttcatcgccacctcccagaagtttgtccaggagacagagctgagccagcgcatcagggactgggaggacacagtgcagcctctgctccaggagcaggagcagcatgtgccctttgacatccacacctatggggaccagctggtctcacggttcccccagctcaatgagtggtgtccctttgcggagctggtggctggccagccggccttcgaggtgtgtcgttccatgctggcctccctgcagctggccaatgactacacagtggagataacccagcagcccgggctggagatggccgtggacaccatgtccctgagactgctcacgcaccagcgagcgcacaagcgcttccagacctacgctgccccctccatggcccagccctgagtggggagcaccgaggcaggggtgggggaatgtgtactgaggagccgtgtgtctgctcctggctggcccggcctaataaagcagtgttgccatctca

SEQ ID NO: 1409 - DNA, 1388 bp, Homo sapiens
cagcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggagctggatcagatctgcatttcttttgacgaaggcaagaccacaatgaacttcattgaggcagcgttgttgatccagggctctgcctgcgtctacagtaagaaggtggaatacctctactcactcgtctaccaggcccttgatttcatctctggaaagaggcgggccaagcagctctcttcggtgcaggaggacagggccaatggggttgccagctccggggtcccccaggaggcagagaatgagttcctgtcgctggatgacttccctgactcccggactaacgtggatctcaagaatgatcagacgcccagtgaggtcctcatcatccccctcctgcccatggccctggtggcccctgatgaaatggagaagaacaacaatcccctgtacagccgtcagggtgaggtcctggccagccggaaggatttcaggatgaacacgtgcgttccccaccccagaggggccttcatgttggagccagagggcatgtcccccatggaaccagcgggcgtttcccccatgccagggacccagaaggacaccgggaggactgaggagcagccaatggaagtttccgtgtgcaggagccctgtcccagcactcggcttctcccaggagccaggcccctctccagaaggcccgatgcccctgggtgggggcgaggacgaggatgcagaggaggcagtagagcttcctgaggcctcggcccccaaggccgctctggagcccaaggagtccaggagcccgcagcaggtgggacccacatggaggcctgcagaacctgagctgtgaactggcaaccctggctctggggccgagtcaccttgcacaaggaggacagtggtatggccttggccccagaccactggtctggggcagaagcccacctgtcttgcagcccgtcctgcaaccagcccttttgaagagcagcttctgtgttcctcccctctctgagcagaactgatgctcctcagagtagtgggctggcgtccaaggatttgagccctgtcgagctcacggcaacctgggatggccgccggttgccaaggcgcctctctgcagtcgggctggtaggagggagtgtctggaggccattgctgcctccctcaacccccggggtcaactgtacccagcctagagccaagaaatccttcctttttattcattaaaacaaaatcaacctga

SEQ ID NO: 1410 - DNA, 2037 bp, Homo sapiens
gcgcctacgcattttcctgggcgggaacagcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggagctggatcagatctgcatttcttttgacgaaggcaagaccacaatgaacttcattgaggcagcgttgttgatccagggctctgcctgcgtctacagtaagaaggtggaatacctctactcactcgtctaccaggcccttgatttcatctctggaaagaggcgggccaagcagctctcttcggtgcaggaggacagggccaatggggttgccagctccggggtcccccaggaggcagagaatgagttcctgtcgctggatgacttccctgactcccggactaacgtggatctcaagaatgatcagacgcccagtgaggtcctcatcatccccctcctgcccatggccctggtggcccctgatgaaatggagaagaacaacaatcccctgtacagccgtcagggtgaggtcctggccagccggaaggatttcaggatgaacacgtgcgttccccaccccagaggggccttcatgttggagccagagggcatgtcccccatggaaccagcgggcgtttcccccatgccagggacccagaaggacaccgggaggactgaggagcagccaatggaagtttccgtgtgcaggagccctgtcccagcactcggcttctcccaggagccaggcccctctccagaaggcccgatgcccctgggtgggggcgaggacgaggatgcagaggaggcagtagagcttcctgaggcctcggcccccaaggccgctctggagcccaaggagtccaggagcccgcagcagagtgctgccctgcccaggaggtacatgctgcgggagcgggagggggccccagagcctgcatcctgcgtgaaggagactccagacccctggcagagcctggacccctttgactccttggagtctaagcccttcaagaaaggtaggccttactctgtgcccccctgtgtggaggaggctctgggacagaagcgcaagaggaagggcgctgccaagctgcaggacttccaccagtggtacctggctgcctatgcagaccatgccgacagcaggcggcttcggcgaaagggtccgtcctttgcagacatggaggtcctgtactggacacacgtgaaggagcagttggaaactctccggaagctgcagaggagggaggtggctgagcagtggctgcggcctgcagaggaggaccacctggaggattccctggaagacctgggggcagcagatgactttctagagcctgaggagtacatggagcccgagggagcagaccccagggaagccgctgaccttgacgcagtgccgatgtccctgagctacgaggagctggttcgaaggaatgtggagctcttcatcgccacctcccagaagtttgtccaggagacagagctgagccagcgcatcagggactgggaggacacagtgcagcctctgctccaggagcaggagcagcatgtgccctttgacatccacacctatggggaccagctggtctcacggttcccccagctcaatgagtggtgtccctttgcggagctggtggctggccagccggccttcgaggtgtgtcgttccatgctggcctccctgcagctggccaatgactacacagtggagataacccagcagcccgggctggagatggccgtggacaccatgtccctgagactgctcacgcaccagcgagcgcacaagcgcttccagacctacgctgccccctccatggcccagccctgagtggggagcaccgaggcaggggtgggggaatgtgtactgaggagccgtgtgtctgctcctggctggcccggcctaataaagcagtgttgccatctca

SEQ ID NO: 1411 - DNA, 1044 bp, Homo sapiens
ctcaaaggaagaagagtccaccttgcgaccgtatccgctagcgcggcctgggatgcgcttgggctccctgttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgcaatgccaccgtagataagttggaggacttcatcaacaacattaacagtgtcttggagtccttgtatattgagataaagagaggagtcacggaagatgatgggagacccatttatgcgttggtgaatcttgctacaacttcaatttccaaaatggctacggattttgcagagaatgaactggatttgtttagaaaggctctggaactgattattgactcagaaaccggctttgcgtcttccacaaacatattgaacctggttgatcaacttaaaggcaagaagatgaggaagaaggaagcggagcaggtgctgcagaagtttgttcaaaacaagtggctgattgagaaggaaggggagttcaccctgcacggccgggccatcctggagatggagcaatacatccgggagacgtaccccgacgcggtgaagatctgcaatatctgtcacagcctcctcatccagggtcaaagctgcgaaacctgtgggatcaggatgcacttaccctgcgtggccaagtacttccagtcgaatgctgaaccgcgctgcccccactgcaacgactactggccccacgagatcccaaaagtcttcgaccctgagaaggagagggagtctggtgtcttgaaatcgaacaaaaagtccctgcggtccaggcagcattagccatcgtgccctgctgaggggctggctgccttgagtggcctgatcgccacagcccttcttggaagaaaggcgtccgtgtttcaggttccacgcgagtcacctctttcgtcttaatgttcaccgtccacagctttggaataaaccatcctgggaagttgctgc

SEQ ID NO: 1412 - DNA, 1195 bp, Homo sapiens
gcccgctctcacttttcagcggcaggcgaagggggctgaggaaaggaggtgggtctaggcaggggaaattggggtgccaccagacggagacagcttggactaccagaatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtggtcttcaagctgacagagaagctgacggaacagaaggagtggatgaagatataattgtgacccaaagtcagaccaacttcacctgccccattacaaaggaggaaatgaagaagccagtgaaaaataaagtgtgtggccacacctatgaagaggacgccattgttcgcatgattgagtccaggcaaaagcggaagaaaaaggcctattgccctcaaattggctgtagccacacggatataagaaagtcagatcttatccaggatgaagcacttagaagggcaattgagaaccataacaagaaaagacatcgtcattccgagtaggaaaagccacctgcctgcagggacaccagcagcctacctcctaccccagctgtctgttgagagcagtgctgaccccagcagttagggactggctgcatagcatacttgttgggggtaaaacttgttgcttttatgtgtgcttgaaaacatttttcaaagttacacaacagaaatgcaatcatattgtttatttttaagtgttctataatgttaaataaaactttgatcatctgca

SEQ ID NO: 1413 - DNA, 841 bp, Homo sapiens
gacgcaagagcccgctctcacttttcagcggcaggcgaagggggctgaggaaaggaggtgggtctaggcaggggaaattggggtgccaccagacggagacagcttggactaccaggcttttaagaactgtgctattgttgacttcttcacagaatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtggtcttcaagctgacagagaagctgacggaacagaaggagtggatgaagatataattgtgacccaaagtcagaccaacttcacctgccccattacaaaggaggaaatgaagaagccagtgaaaaataaagtgtgtggccacacctatgaagaggacgcc

SEQ ID NO: 1414 - DNA, 405 bp, Homo sapiens
cttttcagcggcaggcgaagggggctgaggaaaggaggtgggtctaggcaggggaaattggggtgccaccagacggagacagcttggactaccagaattacagaagagcatgatcgtgttttccttggtcctctgcaaaagtgaagtttcactaaagtaataatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgc

SEQ ID NO: 1415 - DNA, 1037 bp, Homo sapiens
agcggcaggcgaagggggctgaggaaaggaggtgggtctaggcaggggaaattggggtgccaccagacggagacagcttggactaccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtggtcttcaagctgacagagaagctgacggaacagaaggagtggatgaagatataattgtgacccaaagtcagaccaacttcacctgccccattacaaaggaggaaatgaagaagccagtgaaaaataaagtgtgtggccacacctatgaagaggacgccattgttcgcatgattgagtccaggcaaaagcggaagaaaaaggcctattgccctcaaattggctgtagccacacggatataagaaagtcagatcttatccaggatgaagcacttagaagggcaattgagaaccataacaagaaaagacatcgtcattccgagtaggaaaagccacctgcctgcagggacaccagcagcctacctcctaccccagctgtctgttgagagcagtgctgaccccagcagttagggactggctgcatagcatacttgttgggggtaaaacttgttgcttttatgtgtgcttgaaaacatttttcaaagttacacaacagaaatgcaatcatattgttta

SEQ ID NO: 1416 - DNA, 787 bp, Homo sapiens
agtttccacccctccctcaaggcggcggtcctcttctatccgcagtcccggacctggagcgggtcagaccccgacttccgcccctgactccccaggcggtcacatgaccgaagcggctgggagcagggaggggcatcatgtgaccactcgccggcgacggctgatgacgcaagagcccgctctcacttttcagcggcaggcgaagggggctgaggaaaggaggcttttaagaactgtgctattgttgacttcttcacagaatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaat

SEQ ID NO: 1417 - DNA, 1200 bp, Homo sapiens
cttgaaactctctggattcctgtaaacagtggggctcagcccctcaatgactggaggcttcgatggttcaaaggggacctccggaatcacagggccgggagtcgccatgtccgggccacagcagcaggagaaaatcgggactccgacctcagcctcccggtgaaggtcatgaaaggggcggggaaacgaataaattgagccttgtacgcaggcgcaaatgctcgttgcatcctgggagtcgtagtgctcagcacggtagtgctacaaaaggactacatttccccaaatgcccgcaaagccttgtgcacgccttccggaaggagtttgttacacgaggtctgagagacagaggcagcgtgtttgagctgctggtgcggtggtcagcgcgatgcccaaggccaagggcaaaacccggaggcagaagtttggttacagtgtcaaccgaaagcgtctgaaccggaatgctcgacggaaggcagcgccgcggatcgaatgctcccacatccgacatgcctgggaccacgctaaatcggtacggcagaacctggccgagatggggttggctgtggaccccaacaggcggtgccctccgtaagagaaaggtgaaggccatggaggtggacatagaggagaggcctaaagagcttgtacggaagccctatgtgctgaatgacctggaggcagaagccagccttccagaaaagaaaggaaatactctgtctcgggacctcattgactatgtacgctacatggtagagaaccacggggaggactataaggccatggccgtgatgagaagaattactatcaagataccccaaaacagattcggagtaagatcaacgtctataaacgcttttacccagcagagtggcaagacttcctcgattctttgcagaagaggaagatggaggtggagtgactggtttacatcacagctgccccaggctgaggcgtcccccggaccagtgaagctggagccagggtgtaaggcaaggaggtgctgtgtggctccagaggagctggccaggtcccatggaatcagaaggttacacgtgcacactccccgctctggggaaggaactgttctcagaggctccaatttatattcatctgggggttcacggaaaagccagaacctgctgttttcagggtgggtgatgtaaatatagtgtgtacataataaagcaaatatatttt

SEQ ID NO: 1418 - DNA, 1256 bp, Homo sapiens
acctatgggtaccaccgggttctcgcgggtcttgcgaacgaacttttccttgaaactctctggattcctgtaaacagtggggctcagcccctcaatgactggaggcttcgatggttcaaaggggacctccggaatcacagggccgggagtcgccatgtccgggccacagcagcaggagaaaatcgggactccgacctcagcctcccggtgaaggtcatgaaaggggcggggaaacgaataaattgagccttgtacgcaggcgcaaatgctcgttgcatcctgggagtcgtagtgctcagcacggtagtgctacaaaaggactacatttccccaaatgcccgcaaagccttgtgcacgccttccggaaggagtttgttacacgaggtctgagagacagaggcagcgtgtttgagctgctggtgcggtggtcagcgcgatgcccaaggccaagggcaaaacccggaggcagaagtttggttacagtgtcaaccgaaagcgtctgaaccggaatgctcgacggaaggcagcgccgcggatcgaatgctcccacatccgacatgcctgggaccacgctaaatcggtacggcagaacctggccgagatggggttggctgtggaccccaacagggcggtgcccctccgtaagagaaaggtgaaggccatggaggtggacatagaggagaggcctaaagagcttgtacggaagccctatgtgctgaatgacctggaggcagaagccagccttccagaaaagaaaggaaatactctgtctcgggacctcattgactatgtacgctacatggtagagaaccacggggaggactataaggccatggcccgtgatgagaagaattactatcaagataccccaaaacagattcggagtaagatcaacgtctataaacgcttttacccagcagagtggcaagacttcctcgattctttgcagaagaggaagatggaggtggagtgactggtttacatcacagctgccccaggctgaggcgtcccccggaccagtgaagctggagccagggtgtaaggcaaggaggtgctgtgtggctccagaggagctggccaggtcccatggaatcagaaggttacacacacgtgcacactccccgctctggggaaggaactgttctcagaggctccaatttatattcatctgggggttcacggaaaagccagaacctgctgttttcagggtgggtgatgtaaatatagtgtgtacataataaagcaaatatatttta

SEQ ID NO: 1419 - DNA, 763 bp, Homo sapiens
agtttgttacacgaggtctgagagacagaggcagcgtgtttgagctgctggtgcggtggtcagcgcgatgcccaaggccaagggcaaaacccggaggcagaagtttggttacagtgtcaaccgaaagcgtctgaaccggaatgctcgacggaaggcagcgccgcggatcgaatgctcccacatccgacatgcctgggaccacgctaaatcggtacggcagaacctggccgagatggggttggctgtggaccccaacagggcggtgcccctccgtaagagaaaggtgaaggccatggaggtggacatagaggagaggcctaaagagcttgtacggaagccctatgtgctgaatgacctggaggcagaagccagccttccagaaaagaaaggaaatactctgtctcgggacctcattgactatgtacgctacatggtagagaaccacggggaggactataagcagagtggcaagacttcctcgattctttgcagaagaggaagatggaggtggagtgactggtttacatcacagctgccccaggctgaggcgtcccccggaccagtgaagctggagccagggtgtaaggcaaggaggtgctgtgtggctccagaggagctggccaggtcccatggaatcagaaggttacaccacgtgcacactccccgctctggggaaggaactgttctcagaggctccaatttatattcatctgggggttcacggaaaagccagaacctgctgttttcagggtgggtgatgtaa

SEQ ID NO: 1420 - DNA, 952 bp, Homo sapiens
gtcatgaaaggggcggggaaacgaataaattgagccttgtacgcaggcgcaaatgctcgttgcatcctgggagtcgtagtgctcagcacggtagtgctacaaaaggactacatttccccaaatgcccgcaaagccttgtgcacgccttccggaaggagtttgttacacgaggtctgagagacagaggcagcgtgtttgagctgctggtgcggtggtcagcgcgatgcccaaggccaagggcaaaacccggaggcagaagtttggttacagtgtcaaccgaaagcgtctgaaccggaatgctcgacggaaggcagcgccgcggatcgaatgctcccacatccgacatgcctgggaccacgctaaatcggtacggcagaacctggccgagatggggttggctgtggaccccaacagggcggtgcccctccgtaagagaaaggtgaaggccatggaggtggacatagaggagaggcctaaagagcttgtacggaagccctatgtgctgaatgacctggaggcagaagccagccttccagaaaagaaaggaaatactctgtctcgggacctcattgactatgtacgctacatggtagagaaccacggggaggactataagagtggcaagacttcctcgattctttgcagaagaggaagatggaggtggagtgactggtttacatcacagctgccccaggctgaggcgtcccccggaccagtgaagctggagccagggtgtaaggcaaggaggtgctgtgtggctccagaggagctggccaggtcccatggaatcagaaggttacacacacgtgcacactccccgctctggggaaggaactgttctcagaggctccaatttatattcatctgggggttcacggaaaagccagaacctgctgttttcagggtgggtgatgtaaatatagtgtgtacataataaagcaaatatatttta

SEQ ID NO: 1421 - DNA, 2683 bp, Homo sapiens
agcgctacccgtgcgcctgcgtggaacgattctgtggcgagtgccggccgaaagctaggtccggattgcacgtggagggccgcccgaagggcactctcggacattaacccgcattctgtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctg

SEQ ID NO: 1422 - DNA, 2701 bp, Homo sapiens
gagtgccggccgaaagctaggtccggattgcacgtggagggccgcccgaagggcactctcggacattaacccgcattctggtgggtctagaggaaattgggggacgaagagtggcagcactgacctggtctgggacgtggggagaaggtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctg

SEQ ID NO: 1423 - DNA, 2613 bp, Homo sapiens
cacgcgcgacgccaccttctcccatttctgcctgccacagtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctggccactga

SEQ ID NO: 1424 - DNA, 3038 bp, Homo sapiens
aaagtgctgggattacaggcgtgagccactgcgcccagcctggaattccgtgatcttgacgctggactagggcagtggatgcgagggagagggctccaatgtcgggccctggttcgaggagaaggtgcggctttcacccaacagaaaccggccgtgaggctaaaagccaactccatgagggaaggtcggtcaagctcaatggtttcgtcacattgctccctccacccgccgcgggtgtaagctgcgcgtctccttcgaattgccccctactcgccgccgccggctccgctggcgttcccagggcgagcgtaagttccgggtgcggcggccgactaggcgcaacaggaagaggcggggccgcgaggctagcgctacccgtgcgcctgcgtggaacgattctgtggcgagtgccggccgaaagctaggtccggattgcacgtggagggccgcccgaagggcactctcggacattaacccgcattctgtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctg

SEQ ID NO: 1425 - DNA, 2736 bp, Homo sapiens
gccgaaagctaggtccggattgcacgtggagggccgcccgaagggcactctcggacattaacccgcattctgtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcggctggagtgcagtggctcggtcttggctcactgcaacctccacctcccgggttcaagcaattctcctgcctcagcttcccaagtagctgggatttacagttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctg

SEQ ID NO: 1426 - DNA, 2751 bp, Homo sapiens
gccggccgaaagctaggtccggattgcacgtggagggccgcccgaagggcactctcggacattaacccgcattctgtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacagacggtgtcttgctttgtcgctcaggctggactgcagtggtgcaatctcagctcattgcaacctccaccttccaggttcaagcgattcttgtgcctcagactcccaagtagctaggattacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctg

SEQ ID NO: 1427 - DNA, 2707 bp, Homo sapiens
ctctttctcctccacgtggggacgcaggatggcggcagcagtgccggtgggtgtgcgtggatgggggcggggggcgtcgccgcggggcgctagggcccgggtccctgaggcctgagagaggcgaagtggggcccttctgggcgggcgaccagactgactcccgccccacttgctcgcgcaggacgaggcggtggcgcgcgatgtgcagcggttgctagtgcagttccaggatgagggcgggcagctgctgggttccccgttcgacgtgcccgtggacatcaccccggacaggctgcagctcgtgtgcaacgcgctactggcccaggaggatcccctgccactggctttctttgtccacgatgctgagatcgtctcctcactggggaagacgttggagtcccaggcagtggagacagagaaggtcctagacatcatctaccagccacaggctatcttcagagtccgggctgtgactcgctgcaccagctccttggagggtcacagtgaggcagtcatttctgtggccttcagccctacgggaaagtacctggccagtggctctggagacaccaccgtgcgcttctgggatctcagcacagagacaccacatttcacatgcaagggacacagacactgggtccttagtatatcctggtctccagatggcaggaagctggcctcaggctgcaagaatggccagattctcctctgggacccaagcacagggaagcaggtgggcaggaccctcgctggccacagcaagtggatcacaggcctgagctgggagcccctccatgcgaaccctgagtgccgctatgtggccagcagctccaaggatggcagtgtgcggatctgggacacaactgcaggccgctgtgagcgcatcctcaccgggcacacccagtcggtcacctgtctccggtggggaggggacgggcttctctactctgcctcccaggaccgcaccatcaaagtctggagagctcatgacggtgtgctgtgccggactctgcaaggccacggccactgggtgaacaccatggccctcagcactgactatgccctgcgcactggggcctttgaacctgctgaggcctcagttaatccccaagacctccaaggatccttgcaggagttgaaggagagggctctgagccgatacaacctcgtgcggggccagggtccagagaggctggtgtctggctccgacgacttcaccttattcctgtggtccccagcagaggacaaaaagcctctcactcggatgacaggacaccaagctctcatcaaccaggtgctcttctctcctgactcccgcatcgtggctagtgcctcctttgacaagtccatcaagctgtgggatggcaggacgggcaagtacctggcttccctacgcggccacgtggctgccgtgtaccagattgcgtggtcagctgacagtcggctcctggtcagcggcagcagtgacagcacactgaaggtgtgggatgtgaaggcccagaagctggccatggacctgcccggccacgcggatgaggtatatgctgttgactggagtccagatggccagagagtggcaagtggtgggaaggacaaatgcctccggatatggaggagatgagacggcccgaagttctctctgacccccacctcgactcggcctctgccagctgccttccctgccagagaacaaaggctgagatggcagtgcacacaccctccccaccagtggggacctgagaatgcgtgtggcctgctgtcctcgatagaccggaatggggttttcccacagatccccgcctgtggcacaccccagagccagaaatcgaaggtcacaggaagttgtcactgaacttggcccgtgtctgctactctgtaccttgctggtacagacaggggtggtgggcagccaggctctatgagtgggcccctagtgtcagctctgtacagggtcagatcccaggttctatgaccaaataagtaacttaagttttgtgtgttgggttctaattccttgtcctagaatccccatgactcaatcaaggactgtgctaaatgagattgtccagcccccgcccttgcactggactacgccaaaaccacactgaccaggcacttgccttccctctcttcccccgtgttggtaagagagaggccagttgtgatagtggccaaggagaatctagggctgtattgttgtccactgcagtaggcaccggccacatgtgactgctggcatgaaatagaagtgcagttcctccatcgcactgggtaaggcctccagtattggacagcacacagaaaggttttcatcatcaagagagttctgctggtcagccctgctccaggggatgcctctgccttcgcatagcacactgcttgaggccctgccaggcaccaagcactgccctgggcccatgggatagagcggggaaggtgatggctcttccagaggattccctcagatggggaggcagcagtatgagctctgagcagaagtgggtattgttgatacagaggaagttctttgccacgagaactttcaagcagtgaaaggaattcccatcaggactcagaccccaggccgagatcttgccctgaatgtaccctgcctctgctttctcctgcatcccatgctaagcagggtcatggtctgaactactcagattggatttccaaaccatccttgtataaactgctcagaact

SEQ ID NO: 1428 - DNA, 1107 bp, Homo sapiens
gcagctccaaggatggcagtgtgcggatctgggacacaactgcaggccgctgtgagcgcatcctcaccgggcacacccagtcggtcacctgtctccggtggggaggggacgggcttctctactctgcctcccaggaccgcaccatcaaagtctggagagctcatgacggtgtgctgtgccggactctgcaaggccacggccactgggtgaacaccatggccctcagcactgactatgccctgcgcactggggcctttgaacctgctgaggcctcagttaatccccaagacctccaaggatccttgcaggagttgaaggagagggctctgagccgatacaacctcgtgcggggccagggtccagagaggctggtgtctggctccgacgacttcaccttattcctgtggtccccagcagaggacaaaaagcctctcactcggatgacaggacaccaagctctcatcaaccaggtgctcttctctcctgactcccgcatcgtggctagtgcctcctttgacaagtccatcaagctgtgggatggcaggacgggcaaagatgactttcactctgtcacctggtgttcaagtggctcgagtgcagcggcacgatcttggctcattacaacctctgcttcctgggttcaagtgattctcctgcctcagcctcccaggtacctggcttccctacgcggccacgtggctgccgtgtaccagattgcgtggtcagctgacagtcggctcctggtcagcggcagcagtgacagcacactgaaggtgtgggatgtgaaggcccagaagctggccatggacctgcccggccacgcggatgaggtatatgctgttgactggagtccagatggccagagagtggcaagtggtgggaaggacaaatgcctccggatatggaggagatgagacggcccgaagttctctctgacccccacctcgactcggcctctgccagctgccttccctgccagagaacaaaggctgagatggcagtgcacacaccctccccaccagtggggacctgagaatgcgtgtggcctgctgtcctcgatagaccggaatggggttttcccacagatccccgcctgtggcacacccc

SEQ ID NO: 1429 - DNA, 2576 bp, Homo sapiens
ctctttctcctccacgtggggacgcaggatggcggcagcagtgccggacgaggcggtggcgcgcgatgtgcagcggttgctagtgcagttccaggatgagggcgggcagctgctgggttccccgttcgacgtgcccgtggacatcaccccggacaggctgcagctcgtgtgcaacgcgctactggcccaggaggatcccctgccactggctttctttgtccacgatgctgagatcgtctcctcactggggaagacgttggagtcccaggcagtggagacagagaaggtcctagacatcatctaccagccacaggctatcttcagagtccgggctgtgactcgctgcaccagctccttggagggtcacagtgaggcagtcatttctgtggccttcagccctacgggaaagtacctggccagtggctctggagacaccaccgtgcgcttctgggatctcagcacagagacaccacatttcacatgcaagggacacagacactgggtccttagtatatcctggtctccagatggcaggaagctggcctcaggctgcaagaatggccagattctcctctgggacccaagcacagggaagcaggtgggcaggaccctcgctggccacagcaagtggatcacaggcctgagctgggagcccctccatgcgaaccctgagtgccgctatgtggccagcagctccaaggatggcagtgtgcggatctgggacacaactgcaggccgctgtgagcgcatcctcaccgggcacacccagtcggtcacctgtctccggtggggaggggacgggcttctctactctgcctcccaggaccgcaccatcaaagtctggagagctcatgacggtgtgctgtgccggactctgcaaggccacggccactgggtgaacaccatggccctcagcactgactatgccctgcgcactggggcctttgaacctgctgaggcctcagttaatccccaagacctccaaggatccttgcaggagttgaaggagagggctctgagccgatacaacctcgtgcggggccagggtccagagaggctggtgtctggctccgacgacttcaccttattcctgtggtccccagcagaggacaaaaagcctctcactcggatgacaggacaccaagctctcatcaaccaggtgctcttctctcctgactcccgcatcgtggctagtgcctcctttgacaagtccatcaagctgtgggatggcaggacgggcaagtacctggcttccctacgcggccacgtggctgccgtgtaccagattgcgtggtcagctgacagtcggctcctggtcagcggcagcagtgacagcacactgaaggtgtgggatgtgaaggcccagaagctggccatggacctgcccggccacgcggatgaggtatatgctgttgactggagtccagatggccagagagtggcaagtggtgggaaggacaaatgcctccggatatggaggagatgagacggcccgaagttctctctgacccccacctcgactcggcctctgccagctgccttccctgccagagaacaaaggctgagatggcagtgcacacaccctccccaccagtggggacctgagaatgcgtgtggcctgctgtcctcgatagaccggaatggggttttcccacagatccccgcctgtggcacaccccagagccagaaatcgaaggtcacaggaagttgtcactgaacttggcccgtgtctgctactctgtaccttgctggtacagacaggggtggtgggcagccaggctctatgagtgggcccctagtgtcagctctgtacagggtcagatcccaggttctatgaccaaataagtaacttaagttttgtgtgttgggttctaattccttgtcctagaatccccatgactcaatcaaggactgtgctaaatgagattgtccagcccccgcccttgcactggactacgccaaaaccacactgaccaggcacttgccttccctctcttcccccgtgttggtaagagagaggccagttgtgatagtggccaaggagaatctagggctgtattgttgtccactgcagtaggcaccggccacatgtgactgctggcatgaaatagaagtgcagttcctccatcgcactgggtaaggcctccagtattggacagcacacagaaaggttttcatcatcaagagagttctgctggtcagccctgctccaggggatgcctctgccttcgcatagcacactgcttgaggccctgccaggcaccaagcactgccctgggcccatgggatagagcggggaaggtgatggctcttccagaggattccctcagatggggaggcagcagtatgagctctgagcagaagtgggtattgttgatacagaggaagttctttgccacgagaactttcaagcagtgaaaggaattcccatcaggactcagaccccaggccgagatcttgccctgaatgtaccctgcctctgctttctcctgcatcccatgctaagcagggtcatggtctgaactactcagattggatttccaaaccatccttgtataaactgctcagaactagca

SEQ ID NO: 1430 - DNA, 1462 bp, Homo sapiens
acgtggggacgcaggatggcggcagcagtgccggacgaggcggtggcgcgcgatgtgcagcggttgctagtgcagttccaggatgagggcgggcagctgctgggttccccgttcgacgtgcccgtggacatcaccccggacaggctgcagctcgtgtgcaacgcgctactggcccaggaggatcccctgccactggctttctttgtccacgatgctgagatcgtctcctcactggggaagacgttggagtcccaggcagtggagacagagaaggtcctagacatcatctaccagccacaggctatcttcagagtccgggctgtgactcgctgcaccagctccttggagggtcacagtgaggcagtcatttctgtggccttcagccctacgggaaagtacctggccagtggctctggagacaccaccgtgcgcttctgggatctcagcacagagacaccacatttcacatgcaagggacacagacactgggtccttagtatatcctggtctccagatggcaggaagctggcctcaggctgcaagaatggccagattctcctctgggagcccctccatgcgaaccctgagtgccgctatgtggccagcagctccaaggatggcagtgtgcggatctgggacacaactgcaggccgctgtgagcgcatcctcaccgggcacacccagtcggtcacctgtctccggtggggaggggacgggcttctctactctgcctcccaggaccgcaccatcaaagtctggagagctcatgacggtgtgctgtgccggactctgcaaggccacggccactgggtgaacaccatggccctcagcactgactatgccctgcgcactggggcctttgaacctgctgaggcctcagttaatccccaagacctccaaggatccttgcaggagttgaaggagagggctctgagccgatacaacctcgtgcggggccagggtccagagaggctggtgtctggctccgacgacttcaccttattcctgtggtccccagcagaggacaaaaagcctctcactcggatgacaggacaccaagctctcatcaaccaggtgctcttctctcctgactcccgcatcgtggctagtgcctcctttgacaagtccatcaagctgtgggatggcaggacgggcaagtacctggcttccctacgcggccacgtggctgccgtgtaccagattgcgtggtcagctgacagtcggctcctggtcagcggcagcagtgacagcacactgaaggtgtgggatgtgaaggcccagaagctggccatggacctgcccggccacgcggatgaggtatatgctgttgactggagtccagatggccagagagtggcaagtggtgggaaggacaaatgcctccggatatggaggagatgagacggcccgaagttctctctgacccccacctcgactcggcctctgccagctgccttccctg

SEQ ID NO: 1431 - DNA, 5286 bp, Homo sapiens
ggacgcaggatggcggcagcagtgccggtgggtgtgcgtggatgggggcggggggcgtcgccgcggggcgctagggcccgggtccctgaggcctgagagaggcgaagtggggcccttctgggcgggcgaccagactgactcccgccccacttgctcgcgcaggacgaggcggtggcgcgcgatgtgcagcggttgctagtgcagttccaggatgagggcgggcagctgctgggttccccgttcgacgtgcccgtggacatcaccccggacaggctgcagctcgtgtgcaacgcgctactggcccaggaggatcccctgccactggctttctttgtccacgatgctgagatcgtctcctcactggggaagacgttggagtcccaggcagtggagacagagaaggtcctagacatcatctaccagccacaggctatcttcagagtccgggctgtgactcgctgcaccagctccttggagggtcacagtgaggcagtcatttctgtggccttcagccctacgggaaagtacctggccagtggctctggagacaccaccgtgcgcttctgggatctcagcacagagacaccacatttcacatgcaagggacacagacactgggtccttagtatatcctggtctccagatggcaggaagctggcctcaggctgcaagaatggccagattctcctctgggacccaagcacagggaagcaggtgggcaggaccctcgctggccacagcaagtggatcacaggcctgagctgggagcccctccatgcgaaccctgagtgccgctatgtggccagcagctccaaggatggcagtgtgcggatctgggacacaactgcaggccgctgtgagcgcatcctcaccgggcacacccagtcggtcacctgtctccggtggggaggggacgggcttctctactctgcctcccaggaccgcaccatcaaagtctggagagctcatgacggtgtgctgtgccggactctgcaaggccacggccactgggtgaacaccatggccctcagcactgactatgccctgcgcactggggcctttgaacctgctgaggcctcagttaatccccaagacctccaaggatccttgcaggagttgaaggagagggctctgagccgatacaacctcgtgcggggccagggtccagagaggctggtgtctggctccgacgacttcaccttattcctgtggtccccagcagaggacaaaaagcctctcactcggatgacaggacaccaagctctcatcaaccaggtgctcttctctcctgactcccgcatcgtggctagtgcctcctttgacaagtccatcaagctgtgggatggcaggacgggcaagtacctggcttccctacgcggccacgtggctgccgtgtaccagattgcgtggtcagctgacagtcggctcctggtcagcggcagcagtgacagcacactgaaggtgtgggatgtgaaggcccagaagctggccatggacctgcccggccacgcggatgaggtatatgctgttgactggagtccagatggccagagagtggcaagtggtgggaaggacaaatgcctccggatatggaggagatgagacggcccgaagttctctctgacccccacctcgactcggcctctgccagctgccttccctgccagagaacaaaggctgagatggcagtgcacacaccctccccaccagtggggacctgagaatgcgtgtggcctgctgtcctcgatagaccggaatggggttttcccacagatccccgcctgtggcacaccccagagccagaaatcgaaggtcacaggaagttgtcactgaacttggcccgtgtctgctactctgtaccttgctggtacagacaggggtggtgggcagccaggctctatgagtgggcccctagtgtcagctctgtacagggtcagatcccaggttctatgaccaaataagtaacttaagttttgtgtgttgggttctaattccttgtcctagaatccccatgactcaatcaaggactgtgctaaatgagattgtccagcccccgcccttgcactggactacgccaaaaccacactgaccaggcacttgccttccctctcttcccccgtgttggtaagagagaggccagttgtgatagtggccaaggagaatctagggctgtattgttgtccactgcagtaggcaccggccacatgtgactgctggcatgaaatagaagtgcagttcctccatcgcactgggtaaggcctccagtattggacagcacacagaaaggttttcatcatcaagagagttctgctggtcagccctgctccaggggatgcctctgccttcgcatagcacactgcttgaggccctgccaggcaccaagcactgccctgggcccatgggatagagcggggaaggtgatggctcttccagaggattccctcagatggggaggcagcagtatgagctctgagcagaagtgggtattgttgatacagaggaagttctttgccacgagaactttcaagcagtgaaaggaattcccatcaggactcagaccccaggccgagatcttgccctgaatgtaccctgcctctgctttctcctgcatcccatgctaagcagggtcatggtctgaactactcagattggatttccaaaccatccttgtataaactgctcagaactagcatcttgctccttcttaccctcctccacccttgtctgtgcttttgggttttgcgcgtcacctagctgtggtgcttggcctccaccttgcacatatctgcagtgaggctacataagaagcgaacaaaactatcagccactgagctccttggtgccagctgtttgtctgctgtgctctcagactgcaccaggcctggaaggttctcaagctccaaaacttttgatgaggaaacaacataagaaatgattagcccatgccctcacatctagtaagagaaagctgggattaaaccaggccctgccccaaagcttattgtgcactttgtaccacatccctccgtccagagctcaagctagtttgacagttcatgggccaccacgtctgtccatgacagctatttctgtatttttctggtgtaagagccttttagtcttagagcaccagtctccctgttcccctaccccgccccactggggaaggggtgatggcagcatcctattgcctagctgcctgttttctatctccccacccatgtagactctgtcctggtggaagctaggaggtgggtgccagccagcccatctgaggctgtctgcagcataaagcagactttagggtgctggatgacctgcagttctttaatgagggacctagacccagcccagatttggaggaggagggagtctagcagctgtgggcagtggctgagcctggcatggcctggcctgagatgcctccaggtgaatggggcccctatgtagccttggccccagcccaggggtggggtgcccataccactctgccagaccccgggcccgcagggtgctggtggtatggtaggtctcatggctctggtttctgagggcctggggttgaagctgaaagtaggtgaggggtgtcctggggccctcccccttaacagggaaataggtattccagatcctccagcctccgcatctcctccggcccgatggacacgatcttttgccggggttccttgcgccgcacggtgatctggatggggtagttctcaggaaagctgctgaagtcagtggccagggttgcaaactgaagtgaaacaagaaaacccttcagagttccttcccagatctgaacctggctctctctctgtctctatcaccccttttttttctgtctgctgactcagaccttaaacagccttatccaacctagccattgacgcaggaaacaggtgcaaagatgcatgactcaagcctgtacctcctcattatgggatatttccaaccaaagggctgtctgtactcaggcctctatacccccatacccctaccccatacccaggctgttcccttcttcgtccccctttagcctcttgtcttccctatttctttcaatgcccttgacttcccagcctactcacaatcatgggcactgaattgcagagtctaaaaaccaatggctttggaaggggaacattatagtgatgttgaaaaatacattcgtttgcattcctagtgggccccagagtggcttaatccttaaacctcccagaagcatgcattctggaattgatgcttcttgacccaggcagaaggaaagctagccagatgagtcatgtgggcataggggtgttcccaacctccaaagccctggttccctggctttggacttctctccacccccaaggcccctcttttcccagggctcactttgtagggcttgcaccacttccccaccccagctgtgttggctgcacggacactgaggcagtaacacgtgttaggctttagctccatcagcttgacagtagtgcccaaaatcttgttgaagatccatggacgattctttgcctcgggcaactcattctcctgtgtcttggccacctcctgtaacaggagctggtagaaactgaccggctgcttgcccaaggcgtaggtccaggaaatctaggggaagagagagccccgaggcttcctcagatatgtcctgtccttcctgtcccttcaccctcccaactggggtcaggacgtcccatgcccatcccctgctcctgctggggcccaggcaggtcagatggaaggtgcaaggtactgcagcactgagtgtggaacccctgccccgaagcatgtactactctcctgggcagccccacccactttagggtacaccctcattccatatttcttatacgccaggggtcctcaacccttgggccaccaactgatagcagtccatggcctgttaggaactggatagcacagcaggaggagattggtgggcgagcaagcgaagcttcatctgtatttacagctgctccccacggctcagggtaccacctgagctctgcctcctgtcagatcagcagaggcattagattcccataggcacgtgaaccctattgtgaattgtatgggagggatctaagttgaatgctccttatgagaatctaatgcctgatgatctgtcattgtctcccatcacccccaaatgggaccctctcgttgcaggaaaacaagctcagggctcccacagtttctacattatggtgagttgtataattatttcattatatattacaatgtaataataatagaaataaagtacacaataaatgt

SEQ ID NO: 1432 - DNA, 2749 bp, Homo sapiens
agctccgcctctgcaaggccccggggaaacgggcatcccttcttcagtgagcaaaggagaaagacggagcccggtggctgggtgtttcgcccaggatcaccagcgagctcagagtcctccccacgaccgccccagggtgggcatttttaaaagcggaggaagggagggaacacactctttggtgctgtgcccaccttgcctcgcacagagcgggcgctcacaggctttgggggccccgcccggaccgcagtggggagaggccgccccatgccccgccccgccaaatttaagagccttcgccgagcgccaggaggttcccagacaaccggtcttgctcgctgccttttgcagaatcttctcacttctcccgagctcccttccttgcgtccgtccgggcaacggccgcgtcatgcctagccccaggccgcgaggcagcccgccacccgctccctcgggctctcgggtccgacctccgcgctctggccgctctccggcgcccaggtcccctactggcccgaacacgccccgcgctcccggacgcttcgagtcccctttctcggtcgaggccatcctggcgaggcccgacccctgcgcgccggcggcctcccagccgtcgggctccgcctgcgtccacccggccttctggaccgctgcttccctgtgcgccaccgggggtctgccctgggcttgcccgacatcgtggctgcccgcctacctgagcgtaggtttttaccctgtgccagggccgcgcgtggctcccgtctgcggcctgctgggcttcggcgtcacagggttggagctggctcactgctcaggactctgggccttcccagactgggccccaacggaggacctacaggacactgagagacagcaaaagagagtccgaactatgtttaacttggagcagctggaagagttggagaaagtgtttgcaaaacagcacaatctggtggggaagaagagagcccagctggcagctcggctcaaacttacagagaaccaggtgagagtctggttccagaaccgcagggtcaagtatcagaagcagcaaaagctgagggcagcagttacatctgccgaggctgcctccctggatgagccttccagcagctccatcgccagtatccagagtgatgatgccgagtcaggagtggacggctgaagactgggacagaggccctagccaggctgcctggactagttcctcctgggggtacccactggagctccctgcctcacacctcaacgaaaagcctcctcaaccagaagaatctgagctgtcaagcagggacccccttttctatactgattcctggaaactggaataatgtaatgattggaggcacagactctggccttcagctatgtccttggccaacctatggaacttccgagccttttttctttatctgtataatgggtgcattcataacttagatcacccaggggtgagaagatgtctgtaaagcaataatgtgccatgcacagtgcaaagtgtgtggttactgttaaggcttgtaggcccctgagtagagaagaccaactggaaaaaaaaaagtttttttcttctgctgtcaccccacaacaatcaacacagaacacttctgtgaccaaacgtataggggtgtaccccacattccaacctccagttcagcaaattctgacatgatctacctgcaggtagtgtctgaccccacagattcagggctcattccacatggcagcccctcctttcttttttttttgagacagactgcagtggcgcgatcttggctcaccgccacctccgcctcccgggttcaagcgattctcctgcctcagcctcccgagcagctgggactataggcgcatgccaccatgcctggctaatttttatatttttagtagagacggggtttcatcatatggtcaggctggtcttgaactgctgaccttgtgatccacccacctcggcctcccaaagtgctgggattacatgtgtgagccaccacccggcccaaccctgccctttttgttttttatggagtcttaaggtctaccagtcatcagtcaactcattagcatatgaaaagacatcacttcagagattctagggattttaggagttctatgccaggaaatcgagatgaagaccaaatatatatttcataatatcacagctcccctcacctgggggagtaatacctgtaccagcaattaatattttcctggcctggctgtggagaaggaacctctttgaataagcatctgggcatagaagactcttcaccatcagaaggagttgagagcaaagaagagaaggtagactgtttagcccacttcacaaagtttcccaacgttttcttgttttgtctgaactgttaccattctcagaagaagctcaggcccagcagcaaagacaaggactcgctctgtcacccagactggagtgcagtggtgcaatcatagctcacggcagcctcaacctcctgggctctagtgatcctcccaccttagcctcctaagcagctgggactacaggcgcgtgacaccacgcctggctaatttttaacattttttgtagagacaacgtccacttgttgcccaggctggtcttgaattccaggcttcaagtggttctcctgccttggcctcccaaagccccatctttttatagaataatttgtgtatgccaaggctggcattttgtcataaactctgctgtgttttcacaggacagttataatttccccctttcatgactctg

SEQ ID NO: 1433 - DNA, 1129 bp, Homo sapiens
atgttttgttgcttaggatatgaatggctgagcggaggctgtaaaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataat

SEQ ID NO: 1434 - DNA, 1552 bp, Homo sapiens
acccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaa

SEQ ID NO: 1435 - DNA, 1547 bp, Homo sapiens
acccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaa

SEQ ID NO: 1436 - DNA, 1065 bp, Homo sapiens
atgttttgttgcttaggatatgaatggctgagcggaggctgtaaaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggtgcacttacaatttggtattacctgggagtgaaaagaaatattacagccatgcctaactgacttcttgaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgct

SEQ ID NO: 1437 - DNA, 699 bp, Homo sapiens
atgttttgttgcttaggatatgaatggctgagcggaggctgtaaaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggtgcacttacaatttggtattacctgggagtgaaaagaaatattacagccatgcctaa

SEQ ID NO: 1438 - DNA, 1129 bp, Homo sapiens; identical to SEQ ID NO: 1433

SEQ ID NO: 1439 - DNA, 2435 bp, Homo sapiens
ctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgaatggagaatggtgtgttgggaaacgccttggaaggtgtgcatgtggaagaggaagaaggagaaaaaacagaagatgaatctctggtagaaaataatgataacatagatgaggaagcaagggaagagttgagagaacaggtttatgacgccatgggagaaaaagaagaagccaaaaaaacagaagacaagtctttggcaaagcctgaaactgataaagaacaggacagtgaaatggagaagggtggaagagaagatatggatataagtaaatctgcagaggagccacaggaaaaagttgacttgactctagattggttaactgaaacctctgaagaggcaaaaggaggagcagcaccagaaggaccgaatgaagctgaggtcacttctgggaagccagaacaggaagtaccagatgctgaggaagaaaaatcagtttctggaactgatgtccaagaagagtgcagagaaaaaggaggtcaggagaagcagggagaggtaattgtgagcatagaggagaagccaaaagaagtttcagaagagcagcctgtggtgactctagaaaagcagggcactgcagtggaggtagaagcagagtctttagacccgacagtcaagccagtggatgtgggtggggacgagccagaggagaaggtagttacctctgaaaacgaggcaggaaaggcggttcttgaacaactggtaggtcaagaagtaccacctgctgaagagtcaccagaggtgacaacagaggctgcagaggcctcagctgtagaggctggatcagaagtctctgaaaagcctgggcaggaggctccagttctccctaaggatggtgcagtcaatggaccgtcagttgtaggagatcagactcctattgaaccacagacttctatagaaagactgacagaaacaaaagatggctcaggactagaggagaaggtcagggcaaagctggttcctagtcaggaggagactaagctgtctgtagaagagtctgaggcagctggagatggggttgataccaaggtagcccagggagctactgagaaatcacctgaagacaaagttcagatagctgctaatgaagagacacaagagagagaagaacagatgaaagagggtgaagaaactgaaggctcagaagaggatgataaagaaaatgataagaccgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagc

SEQ ID NO: 1440 - DNA, 3207 bp, Homo sapiens
gtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaggaagcaagggaagagttgagagaacaggtttatgacgccatgggagaaaaagaagaagccaaaaaaacagaagacaagtctttggcaaagcctgaaactgataaagaacaggacagtgaaatggagaagggtggaagagaagatatggatataagtaaatctgcagaggagccacaggaaaaagttgacttgactctagattggttaactgaaacctctgaagaggcaaaaggaggagcagcaccagaaggaccgaatgaagctgaggtcacttctgggaagccagaacaggaagtaccagatgctgaggaagaaaaatcagtttctggaactgatgtccaagaagagtgcagagaaaaaggaggtcaggagaagcagggagaggtaattgtgagcatagaggagaagccaaaagaagtttcagaagagcagcctgtggtgactctagaaaagcagggcactgcagtggaggtagaagcagagtctttagacccgacagtcaagccagtggatgtgggtggggacgagccagaggagaaggtagttacctctgaaaacgaggcaggaaaggcggttcttgaacaactggtaggtcaagaagtaccacctgctgaagagtcaccagaggtgacaacagaggctgcagaggcctcagctgtagaggctggatcagaagtctctgaaaagcctgggcaggaggctccagttctccctaaggatggtgcagtcaatggaccgtcagttgtaggagatcagactcctattgaaccacagacttctatagaaagactgacagaaacaaaagatggctcaggactagaggagaaggtcagggcaaagctggttcctagtcaggaggagactaagctgtctgtagaagagtctgaggcagctggagatggggttgataccaaggtagcccagggagctactgagaaatcacctgaagacaaagttcagatagctgctaatgaagagacacaagagagagaagaacagatgaaagagggtgaagaaactgaaggctcagaagaggatgataaagaaaatgataagaccgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaaggttgaggctttgatggtttttttcttaattattggctgaatctgccttggagcactgctggttttatatattagccaaaggttttgttctggccttctgtactgatctgtgttcctgatcctaattcctatctgtctaacgtggaggtgatcaagtgtggctgtaggcctttgttttccaatggtgctatattctgttttcaaacacttcactgaacccagctgtcttgcaaactttcagtggtgctgtccctggatgggggctacaaaaacaagaattggtgaagatcttgctcttcagtgctgaaaatggatgatggactttggctgtgagccaggcctaggatggttcttgtcctatatccacctagtcttcacctggggctataattctgtcctggaaaaagaactctgaaaacctgggtcaggggaatgattcctaaggaaaacggtctgcatttgagctctggtttgaaagtagccaaggggactgatggtggacactccagatgtggttggaagcatatgtggggaggctggctggttgagttttgttattttctgtatagaaaggttgagatatatcaacacttggaattgttacccatctgcagaattgacttctcaaataaagatgctaaaaatct

SEQ ID NO: 1441 - DNA, 1538 bp, Homo sapiens
tgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaaactgaaggctcagaagaggatgataaagaaaatgataagaccgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaa

SEQ ID NO: 1442 - DNA, 2645 bp, Homo sapiens
aatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagcaaccattaatctgctttctgtcactgaagatgggttgcattttgtagaatattatctaaatagaatcatacatctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaggaagcaagggaagagttgagagaacaggtttatgacgccatgggagaaaaagaagaagccaaaaaaacagaagacaagtctttggcaaagcctgaaactgataaagaacaggacagtgaaatggagaagggtggaagagaagatatggatataagtaaatctgcagaggagccacaggaaaaagttgacttgactctagattggttaactgaaacctctgaagaggcaaaaggaggagcagcaccagaaggaccgaatgaagctgaggtcacttctgggaagccagaacaggaagtaccagatgctgaggaagaaaaatcagtttctggaactgatgtccaagaagagtgcagagaaaaaggaggtcaggagaagcagggagaggtaattgtgagcatagaggagaagccaaaagaagtttcagaagagcagcctgtggtgactctagaaaagcagggcactgcagtggaggtagaagcagagtctttagacccgacagtcaagccagtggatgtgggtggggacgagccagaggagaaggtagttacctctgaaaacgaggcaggaaaggcggttcttgaacaactggtaggtcaagaagtaccacctgctgaagagtcaccagaggtgacaacagaggctgcagaggcctcagctgtagaggctggatcagaagtctctgaaaagcctgggcaggaggctccagttctccctaaggatggtgcagtcaatggaccgtcagttgtaggagatcagactcctattgaaccacagacttctatagaaagactgacagaaacaaaagatggctcaggactagaggagaaggtcagggcaaagctggttcctagtcaggaggagactaagctgtctgtagaagagtctgaggcagctggagatggggttgataccaaggtagcccagggagctactgagaaatcacctgaagacaaagttcagatagctgctaatgaagagacacaagagagagaagaacagatgaaagagggtgaagaaactgaaggctcagaagaggatgataaagaaaatgataagaccgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagc

SEQ ID NO: 1443 - DNA, 874 bp, Homo sapiens
agtcgggctagggagggaaacaatcccgcggagccatatggagagggcaggaggtgtctagatagtggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaaactgaaggctcagaagaggatgataaagaaaatgataagaccgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatggg

SEQ ID NO: 1444 - DNA, 2387 bp, Homo sapiens
aatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagaatggagaatggtgtgttgggaaacgccttggaaggtgtgcatgtggaagaggaagaaggagaaaaaacagaagatgaatctctggtagaaaataatgataacatagatgaggaagcaagggaagagttgagagaacaggtttatgacgccatgggagaaaaagaagaagccaaaaaaacagaagacaagtctttggcaaagcctgaaactgataaagaacaggacagtgaaatggagaagggtggaagagaagatatggatataagtaaatctgcagaggagccacaggaaaaagttgacttgactctagattggttaactgaaacctctgaagaggcaaaaggaggagcagcaccagaaggaccgaatgaagctgaggtcacttctgggaagccagaacaggaagtaccagatgctgaggaagaaaaatcagtttctggaactgatgtccaagaagagtgcagagaaaaaggaggtcaggagaagcagggagaggtaattgtgagcatagaggagaagccaaaagaagtttcagaagagcagcctgtggtgactctagaaaagcagggcactgcagtggaggtagaagcagagtctttagacccgacagtcaagccagtggatgtgggtggggacgagccagaggagaaggtagttacctctgaaaacgaggcaggaaaggcggttcttgaacaactggtaggtcaagaagtaccacctgctgaagagtcaccagaggtgacaacagaggctgcagaggcctcagctgtagaggctggatcagaagtctctgaaaagcctgggcaggaggctccagttctccctaaggatggtgcagtcaatggaccgtcagttgtaggagatcagactcctattgaaccacagacttctatagaaagactgacagaaacaaaagatggctcaggactagaggagaaggtcagggcaaagctggttcctagtcaggaggagactaagctgtctgtagaagagtctgaggcagctggagatggggttgataccaaggtagcccagggagctactgagaaatcacctgaagacaaagttcagatagctgctaatgaagagacacaagagagagaagaacagatgaaagagggtgaagaaactgaaggctcagaagaggatgataaagaaaatgataagaccgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaaggtt

SEQ ID NO: 1445 - DNA, 771 bp, Homo sapiens
atgaggtcttgctgtgttgtccaggctggtctgcagctcctggcctcaagtgatcctccttcttcagcttcccaaagtgctaggattacaggcgtgaaccaccgcactccgccaagggagatcaagagcaacaagacagttctgcacttggccgtgcaggctgccaaccccactctggttcagctgctgctggagctgccccggggagacctgcggacctttgtcaacatgaaggcccacgggaacacagccctccacatggcggctgccctgccccctgggccggcccaggaggccatcgtgcggcacctgttggcagctggggcggaccccacactgcgcaacctggagaatgagcagcccgttcacctgctgcggcccgggccgggccctgaggggctccggcagctgttgaagaggagccgtgtggcgccgccaggcctgtcctcttaggactcaaacccagaccctggactgattttccagtccccaccgtcctgcgggacagccagcgtatgctaatgttgcaaacccatgataatgtatgtggaatatcctgccattggggttttacattaaaaccccagaatggctgcagaggggtgaacaggccccaatatttggggtgctgtgatacccctcttctacccacaaggagccctcttgatgatttctgtgaaatcgaggccccttgattgtttctgtgaaacaccctgcacccctagtcctttccccactgagatctttcgggttctctcccctaactcagct

SEQ ID NO: 1446 - DNA, 1716 bp, Homo sapiens
atgtgggtgtgtttgagagggatcctagacagccaagccttctggcatgaaacgctgagaagatgggagtgtctgctggcagagatgaaagtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactggccaccctcccttcccagcacactcggagactgtgggttctggacctagcagcctgggctttccagactgggaccccaacacgcatgctgcctacactgacagcccctactcttgccctgcttctgctgccgaaaatttcctgcctcctgacttctacccaccctcggacccagggcagccgtgcccatttccccagggcatggaggctggaccctggagagtttctgcacccccttcaggacccccacagttccccgctgtggtccctggaccatcgctggaggtggcccgagctcacatgctggctttggggccacagcagctgctggcccaggatgaggagggggacacgctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttggctgtgcttaactctggggtccaggttgacctggaagccagagacttcgagggcctcaccccgctccacacggccatcctggcccttaacgttgctatgcgcccttccgacctctgtccccgggtgctgagcacacaggcccgagacaggctggattgtgtccacatgttgctgcaaatgggtgctaatcacaccagccaggagatcaagagcaacaagacagttctgcacttggccgtgcaggctgccaaccccactctggttcagctgctgctggagctgccccggggagacctgcggacctttgtcaacatgaaggcccacgggaacacagccctccacatggcggctgccctgccccctgggccggcccaggaggccatcgtgcggcacctgttggcagctggggcggaccccacactgcgcaacctggagaatgagcagcccgttcacctgctgcggcccgggccgggccctgaggggctccggcagctgttgaagaggagccgtgtggcgccgccaggcctgtcctcttaggactcaaacccagaccctggactgattttccagtccccaccgtcctgcgggacagccagcgtatgctaatgttgcaaacccatgataatgtatgtggaatatcctgccattggggttttacattaaaaccccagaatggctgcagaggggtgaacaggccccaatatttggggtgctgtgatacccctcttctacccacaaggagccctcttgatgatttctgtgaaatcgaggccccttgattgtttctgtgaaacaccctgcacccctagtcctttccccactgagatctttcgggttctctcccctaactcagct

SEQ ID NO: 1447 - DNA, 1834 bp, Homo sapiens
ttcgccggagcgcgacccggggactcccaggcctgtgggcgggccctgcccaggactgggcggtgccataacccctagtttaaaaactcgcgggtaccggacccaagatcggggacccggcggcggctccgcgggggaaacagcgaggctggcgcagcgccgaggccgcggccctgggggcccgcaatccacgccacggaatccccgagtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactggccaccctcccttcccagcacactcggagactgtgggttctggacctagcagcctgggctttccagactgggaccccaacacgcatgctgcctacactgacagcccctactcttgccctgcttctgctgccgaaaatttcctgcctcctgacttctacccaccctcggacccagggcagccgtgcccatttccccagggcatggaggctggaccctggagagtttctgcacccccttcaggacccccacagttccccgctgtggtccctggaccatcgctggaggtggcccgagctcacatgctggctttggggccacagcagctgctggcccaggatgaggagggggacacgctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttggctgtgcttaactctggggtccaggttgacctggaagccagagacttcgagggcctcaccccgctccacacggccatcctggcccttaacgttgctatgcgcccttccgacctctgtccccgggtgctgagcacacaggcccgagacaggctggattgtgtccacatgttgctgcaaatgggtgctaatcacaccagccaggagatcaagagcaacaagacagttctgcacttggccgtgcaggctgccaaccccactctggttcagctgctgctggagctgccccggggagacctgcggacctttgtcaacatgaaggcccacgggaacacagccctccacatggcggctgccctgccccctgggccggcccaggaggccatcgtgcggcacctgttggcagctggggcggaccccacactgcgcaacctggagaatgagcagcccgttcacctgctgcggcccgggccgggccctgaggggctccggcagctgttgaagaggagccgtgtggcgccgccaggcctgtcctcttaggactcaaacccagaccctggactgattttccagtccccaccgtcctgcgggacagccagcgtatgctaatgttgcaaacccatgataatgtatgtggaatatcctgccattggggttttacattaaaaccccagaatggctgcagaggggtgaacaggccccaatatttggggtgctgtgatacccctcttctacccacaaggagccctcttgatgatttctgtgaaatcgaggccccttgattgtttctgtgaaacaccctgcacccctagtcctttccccactgagatctttcgggttctctcccctaactcagct

SEQ ID NO: 1448 - DNA, 2392 bp, Homo sapiens
gcctcggggaagcggtcccggaacagcgacgccaggagcccttcatcctccacctcgccgagagccgctgctgtggccgtggctaccgatgggatagtcgccgcggtcgccatcttcccagcaacaacgtcacttcccttccggaccacaaggggcgctgactccgaacttaggacaggaagaaacaggcacatttccggtctctatgctttctcatccggccggcttgctttcccctgcggtcgtccagactattgggcgctagcgagacgaactattggtacggggctagagaggaaggctttgggattgccggggagcagcgagcgaccgacttccgtttccagttaccaaggcacgaggatccggtgttccaacccagggggaaaaatgcggcctttgactgaagaggagacccgtgtcatgtttgagaagatagcgaaatacattggggagaatcttcaactgctggtggaccggcccgatggcacctactgtttccgtctgcacaacgaccgggtgtactatgtgagtgagaagattatgaagctggccgccaatatttccggggacaagctggtgtcgctggggacctgctttggaaaattcactaaaacccacaagtttcggttgcacgtcacagctctggattaccttgcaccttatgccaagtataaagtttggataaagcctggtgcagagcagtccttcctgtatgggaaccatgtgttgaaatctggtctgggtcgaatcactgaaaatacttctcagtaccagggcgtggtggtgtactccatggcagacatccctttgggttttggggtggcagccaaatctacacaagactgcagaaaagtagaccccatggcgattgtggtatttcatcaagcagacattggggaatatgtgcggcatgaagagacgttgacttaaaacgaagccattccaaggacagacggctgtatggaaaggccgagctttgtttcctgtgtttgtgtggactccaccatcatgttgaattttgtcaacactctggcctcttcagggacttcttatttactgtactctctatcactgacaaatgcaggctggattcttattatatacagagatggctcaaaaatggggtttcagatctttgtgacgaaatagaatactgtttcatatttgaatcagagggcttcttgttctgagaaataggttcaaaatcattggaaccaggaacaagaatagcttattgttatctgtgataacactgttttctaaacacaaggattttcttttttattaatatgcaacatagacattgccataacagaataataaaccacatgtggggttttaaaaatgaaatttggctaataggagcaattcagctatttttctatacagtaattggtgtgtggtatagaagaaaaacgggttcaaaccccacttctgccacctaccagctatatggccttgaatgagtcattcagctttaataaggttcattttcttctgtttaaaaagacacaaaacttgaaaatcagctttggccatctacctgagaattagaaagtctgatttttggaattagaaatcatgattgtaggctgggcacagtggctcgcgcctgtaatcccagcactttgggaggccaaggcggacggatcacttgaggttaggagtttgagaccagcctggccaacatggtgaaaccccatctctactaaaaaaaaaaaaaaaattaggtgtggtgacacatggctgtggtcctagttacttgggaggctgaggcaggagaatggcttgaactggggaagcagagcttgcagtgagccaagatggtgccattgcactccagcctgggcgtgacagagtgagactccatctgattgtaaagcatctagtacagtgtacagtgccttggaaatgataggtatggaataaatggtaattatttttatattatatatattatgtattcctgttattaagtgtagagttttatgagtataatttgattttattaccttcttttttacaagctgttttctcagtatttttcttggatgggatgacgctaggctggaaagtttttttcatcactatgattttataaaacaattttttctatgaacctttacttacttgactggattggactaaaagcactgatcagaggccacgacataaaaattcagtccctttgtccttccccgtgcctcccaaagttactttaagatccttagaatatttctttaaatattttatagacaaaaaatttaaagactatctgtattgcaaaattaaactatttctttaatgaatatattgcttattttaagttccaaaggtgaagtctttaagaataaaacattaccaactcctgcttttatatgtaagcaaa

SEQ ID NO: 1449 - DNA, 1887 bp, Homo sapiens
acgaggatccggtgttccaacccagggggaaaaatgcggcctttgactgaagaggagacccgtgtcatgtttgagaagatagcgaaatacattggggagaatcttcaactgctggtggaccggcccgatggcacctactgtttccgtctgcacaacgaccgggtgtactatgtgagtgagaagattatgaagctggccgccaatatttccggggacaagctggtgtcgctggggacctgctttggaaaattcactaaaacccacaagtttcggttgcacgtcacagctctggattaccttgcaccttatgccaagggttttggggtggcagccaaatctacacaagactgcagaaaagtagaccccatggcgattgtggtatttcatcaagcagacattggggaatatgtgcggcatgaagagacgttgacttaaaacgaagccattccaaggacagacggctgtatggaaaggccgagctttgtttcctgtgtttgtgtggactccaccatcatgttgaattttgtcaacactctggcctcttcagggacttcttatttactgtactctctatcactgacaaatgcaggctggattcttattatatacagagatggctcaaaaatggggtttcagatctttgtgacgaaatagaatactgtttcatatttgaatcagagggcttcttgttctgagaaataggttcaaaatcattggaaccaggaacaagaatagcttattgttatctgtgataacactgttttctaaacacaaggattttcttttttattaatatgcaacatagacattgccataacagaataataaaccacatgtggggttttaaaaatgaaatttggctaataggagcaattcagctatttttctatacagtaattggtgtgtggtatagaagaaaaacgggttcaaaccccacttctgccacctaccagctatatggccttgaatgagtcattcagctttaataaggttcattttcttctgtttaaaaagacacaaaacttgaaaatcagctttggccatctacctgagaattagaaagtctgatttttggaattagaaatcatgattgtaggctgggcacagtggctcgcgcctgtaatcccagcactttgggaggccaaggcggacggatcacttgaggttaggagtttgagaccagcctggccaacatggtgaaaccccatctctactaaaaaaaaaaaaaaaattaggtgtggtgacacatggctgtggtcctagttacttgggaggctgaggcaggagaatggcttgaactggggaagcagagcttgcagtgagccaagatggtgccattgcactccagcctgggcgtgacagagtgagactccatctgattgtaaagcatctagtacagtgtacagtgccttggaaatgataggtatggaataaatggtaattatttttatattatatatattatgtattcctgttattaagtgtagagttttatgagtataatttgattttattaccttcttttttacaagctgttttctcagtatttttcttggatgggatgacgctaggctggaaagtttttttcatcactatgattttataaaacaattttttctatgaacctttacttacttgactggattggactaaaagcactgatcagaggccacgacataaaaattcagtccctttgtccttccccgtgcctcccaaagttactttaagatccttagaatatttctttaaatattttatagacaaaaaatttaaagactatctgtattgcaaaattaaactatttctttaatgaatatattgcttattttaagttccaaaggtgaagtctttaagaataaaacattaccaactcctgcttttatatgt

SEQ ID NO: 1450 - DNA, 873 bp, Homo sapiens
gactcagggaccgactcttcccgtctcatgactgtgtttactgggctggattttgggaaggggccagattgcatcagacagggcctgatgggctggagccagactgtggtctgaggaggagacacagccttataagctgagggagtggagaggcccggggccaggaaagcagagacagacaaagcgttaggagaagaagagaggcagggaagacaagccaggcacgatggccaccttcccaccagcaaccagcgccccccagcagcccccaggcccggaggacgaggactccagcctggatgaatctgacctctatagcctggcccattcctacctcggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcaatagagacgggactgcggaggaaggaggacccaggacaggatccaggccggcttgccacaccccccacccctaggacttattcccgctgactgagtctctgaggggctaccaggaaagcgcctccaaccctagcaaaagtgcaagatggggagtgagaggctgggaatggaggggcagagccaggaagatcccccagaaaagaaagctacagaagaaactggggctcctccagggtggcagcaacaataaatagacacgcacggcagccacagcttgggtgtgtgttcatccttgttctttgtgtgtttttgttcgggcatgtgtgtgcttgcctgtgcctgcacattcatga

SEQ ID NO: 1451 - DNA, 912 bp, Homo sapiens
ccagctgggtgagcctgggagggaggaggtgagttgggctggactcagggaccgactcttcccgtctcatgactgtgtttactgggctggattttgggaaggggccagattgcatcagacagggcctgatgggctggagccagactgtggtctgaggaggagacacagccttataagctgagggagtggagaggcccggggccaggaaagcagagacagacaaagcgttaggagaagaagagaggcagggaagacaagccaggcacgatggccaccttcccaccagcaaccagcgccccccagcagcccccaggcccggaggacgaggactccagcctggatgaatctgacctctatagcctggcccattcctacctcgggcctctcatcatgcctatgcccacttcacctctgactcctgccttggttacaggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcaatagagacgggactgcggaggaaggaggacccaggacaggatccaggccggcttgccacaccccccacccctaggacttattcccgctgactgagtctctgaggggctaccaggaaagcgcctccaaccctagcaaaagtgcaagatggggagtgagaggctgggaatggaggggcagagccaggaagatcccccagaaaagaaagctacagaagaaactggggctcctccagggtggcagcaacaataaatagacacgcacggcagccacagcttgggtgtgtgttcatccttgtt

SEQ ID NO: 1452 - DNA, 1276 bp, Homo sapiens
gggtcccaagatttggctccaagagctattcgcagagaaacagcctcgcacaaaaagccaccgcccccgaaacccgcgggaaatctgtttcctgtgaaaggcctggcctccgggcattggcggtttccctgatcctctctcccaaattttccggcaggggattgatcgaggcgacatttaggactggggtgggcgagggagtggcggttctcgtcccaagttacaggtgaggacgttcaggccaaggcgtagccaagatcgcgccgccctgtagcttgaggaggcgccgggattcgaaccaaggctgtgcccaatcctaagccctgcgaggtcttgtggaaccgacatgacccactctttggtttgtccagagacagtgagcagggtgagttcagtgctgaatcgcaacactcggcagtttggaaaaaaacatcttttcgaccaggatgaggagacatgttggaactcagaccagggcccctcccagtgggtgacgctggagtttccccagctcatccgtgtctcccagctgcagatccagtttcagggtggcttctccagtcgccggggctgcctggaaggttcacagggcactcaggctctccacaagattgtagatttctaccctgaggacaacaactcgcttcagactttccccataccagctgctgaagtggaccggctgaaggtgacgtttgaggatgccactgacttttttggccgtgtggtcatctaccacctgcgggtgcttggggagaaggtgtgagacctctaggggctgtctcctccaggaagccctccgggaagcacagcaaagtccctcattctgcacagaaggtttattggttcctcttgggaagggtcccctcccaccacctgtccagaagctgcctttgaagtcagttctgggtttccccagctctggctgaccattttgttccctgagtgtctgagtccccggcaggcggccttcactcagggtcagcgggcaccaggttgctctggaagagcttgaggatgtggttctcgatcacctgttgcactgagatggggcagggaaaaggtgggctgtgagcttgaatcgggagtggggtggaggcacaggccaacctgcgctctccccttaggggacaaacagggacccttgcagagacctgcattacagagcaaagctgggagaaccgaggactcaccccaggaacctcaacttcccctaagtttgtaaaaatgcacttttgtagcttttcagaattaatataaaaatatttcctaccaa

SEQ ID NO: 1453 - DNA, 3220 bp, Homo sapiens
cggccgccattgcctcgtgcccgcgccggtcggttggtggcgcctttgtcctacggcgggcaggtgggccgacgcggaggcggcagcggcgggcctgaggcgaaggagcggccgggagcccgccgcgctggtagcgatattaataaggcagcggaaagaagaaatatgaatacggctccatcaagacccagccccacacgaagggatccatatggctttggagacagtcgagattcaaggcgtgatcgatccccaattcgaggaagtccaaggagagagcccagggatggcagaaatggccgggatgcccgggacagcagagacattcgagacccccgagacttgcgggaccacagacatagtagagatttgcgggatcacagagacagcaggagtgtgcgcgacgttcgggacgtgagggatcttagagactttcgtgatctaagagactctagggattttcgagatcagcgagaccccatgtacgacagatacagagacatgagagactcccgagatcctatgtacaggagagaaggctcttatgaccgatacctacgaatggatgactattgcaggagaaaggatgactcttattttgaccgttacagagatagctttgatggacggggccctccaggcccagaaagtcagtctcgtgcaaaagagcgtttgaaacgtgaggaacggcgtagagaagagctttatcgtcaatattttgaggaaatccagagacgctttgatgccgaaaggcccgttgattgttctgtgattgtggtcaacaaacagacaaaagactatgctgagtctgtggggcggaaggtgcgagacctgggcatggtagtggacttgatcttccttaacacagaagtgtcactgtcacaagccttggaggatgttagcaggggaggttctccttttgctattgtcatcacccagcaacaccagattcaccgctcctgcacagtcaacatcatgtttggaaccccgcaagagcatcgcaacatgccccaagcagatgccatggtgctggtggccagaaattatgagcgttacaagaatgagtgccgggagaaggaacgtgaggagattgccagacaggcagccaagatggccgatgaagccatcctgcaggaaagagagagaggaggccctgaggagggagtgcgtgggggccaccctccagccatccagagcctcatcaacctgctggcagacaacaggtacctcactgctgaagagactgacaagatcatcaactacctgcgagagcggaaggagcggctgatgaggagcagcaccgactctctgcctggcccgatttcccgccaaccactcggggcgacctcgggtgcctcgctgaagacacagccaagctcccaaccgctccagagcggccaagtgctcccctctgctacacccactccatctgcaccccccacctcccagcaagagcttcaggccaaaatcctcagcctcttcaatagtggcacagtgacggccaatagcagctctgcatccccctcggttgctgccggaaacaccccaaaccagaatttttccacagcagcaaacagccagcctcaacaaagatcacaggcttctggcaatcagcctccaagcattttgggacagggaggatctgctcagaacatgggccccagacctggggctccttcccaagggctttttggccagccttccagtcgcctggcacctgctagcaacatgactagccagaggcctgtgtcttccacaggtatcaactttgacaatccaagtgtacagaaggctctggataccctgatccagagtggccctgctctctcccacctggttagccagaccacagcacagatggggcagccacaggcccccatgggatcttaccagaggcattactgaagctaaatctttcaactctccccagtcccctcatcccctggcctcctcccacttacttgttctaaatagagctgtttggaggatgttctctgcgctcccaggccggcatcgagtgtcatcaatttctaccacctgctctctcttctgcccaaggctgtgttgcttattccttacaaagtttatactgcatttggggctgtatctttttttgttttttgttttgtagaaaataaatatctccgggggcagtacaggtgtctgggcttgtatttgatggggtttctccggtccctgtttctactggatttggagccaggcccagctagccaagtttggaatggcatttgtcatgtcagtagccaccacctttgttcattgtgaacctaccaaggctttccagcttcatacacattgaccagagctcaagctcctgcctgcaactcctgcctagagttgaagaaaagcaaactggccttggcaggcacagtgtcatcataccctcaccccatatgtttggggtctgcttgaggattcataaatcagccactctggattgttgaggaatggccatggcagccacagaaaaaagaatttttctctctgagccaaggttgttttttgtttttttctcttttcttttttgttttcatttcattggaagatctccaatggactgaacagctccagtcagcagcagttaccacaaactgtgaatctgggccccaccactcttccctgttaaccagttctgtcagcatccccctctccagcagcacttccatgaagttggttctgagactctggccgtgaacacccgtttcttcagtgatttgttttgggcttttggctcaaaaccccaggctcttgtttttgtctagactcttattctgtttcctgagcagcaggaggtagggaccactttgatgtcagacttctggtagctggacatgttctcgagatgggtggctgttcgcgacttttgtaccagagtgaaattgttagaaggagggtttctggctgtggttctaaatggagccccaggaagctgccctctccccagggtttgtgctcagtagagccctgtggatcacagtcttgaggtcctctagcaggggtgagggagagcagcgacttcagctgagtccctgccagtggttaagcaaacaatggtttcaaaattcaaggtccccaaatggcagcattttatgttctgacctgtttgtgttatatagtggttttttttttcctctttggaactcttgtgttgttaataaaatgaaatgattactttttaattaaaatgaaaaaagtaaaa

SEQ ID NO: 1454 - DNA, 727 bp, Homo sapiens
cggccgccattgcctcgtgcccgcgccggtcggttggtggcgcctttgtcctacggcgggcaggtgggccgacgcggaggcggcagcggcgggcctgaggcgaaggagcggccgggagcccgccgcgctggtagcgggatccatatggctttggagacagtcgagattcaaggcgtgatcgatccccaattcgaggaagtccaaggagagagcccagggatggcagaaatggccgggatgcccgggacagcagagacattcgagacccccgagacttgcgggaccacagacatagtagagatttgcgggatcacagagacagcaggagtgtgcgcgacgttcgggacgtgagggatcttagagactttcgtgatctaagagactctagggattttcgagatcagcgagaccccatgtacgacagatacagagacatgagagactcccgagatcctatgtacaggagagaaggctcttatgaccgatacctacgaatggatgactattgcaggagaaaggatgactcttattttgaccgttacagagatagctttgatggacggggccctccaggcccagaaagtcagtctcgtgcaaaagagcgtttgaaacgtgaggaacggcgtagagaagagctttatcgtcaatattttgaggaaatccagagacgctttgatgccgaaaggcccgttgattgttctgtgattgtggtcaacaaacagacaaa

SEQ ID NO: 1455 - DNA, 1633 bp, Homo sapiens
tcacctcattgtctccccgacttatcctaatgcgaaattggattctgagcatttgtagcaaaatcgctgggatctggagaggaagactcagtccagaatcctcccagggccttgaaagtccatctctgacccaaaacaatccaaggaggtagaagacatcgtagaaggagtgaaagaagaaaagaagacttagaaacatagctcaaagtgaacactgcttctcttagtttcctggatttcttctggacatttcctcaagatgaaacttcagacactttggagttttttttgaagaccaccataaagaaagtgcatttcaattgaaaaatttggatgggatcaaaaatgaatctcattgaacattcccatttacctaccacagatgaattttctttttctgaaaatttatttggtgttttaacagaacaagtggcaggtcctctgggacagaacctggaagtggaaccatactcgcaatacagcaatgttcagtttccccaagttcaaccacagatttcctcgtcatcctattattccaacctgggtttctacccccagcagcctgaagagtggtactctcctggaatatatgaactcaggcgtatgccagctgagactctctaccagggagaaactgaggtagcagagatgcctgtaacaaagaagccccgcatgggcgcgtcagcagggaggatcaaaggggatgagctgtgtgttgtttgtggagacagagcctctggataccactataatgcactgacctgtgaggggtgtaaaggcttgttaactgaaattcagtgtaaatctaagcgactgagaaaaaatgtgaagcagcatgcagatcagaccgtgaatgaagacagtgaaggtcgtgacttgcgacaagtgacctcgacaacaaagtcatgcagggagaaaactgaactcaccccagatcaacagactcttctacattttattatggattcatataacaaacagaggatgcctcaggaaataacaaataaaattttaaaagaagaattcagtgcagaagaaaattttctcattttgacggaaatggcaaccaatcatgtacaggttcttgtagaattcacaaaaaagctaccaggatttcagactttggaccatgaagaccagattgctttgctgaaagggtctgcggttgaagctatgttccttcgttcagctgagattttcaataagaaacttccgtctgggcattctgacctattggaagaaagaattcgaaatagtggtatctctgatgaatatataacacctatgtttagtttttataaaagtattggggaactgaaaatgactcaagaggagtatgctctgcttacagcaattgttatcctgtctccagatagacaatacataaaggatagagaggcagtagagaagcttcaggagccacttcttgatgtgctacaaaagttgtgtaagattcaccagcctgaaaatcctcaacactttgcctgtctcctgggtcgcctgactgaattacggacattcaatcatcaccacgctgagatgctgatgtcatggagagtaaacgaccacaagtttaccccacttctctgtgaaatctgggacgtgcagtgatggggattacaggggaggggtc

SEQ ID NO: 1456 - DNA, 4386 bp, Homo sapiens
gtcacatggtcgcggctgccctccccgtcagccgccctcgccgccgcggtgcgctggctgcaggaagccgccgcgccgccgcttttgttgtcagggacccagcgaggagcgccgctcgccggccgccgccaccctctctcgctgcagcctgctgtgcgctgcacggcctggggcccgggagccccgcccgctctgcccatgagggggccccgcgaccaccgctgcttccagcccggggcggcgcggcgctgaggcggcggcggcggcgctgccccctctgcgggaagcgggcggccccggccgcctccgcgagggcaccatggaggtgaatgcaggaggtgtgattgcctatatcagttcttccagctcagcctcaagccctgcctcttgtcacagtgagggttctgagaatagtttccagtcctcctcctcttctgttccatcttctccaaatagctctaattctgataccaatggtaatcccaagaatggtgatctcgccaatattgaaggcatcttgaagaatgatcgaatagattgttctatgaaaacaagcaaatcgagtgcacctgggatgacaaaaagtcatagtggtgtgacaaaatttagtggcatggttctactgtgtaaagtctgtggggatgtggcgtcaggattccactatggagttcatgcttgcgaaggctgtaagggtttctttcggagaagtattcaacaaaacatccagtacaagaagtgcctgaagaatgaaaactgttctataatgagaatgaataggaacagatgtcagcaatgtcgcttcaaaaagtgtctgtctgttggaatgtcaagagatgctgttcggtttggtcgtattcctaagcgtgaaaaacagaggatgctaattgaaatgcaaagtgcaatgaagaccatgatgaacagccagttcagtggtcacttgcaaaatgacacattagtagaacatcatgaacagacagccttgccagcccaggaacagctgcgacccaagccccaactggagcaagaaaacatcaaaagctcttctcctccatcttctgattttgcaaaggaagaagtgattggcatggtgaccagagctcacaaggatacctttatgtataatcaagagcagcaagaaaactcagctgagagcatgcagccccagagaggagaacggattcccaagaacatggagcaatataatttaaatcatgatcattgcggcaatgggcttagcagccattttccctgtagtgagagccagcagcatctcaatggacagttcaaagggaggaatataatgcattacccaaatggtcatgccatttgtattgcaaatggacattgtatgaacttctccaatgcttatactcaaagagtatgtgatagagttccgatagatggattttctcagaatgagaacaagaatagttacctgtgcaacactggaggaagaatgcatctggtttgtccattgagtaagtctccatatgtggatcctcataaatcaggacatgaaatctgggaagaattttcgatgagcttcactccagcagtgaaagaagtggtggaatttgcaaagcgtattcctgggttcagagatctctctcagcatgaccaggtcaaccttttaaaggctgggacttttgaggttttaatggtacggttcgcatcattatttgatgcaaaggaacgtactgtcacctttttaagtggaaagaaatatagtgtggatgatttacactcaatgggagcaggggatctgctaaactctatgtttgaatttagtgagaagctaaatgccctccaacttagtgatgaagagatgagtttgtttacagctgttgtcctggtatctgcagatcgatctggaatagaaaacgtcaactctgtggaggctttgcaggaaactctcattcgtgcactaaggaccttaataatgaaaaaccatccaaatgaggcctctatttttacaaaactgcttctaaagttgccagatcttcgatctttaaacaacatgcactctgaggagctcttggcctttaaagttcacccttaaggcctttgtttatttaaacatgaactgatggtaactgtacattttgtgctaaaatgcatatttatatgtgtataccatatgtggagatagaaaagacctttaagacaataaaagattgtaggctatctctgtaatcatgcaatagctgttcggattgagaactcttcagccatgattagacgttgactgcatctccctgatagaccaatcagctgtgtcgcacttaaactggagaagttacactgaagtataatcacactgaatgttagactttttcatctgccaaaaccaaaaaccattttgatctccctgtggttatcaatataacgcacaatcacaagtgtatgaggacttagaaattaatcctttgtggtaggagttctgttgaatgatggaaatcttattactaccacaagactatttgatctggtaattggagacttcgggatttaggagatctccatgtctgtatttactctaccactgctaaagtgtgtggtcctgggtagtttacttgcttgcggaaaatgagaattgatggtgtccccaatgccccacctcacagagttactaaaaaatgtctgtaaagcatatttacctcttgggagataggcactatgtaaataaggtaaaatttctgttattacaattattcataataatattcttttcttatttctaagcctttctgggaaatcatttcagtccacaccaaccatattattcagggttcctgccatatgtgtggggtatcctactgatacacacgtattcaaagtttatgggtacaacaaagacatagtacatgtacataatatgtatgtgaatatagttaaatatatttcttcacaatattttaaactgtgaagaactttatcatacaggaaacttaaaacaagaggtgtcaaaagacccaaattaggtgcattttacttgtttatgatggcataaccattgctttaaaatgtttagacagtagaatattgaatttatgctctatttttgtttatttaagcaacacttaatgtaaaagtgcaacaggcaattgaatccaaatttcaacgacaaaaaaaaaaaacatgtattttagagttcatctttggcaaaatctttggttcagggtactagttgtttaaaagttgattcatattcttaccttgtgctgagaaaggttgcattgctgccccttatacacatgctgcagcttgatgttaaagaatttttattctttctgaagaactaattaatgtttaaagcaactgtttaatatgatggcatgtgtgtgtgtgcgtgcgtgtgtatgttctgagtccacttcttttttcctaaataacactacagggattttgtcatattagatttaatttataatttgaaaaatcatctagtgtgtgacctacaggcttagaaatggtatagtcaaagacattttatccacatttctaatagtggacttgattaagtagataagatcagcatctgtttatggtagtaggagaaatagccaaagttgaggattttatgtatgttttcctgtttacctggaaaatagcaattaattggattttttggtaaagattgccttctgtataatgtttggattatataaaattgcaaaaatgataacagcccgctttactgtactaagcctgttactttcatgacgtgtgagcagaatgccttattttgtaatcttgtttaacttgttgctactgggacttgatttactgtggcactagttaagtaagttaaaaaaaagttaaaccctctcattattaaagaggaaaggcgatggtgatgtctgtagtacaatataaaccataattgtgatttaccttaagtaggtataactcttatgggatatacagtatagtttttgtgaatctttacatgatagcattatctttttataattttttttcctaagataaacaaatgcatagttttcttctatgggtgatagaaacagctttttgaagtaatgaaaacctcaaaagatcatgttgattcttaatttttgccttttgcataagcctctttataacatgtatctttaaaacaattaagtctttaggaatgtgtaaccagaactatgttagtattgcttataaaactttagttaggttcaatatatacatatatacatctctatataggtatatagatttgcattttgtcttgtaaaattttatttgaataaattcttcctgtaggtaatgggaaacaaaattaatagttcatatgtcactcatagcatttctatatttgaaagtagcccaatataaaacttttgattctaaaattaaaccagcagcctattacaagca

SEQ ID NO: 1457 - DNA, 4375 bp, Homo sapiens
tcgccggccgccgccaccctctctcgctgcagcctgctgtgcgctgcacggcctggggcccgggagccccgcccgctctgcccatgagggggccccgcgaccaccgctgcttccagcccggggcggcgcggcgctgaggcggcggcggcggcgctgccccctctgcgggaagcgggcggccccggccgcctccgcgagggcaccatggaggtgaatgcaggaggtgtgattgcctatatcagttcttccagctcagcctcaagccctgcctcttgtcacagtgagggttctgagaatagtttccagtcctcctcctcttctgttccatcttctccaaatagctctaattctgataccaatggtaatcccaagaatggtgatctcgccaatattgaaggcatcttgaagaatgatcgaatagattgttctatgaaaacaagcaaatcgagtgcacctgggatgacaaaaagtcatagtggtgtgacaaaatttagtggcatggttctactgtgtaaagtctgtggggatgtggcgtcaggattccactatggagttcatgcttgcgaaggctgtaagggtttctttcggagaagtattcaacaaaacatccagtacaagaagtgcctgaagaatgaaaactgttctataatgagaatgaataggaacagatgtcagcaatgtcgcttcaaaaagtgtctgtctgttggaatgtcaagagatgctgttcggtttggtcgtattcctaagcgtgaaaaacagaggatgctaattgaaatgcaaagtgcaatgaagaccatgatgaacagccagttcagtggtcacttgcaaaatgacacattagtagaacatcatgaacagacagccttgccagcccaggaacagctgcgacccaagccccaactggagcaagaaaacatcaaaagctcttctcctccatcttctgattttgcaaaggaagaagtgattggcatggtgaccagagctcacaaggatacctttatgtataatcaagagcagcaagaaaactcagctgagagcatgcagccccagagaggagaacggattcccaagaacatggagcaatataatttaaatcatgatcattgcggcaatgggcttagcagccattttccctgtagtgagagccagcagcatctcaatggacagttcaaagggaggaatataatgcattacccaaatggtcatgccatttgtattgcaaatggacattgtatgaacttctccaatgcttatactcaaagagtatgtgatagagttccgatagatggattttctcagaatgagaacaagaatagttacctgtgcaacactggaggaagaatgcatctgtacagtgttcatattcagccaaaatttcaccaaaaacagcagtaccacaccatttccagtttaaaccatgaagtcctttgatagtgcttggtattttctactgacaggtttgtccattgagtaagtctccatatgtggatcctcataaatcaggacatgaaatctgggaagaattttcgatgagcttcactccagcagtgaaagaagtggtggaatttgcaaagcgtattcctgggttcagagatctctctcagcatgaccaggtcaaccttttaaaggctgggacttttgaggttttaatggtacggttcgcatcattatttgatgcaaaggaacgtactgtcacctttttaagtggaaagaaatatagtgtggatgatttacactcaatgggagcaggggatctgctaaactctatgtttgaatttagtgagaagctaaatgccctccaacttagtgatgaagagatgagtttgtttacagctgttgtcctggtatctgcagatcgatctggaatagaaaacgtcaactctgtggaggctttgcaggaaactctcattcgtgcactaaggaccttaataatgaaaaaccatccaaatgaggcctctatttttacaaaactgcttctaaagttgccagatcttcgatctttaaacaacatgcactctgaggagctcttggcctttaaagttcacccttaaggcctttgtttatttaaacatgaactgatggtaactgtacattttgtgctaaaatgcatatttatatgtgtataccatatgtggagatagaaaagacctttaagacaataaaagattgtaggctatctctgtaatcatgcaatagctgttcggattgagaactcttcagccatgattagacgttgactgcatctccctgatagaccaatcagctgtgtcgcacttaaactggagaagttacactgaagtataatcacactgaatgttagactttttcatctgccaaaaccaaaaaccattttgatctccctgtggttatcaatataacgcacaatcacaagtgtatgaggacttagaaattaatcctttgtggtaggagttctgttgaatgatggaaatcttattactaccacaagactatttgatctggtaattggagacttcgggatttaggagatctccatgtctgtatttactctaccactgctaaagtgtgtggtcctgggtagtttacttgcttgcggaaaatgagaattgatggtgtccccaatgccccacctcacagagttactaaaaaatgtctgtaaagcatatttacctcttgggagataggcactatgtaaataaggtaaaatttctgttattacaattattcataataatattcttttcttatttctaagcctttctgggaaatcatttcagtccacaccaaccatattattcagggttcctgccatatgtgtggggtatcctactgatacacacgtattcaaagtttatgggtacaacaaagacatagtacatgtacataatatgtatgtgaatatagttaaatatatttcttcacaatattttaaactgtgaagaactttatcatacaggaaacttaaaacaagaggtgtcaaaagacccaaattaggtgcattttacttgtttatgatggcataaccattgctttaaaatgtttagacagtagaatattgaatttatgctctatttttgtttatttaagcaacacttaatgtaaaagtgcaacaggcaattgaatccaaatttcaacgacaaaaaaaaaaaacatgtattttagagttcatctttggcaaaatctttggttcagggtactagttgtttaaaagttgattcatattcttaccttgtgctgagaaaggttgcattgctgccccttatacacatgctgcagcttgatgttaaagaatttttattctttctgaagaactaattaatgtttaaagcaactgtttaatatgatggcatgtgtgtgtgtgcgtgcgtgtgtatgttctgagtccacttcttttttcctaaataacactacagggattttgtcatattagatttaatttataatttgaaaaatcatctagtgtgtgacctacaggcttagaaatggtatagtcaaagacattttatccacatttctaatagtggacttgattaagtagataagatcagcatctgtttatggtagtaggagaaatagccaaagttgaggattttatgtatgttttcctgtttacctggaaaatagcaattaattggattttttggtaaagattgccttctgtataatgtttggattatataaaattgcaaaaatgataacagcccgctttactgtactaagcctgttactttcatgacgtgtgagcagaatgccttattttgtaatcttgtttaacttgttgctactgggacttgatttactgtggcactagttaagtaagttaaaaaaaagttaaaccctctcattattaaagaggaaaggcgatggtgatgtctgtagtacaatataaaccataattgtgatttaccttaagtaggtataactcttatgggatatacagtatagtttttgtgaatctttacatgatagcattatctttttataattttttttcctaagataaacaaatgcatagttttcttctatgggtgatagaaacagctttttgaagtaatgaaaacctcaaaagatcatgttgattcttaatttttgccttttgcataagcctctttataacatgtatctttaaaacaattaagtctttaggaatgtgtaaccagaactatgttagtattgcttataaaactttagttaggttcaatatatacatatatacatctctatataggtatatagatttgcattttgtcttgtaaaattttatttgaataaattcttcctgtaggtaatgggaaacaaaattaatagttcatatgtcactcatagcatttctatatttgaaagtagcccaatataaaacttttgattctaaaattaaaccagcagcctattacaa

SEQ ID NO: 1458 - DNA, 1877 bp, Homo sapiens
ggtgcgctggctgcaggaagccgccgcgccgccgcttttgttgtcagggacccagcgaggagcgccgctcggcggcggcggcggcgctgccccctctgcgggaagcgggcggccccggccgcctccgcgagggcaccatggaggtgaatgcaggaggtgtgattgcctatatcagttcttccagctcagcctcaagccctgcctcttgtcacagtgagggttctgagaatagtttccagtcctcctcctcttctgttccatcttctccaaatagctctaattctgataccaatggtaatcccaagaatggtgatctcgccaatattgaaggcatcttgaagaatgatcgaatagattgttctatgaaaacaagcaaatcgagtgcacctgggatgacaaaaagtcatagtggtgtgacaaaatttagtggcatggttctactgtgtaaagtctgtggggatgtggcgtcaggattccactatggagttcatgcttgcgaaggctgtaagggtttctttcggagaagtattcaacaaaacatccagtacaagaagtgcctgaagaatgaaaactgttctataatgagaatgaataggaacagatgtcagcaatgtcgcttcaaaaagtgtctgtctgttggaatgtcaagagatgctgttcggtttggtcgtattcctaagcgtgaaaaacagaggatgctaattgaaatgcaaagtgcaatgaagaccatgatgaacagccagttcagtggtcacttgcaaaatgacacattagtagaacatcatgaacagacagccttgccagcccaggaacagctgcgacccaagccccaactggagcaagaaaacatcaaaagctcttctcctccatcttctgattttgcaaaggaagaagtgattggcatggtgaccagagctcacaaggatacctttatgtataatcaagagcagcaagaaaactcagctgagagcatgcagccccagagaggagaacggattcccaagaacatggagcaatataatttaaatcatgatcattgcggcaatgggcttagcagccattttccctgtagtgagagccagcagcatctcaatggacagttcaaagggaggaatataatgcattacccaaatggtcatgccatttgtattgcaaatggacattgtatgaacttctccaatgcttatactcaaagagtatgtgatagagttccgatagatggattttctcagaatgagaacaagaatagttacctgtgcaacactggaggaagaatgcatctggtttgtccattgagtaagtctccatatgtggatcctcataaatcaggacatgaaatctgggaagaattttcgatgagcttcactccagcagtgaaagaagtggtggaatttgcaaagcgtattcctgggttcagagatctctctcagcatgaccaggtcaaccttttaaaggctgggacttttgaggttttaatggtacggttcgcatcattatttgatgcaaaggaacgtactgtcacctttttaagtggaaagaaatatagtgtggatgatttacactcaatgggagcaggggatctgctaaactctatgtttgaatttagtgagaagctaaatgccctccaacttagtgatgaagagatgagtttgtttacagctgttgtcctggtatctgcagatcgatctggaatagaaaacgtcaactctgtggaggctttgcaggaaactctcattcgtgcactaaggaccttaataatgaaaaaccatccaaatgaggcctctatttttacaaaactgcttctaaagttgccagatcttcgatctttaaacaacatgcactctgaggagctcttggcctttaaagttcacccttaa

SEQ ID NO: 1459 - DNA, 1630 bp, Homo sapiens
attttcagtggctgtgaataagctaagaatggtaatgcagtttcaggggttagaaaatccaattcaaattagtcctcactgcagctgtacgccgtcaggatttttcatggaaatgatgagtatgaagcccgcgaaaggtgttttaacagaacaagtggcaggtcctctgggacagaacctggaagtggaaccatactcgcaatacagcaatgttcagtttccccaagttcaaccacagatttcctcgtcatcctattattccaacctgggtttctacccccagcagcctgaagagtggtactctcctggaatatatgaactcaggcgtatgccagctgagactctctaccagggagaaactgaggtagcagagatgcctgtaacaaagaagccccgcatgggcgcgtcagcagggaggatcaaaggggatgagctgtgtgttgtttgtggagacagagcctctggataccactataatgcactgacctgtgaggggtgtaaaggtttcttcaggagaagcattaccaaaaacgctgtgtacaagtgtaaaaacgggggcaactgtgtgatggatatgtacatgcgaagaaagtgtcaagagtgtcgactaaggaaatgcaaagagatgggaatgttggctgaatgcttgttaactgaaattcagtgtaaatctaagcgactgagaaaaaatgtgaagcagcatgcagatcagaccgtgaatgaagacagtgaaggtcgtgacttgcgacaagtgacctcgacaacaaagtcatgcagggagaaaactgaactcaccccagatcaacagactcttctacattttattatggattcatataacaaacagaggatgcctcaggaaataacaaataaaattttaaaagaagaattcagtgcagaagaaaattttctcattttgacggaaatggcaaccaatcatgtacaggttcttgtagaattcacaaaaaagctaccaggatttcagactttggaccatgaagaccagattgctttgctgaaagggtctgcggttgaagctatgttccttcgttcagctgagattttcaataagaaacttccgtctgggcattctgacctattggaagaaagaattcgaaatagtggtatctctgatgaatatataacacctatgtttagtttttataaaagtattggggaactgaaaatgactcaagaggagtatgctctgcttacagcaattgttatcctgtctccagatagacaatacataaaggatagagaggcagtagagaagcttcaggagccacttcttgatgtgctacaaaagttgtgtaagattcaccagcctgaaaatcctcaacactttgcctgtctcctgggtcgcctgactgaattacggacattcaatcatcaccacgctgagatgctgatgtcatggagagtaaacgaccacaagtttaccccacttctctgtgaaatctgggacgtgcagtgatggggattacaggggaggggtctagctcctttttctctctcatattaatctgatgtataactttcctttatttcacttgtacccagtttcactcaagaaatcttgatgaatatttatgttgtaattacatgtgtaacttccacaactgtaaat

SEQ ID NO: 1460 - DNA, 1778 bp, Homo sapiens
tcacctcattgtctccccgacttatcctaatgcgaaattggattctgagcatttgtagcaaaatcgctgggatctggagaggaagactcagtccagaatcctcccagggccttgaaagtccatctctgacccaaaacaatccaaggaggtagaagacatcgtagaaggagtgaaagaagaaaagaagacttagaaacatagctcaaagtgaacactgcttctcttagtttcctggatttcttctggacatttcctcaagatgaaacttcagacactttggagttttttttgaagaccaccataaagaaagtgcatttcaattgaaaaatttggatgggatcaaaaatgaatctcattgaacattcccatttacctaccacagatgaattttctttttctgaaaatttatttggtgttttaacagaacaagtggcaggtcctctgggacagaacctggaagtggaaccatactcgcaatacagcaatgttcagtttccccaagttcaaccacagatttcctcgtcatcctattattccaacctgggtttctacccccagcagcctgaagagtggtactctcctggaatatatgaactcaggcgtatgccagctgagactctctaccagggagaaactgaggtagcagagatgcctgtaacaaagaagccccgcatgggcgcgtcagcagggaggatcaaaggggatgagctgtgtgttgtttgtggagacagagcctctggataccactataatgcactgacctgtgaggggtgtaaaggtttcttcaggagaagcattaccaaaaacgctgtgtacaagtgtaaaaacgggggcaactgtgtgatggatatgtacatgcgaagaaagtgtcaagagtgtcgactaaggaaatgcaaagagatgggaatgttggctgaatgtatgtatacaggcttgttaactgaaattcagtgtaaatctaagcgactgagaaaaaatgtgaagcagcatgcagatcagaccgtgaatgaagacagtgaaggtcgtgacttgcgacaagtgacctcgacaacaaagtcatgcagggagaaaactgaactcaccccagatcaacagactcttctacattttattatggattcatataacaaacagaggatgcctcaggaaataacaaataaaattttaaaagaagaattcagtgcagaagaaaattttctcattttgacggaaatggcaaccaatcatgtacaggttcttgtagaattcacaaaaaagctaccaggatttcagactttggaccatgaagaccagattgctttgctgaaagggtctgcggttgaagctatgttccttcgttcagctgagattttcaataagaaacttccgtctgggcattctgacctattggaagaaagaattcgaaatagtggtatctctgatgaatatataacacctatgtttagtttttataaaagtattggggaactgaaaatgactcaagaggagtatgctctgcttacagcaattgttatcctgtctccagatagacaatacataaaggatagagaggcagtagagaagcttcaggagccacttcttgatgtgctacaaaagttgtgtaagattcaccagcctgaaaatcctcaacactttgcctgtctcctgggtcgcctgactgaattacggacattcaatcatcaccacgctgagatgctgatgtcatggagagtaaacgaccacaagtttaccccacttctctgtgaaatctgggacgtgcagtgatggggattacaggg

SEQ ID NO: 1461 - DNA, 2884 bp, Homo sapiens
acattcctcattctggggctttgcggttttgtcttgggaatctcgaggctctcccaaggttcctttctatgtttatatcatttagcagggaaggattgttaatgactaatctgtgtccatgaggcacagagccaaggaagagatgctgctgctagcccagaaggccgcctgtgatcatgcacagtacactggaactctctcctcctcctcacctcattgtctccccgacttatcctaatgcgaaattggattctgagcatttgtagcaaaatcgctgggatctggagaggaagactcagtccagaatcctcccagggccttgaaagtccatctctgacccaaaacaatccaaggaggtagaagacatcgtagaaggagtgaaagaagaaaagaagacttagaaacatagctcaaagtgaacactgcttctcttagtttcctggatttcttctggacatttcctcaagatgaaacttcagacactttggagttttttttgaagaccaccataaagaaagtgcatttcaattgaaaaatttggatgggatcaaaaatgaatctcattgaacattcccatttacctaccacagatgaattttctttttctgaaaatttatttggtgttttaacagaacaagtggcaggtcctctgggacagaacctggaagtggaaccatactcgcaatacagcaatgttcagtttccccaagttcaaccacagatttcctcgtcatcctattattccaacctgggtttctacccccagcagcctgaagagtggtactctcctggaatatatgaactcaggcgtatgccagctgagactctctaccagggagaaactgaggtagcagagatgcctgtaacaaagaagccccgcatgggcgcgtcagcagggaggatcaaaggggatgagctgtgtgttgtttgtggagacagagcctctggataccactataatgcactgacctgtgaggggtgtaaaggtttcttcaggagaagcattaccaaaaacgctgtgtacaagtgtaaaaacgggggcaactgtgtgatggatatgtacatgcgaagaaagtgtcaagagtgtcgactaaggaaatgcaaagagatgggaatgttggctgaatgcttgttaactgaaattcagtgtaaatctaagcgactgagaaaaaatgtgaagcagcatgcagatcagaccgtgaatgaagacagtgaaggtcgtgacttgcgacaagtgacctcgacaacaaagtcatgcagggagaaaactgaactcaccccagatcaacagactcttctacattttattatggattcatataacaaacagaggatgcctcaggaaataacaaataaaattttaaaagaagaattcagtgcagaagaaaattttctcattttgacggaaatggcaaccaatcatgtacaggttcttgtagaattcacaaaaaagctaccaggatttcagactttggaccatgaagaccagattgctttgctgaaagggtctgcggttgaagctatgttccttcgttcagctgagattttcaataagaaacttccgtctgggcattctgacctattggaagaaagaattcgaaatagtggtatctctgatgaatatataacacctatgtttagtttttataaaagtattggggaactgaaaatgactcaagaggagtatgctctgcttacagcaattgttatcctgtctccagatagacaatacataaaggatagagaggcagtagagaagcttcaggagccacttcttgatgtgctacaaaagttgtgtaagattcaccagcctgaaaatcctcaacactttgcctgtctcctgggtcgcctgactgaattacggacattcaatcatcaccacgctgagatgctgatgtcatggagagtaaacgaccacaagtttaccccacttctctgtgaaatctgggacgtgcagtgatggggattacaggggaggggtctagctcctttttctctctcatattaatctgatgtataactttcctttatttcacttgtacccagtttcactcaagaaatcttgatgaatatttatgttgtaattacatgtgtaacttccacaactgtaaatattgggctagatagaacaactttctctacattgtgttttaaaaggctccagggaatcctgcattctaattggcaagccctgtttgcctaattaaattgattgttacttcaattctatctgttgaactagggaaaatctcattttgctcatcttaccatattgcatatattttattaaagagttgtattcaatcttggcaataaagcaaacataatggcaacaggattttctttgggaacaaaatttgataaatatacaaactcatttctttaaatgttgaaagacatcctattgaatctgagggggtaatttacagaaagatactgtctctcgcacttttgtcatctctggaaaagtcctggtgaatagtcattcatttgtaatagccctctgatcatttccttttctttgaagttcaaagagaatagcaaacagaaaagttaacaattttcacataaaatattccctcaagcaatcctttcccccatagttagtcttgaggcaggattcacaaattcagagtatgcagctaactgcagtgatgggaccttcgctttcctctcttaaaagtgaggaaatgattggcttcattgtatccaatcatctttctgttttgttttgcttttgaaaacattcctacagctgggagcacagctgctgtatacttcccccaaagcaggaattagttcatttccttccttcattgttacactgttgcattcttctccctattatcctttggtgaatacaataaaacaccttctataagta

SEQ ID NO: 1462 - DNA, 1489 bp, Homo sapiens
attttcagtggctgtgaataagctaagaatggtaatgcagtttcaggggttagaaaatccaattcaaattagtcctcactgcagctgtacgccgtcaggatttttcatggaaatgatgagtatgaagcccgcgaaaggtgttttaacagaacaagtggcaggtcctctgggacagaacctggaagtggaaccatactcgcaatacagcaatgttcagtttccccaagttcaaccacagatttcctcgtcatcctattattccaacctgggtttctacccccagcagcctgaagagtggtactctcctggaatatatgaactcaggcgtatgccagctgagactctctaccagggagaaactgaggtagcagagatgcctgtaacaaagaagccccgcatgggcgcgtcagcagggaggatcaaaggggatgagctgtgtgttgtttgtggagacagagcctctggataccactataatgcactgacctgtgaggggtgtaaaggtttcttcaggagaagcattaccaaaaacgctgtgtacaagtgtaaaaacgggggcaactgtgtgatggatatgtacatgcgaagaaagtgtcaagagtgtcgactaaggaaatgcaaagagatgggaatgttggctgaatgtatgtatacaggcttgttaactgaaattcagtgtaaatctaagcgactgagaaaaaatgtgaagcagcatgcagatcagaccgtgaatgaagacagtgaaggtcgtgacttgcgacaagtgacctcgacaacaaagtcatgcagggagaaaactgaactcaccccagatcaacagactcttctacattttattatggattcatataacaaacagaggatgcctcaggaaataacaaataaaattttaaaagaagaattcagtgcagaagaaaattttctcattttgacggaaatggcaaccaatcatgtacaggttcttgtagaattcacaaaaaagctaccaggatttcagactttggaccatgaagaccagattgctttgctgaaagggtctgcggttgaagctatgttccttcgttcagctgagattttcaataagaaacttccgtctgggcattctgacctattggaagaaagaattcgaaatagtggtatctctgatgaatatataacacctatgtttagtttttataaaagtattggggaactgaaaatgactcaagaggagtatgctctgcttacagcaattgttatcctgtctccagatagacaatacataaaggatagagaggcagtagagaagcttcaggagccacttcttgatgtgctacaaaagttgtgtaagattcaccagcctgaaaatcctcaacactttgcctgtctcctgggtcgcctgactgaattacggacattcaatcatcaccacgctgagatgctgatgtcatggagagtaaacgaccacaagtttaccccacttctctgtgaaatctgggacgtgcagtga

SEQ ID NO: 1463 - DNA, 1074 bp, Homo sapiens
atggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtatctcccacagtggggttccaggtagagtttttggagttgctctttcacttccatggaacactacgaaaactgcagctccaagagcctgagtatgtgctcttggctgccatggccctcttctctcctgctccctatcttacagaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctga

SEQ ID NO: 1464 - DNA, 1408 bp, Homo sapiens
ataaaacagacatctcttgttttccagatactacgggtcataatccctaactccaatcactggcaactcctgagatcagaggaaaaccagcaacagcgtgggagtttggggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtatctcccacagtggggttccaggtagagtttttggagttgctctttcacttccatggaacactacgaaaactgcagctccaagagcctgagtatgtgctcttggctgccatggccctcttctctcctgctccctatcttacagaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaaaatgctgggaccaaagattgggccgggttcaaagggagcccagtggttgcaatgaaagactaaagcaataa

SEQ ID NO: 1465 - DNA, 1076 bp, Homo sapiens
ggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgctccctatcttacagaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaa

SEQ ID NO: 1466 - DNA, 1322 bp, Homo sapiens
taactccaatcactggcaactcctgagatcagaggaaaaccagcaacagcgtgggagtttggggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtatctcccacagtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaaaatgctgggaccaaagattgggccgggttcaaagggagcccagtggt

SEQ ID NO: 1467 - DNA, 1473 bp, Homo sapiens
gtcatgctgggaaaacctcccacccaggcctttgccctgagtccagggtctgtgccctaaccccacagtcactgagagcaactggaggccacataaaacagacatctcttgttttccagatactacgggtcataatccctaactccaatcactggcaactcctgagatcagaggaaaaccagcaacagcgtgggagtttggggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaaaatgctgggaccaaagattgggccgggttcaaagggagcccagtggttgcaatgaaagactaaagcaataa

SEQ ID NO: 1468 - DNA, 1059 bp, Homo sapiens
gggagtttggggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagc

SEQ ID NO: 1469 - DNA, 1074 bp, Homo sapiens
gggagtttggggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgctccctatcttacagaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagc

SEQ ID NO: 1470 - DNA, 989 bp, Homo sapiens
ggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtatctcccacagtggggttccaggtagagtttttggagttgctctttcacttccatggaacactacgaaaactgcagctccaagagcctgagtatgtgctcttggctgccatggccctcttctctcctgctccctatcttacagaccgacctggagttacccagagagatgagattgatcagctgcaagaggagatggcactgactctgcaaagctacatcaagggccagcagcgaaggccccgggatcgctcacctggaacaccctggatacactggagtgggaaaatgctgggaccaaagattgggccgggttcaaagggagcccagtggttgcaatga

SEQ ID NO: 1471 - DNA, 1117 bp, Homo sapiens
ggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgctccctatcttacagaccgacctggagttacccagagagatgagattgatcagctgcaagaggagatggcactgactctgcaaagctacatcaagggccagcagcgaaggccccgggatcgctcacctggaacaccctggatacactggagtgggaaaatgctgggaccaaagattgggccgggttcaaagggagcccagtggttgcaatga

SEQ ID NO: 1472 - DNA, 973 bp, Homo sapiens
ggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcgctcacctggaacaccctggatacactggagtgggaaaatgctgggaccaaagattgggccgggttcaaagggagcccagtggttgcaatgaaagactaaagc

SEQ ID NO: 1473 - DNA, 1114 bp, Homo sapiens
ggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtatctcccacagtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcgctcacctggaacaccctggatacactggagtgggaaaatgctgggaccaaagattgggccgggttcaaagggagcccagtggttgcaatga

SEQ ID NO: 1474 - DNA, 914 bp, Homo sapiens
ggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacacctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaa

SEQ ID NO: 1475 - DNA, 774 bp, Homo sapiens
ggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacattccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaa

SEQ ID NO: 1476 - DNA, 944 bp, Homo sapiens
ggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaa

SEQ ID NO: 1477 - DNA, 985 bp, Homo sapiens
ggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcgctcacctggaacaccctggatacactggagtgggaaaatgctgggaccaaagattgggccgggttcaaagggagcccagtggttgcaatga

SEQ ID NO: 1478 - DNA, 1380 bp, Homo sapiens
taactccaatcactggcaactcctgagatcagaggaaaaccagcaacagcgtgggagtttggggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtatctcccacagtggggttccaggtagagtttttggagttgctctttcacttccatggaacactacgaaaactgcagctccaagagcctgagtatgtgctcttggctgccatggccctcttctctcctggtgagcacctcccaaagcccagagccttttgctgcaccacctctgcccaaatactcagctccttgagtccatccacccaggccttctagcctagctatcaaacctgcagactaggtctatcccagcctcagtccccggggcaccacgcaggcccacccctgccacccaacttgtccttcccagctccctatcttacagaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaaaatgctgggaccaaagattgggccgggttcaaagggagcccagtggt

SEQ ID NO: 1479 - DNA, 620 bp, Homo sapiens
ggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacacctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcgctcacctggaacaccctggatacactggagtgggaa

SEQ ID NO: 1480 - DNA, 634 bp, Homo sapiens
ggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacattccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaa

SEQ ID NO: 1481 - DNA, 977 bp, Homo sapiens
ggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgctccctatcttacagaccgacctggagttacccagagagatgagattgatcagctgcaagaggagatggcactgactctgcaaagctacatcaagggccagcagcgaaggccccgggatcgctcacctggaacaccctggatacactggagtgggaaaatgctgggaccaaagattgggccgggttcaaagggagcccagtggttgcaatga

SEQ ID NO: 1482 - DNA, 774 bp, Homo sapiens
ggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacacctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaa

SEQ ID NO: 1483 - DNA, 1061 bp, Homo sapiens
ggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaa

SEQ ID NO: 1484 - DNA, 480 bp, Homo sapiens
ggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacattccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcgctcacctggaacaccctggatacactggagtgggaa

SEQ ID NO: 1485 - DNA, 620 bp, Homo sapiens
ggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacattccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcgctcacctggaacaccctggatacactggagtgggaa

SEQ ID NO: 1486 - DNA, 891 bp, Homo sapiens
ggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacacctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaa

SEQ ID NO: 1487 - DNA, 861 bp, Homo sapiens
ggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcgctcacctggaacaccctggatacactggagtgggaaaatgctgggaccaaagattgggccgggttcaaagggagcccagtggttgcaatgaaagactaaagcaataa

SEQ ID NO: 1488 - DNA, 1093 bp, Homo sapiens
aaccccacagtcactgagagcaactggaggccacataaaacagacatctcttgttttccagatactacgggtcataatccctaactccaatcactggcaactcctgagatcagaggaaaaccagcaacagcgtgggagtttggggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtggtgagatggtgctagagcaatagggggcatgtgtcctcatggtacaggatgtggtcaggtgacctagaggctcctaatcctagtatctcccacagtggggttccaggtagagtttttggagttgctctttcacttccatggaacactacgaaaactgcagct

SEQ ID NO: 1489 - DNA, 2014 bp, Homo sapiens
ccaaacacagaaagctctctccgccgtgaatctcgatcccacatcccgtcggctttcttcaacctctcttcccggagcgccccccaatccacgagtggcagccgcgggactgtcgcgtcggcgcccgacgccggagtcagcagggcgcaaaagcgccggtagatcatggcaaccatagaagaaattgcacatcaaattattgaacaacagatgggagagattgttacagagcagcaaactgggcagaaaatccagattgtgacagcacttgatcataatacccaaggcaagcagttcattctgacaaatcacgacggctctactccaagcaaagtcattctggccaggcaagattccactccgggaaaagttttccttacaactccagatgcagcaggtgtcaaccagttattttttaccactcctgatctgtctgcacaacacctgcagctcctaacagataattctccagaccaaggaccaaataaggtttttgatctttgcgtagtatgtggagacaaagcatcaggacgtcattatggagcagtaacttgtgaaggctgcaaaggattttttaaaagaagcatccgaaaaaatttagtatattcatgtcgaggatcaaaggattgtattattaataagcaccaccgaaaccgctgtcaatactgcaggttacagagatgtattgcgtttggaatgaagcaagactctgtccaatgtgaaagaaaacccattgaagtatcacgagaaaaatcttccaactgtgccgcttcaacagaaaaaatctatatccgaaaggaccttcgtagcccattaactgcaactccaacttttgtaacagatagtgaaagtacaaggtcaacaggactgttagattcaggaatgttcatgaatattcatccatctggagtaaaaactgagtcagctgtgctgatgacatcagataaggctgaatcatgtcagggagatttaagtacattggccaatgtggttacatcattagcgaatcttggaaaaactaaagatctttctcaaaatagtaatgaaatgtctatgattgaaagcttaagcaatgatgatacctctttgtgtgaatttcaagaaatgcagaccaacggtgatgtttcaagggcatttgacactcttgcaaaagcattgaatcctggagagagcacagcctgccagagctcagtagcgggcatggaaggaagtgtacacctaatcactggagattcaagcataaattacaccgaaaaagaggggccacttctcagcgattcacatgtagctttcaggctcaccatgccttctcctatgcctgagtacctgaatgtgcactacattggggagtctgcctccagactgctgttcttatcaatgcactgggcactttcgattccttctttccaggctctagggcaagaaaacagcatatcactggtgaaagcttactggaatgaactttttactcttggtcttgcccagtgctggcaagtgatgaatgtagcaactatattagcaacatttgtcaattgtcttcacaatagtcttcaacaagatgccaaggtaattgcagccctcattcatttcacaagacgagcaatcactgatttataaatgcttaactatagaatggcttatgactacccaaaacagtgccccatcaacaaatggggaaaattgccttttgagctcaggaataatttataaattggggactaccttttagttctttagcatattctatttcttattgttttatataatttttaaatcatttgcttcctccttatgtttaacagcagaggggtaatcaccttaaaatgtcatcaaaaatagatctactagaaggcagcatcacattcccatcttacttatggactcctacccctggttcatgtcttatatgcctgtaatggttataaagcctaccttcaggaaagctatggttgactaattactaatggatgggttttaaacatgtccctctacaataaattaaaatctttattgt

SEQ ID NO: 1490 - DNA, 2479 bp, Homo sapiens
gtggactcacagagccgctgctcggccctccgatccctccaccccaccctgggaacgtcacgacctcctctcgccgcttctccccgttgctaatgcgcaggcgctggcgggatagcgcgccgccgagccgagaaagaggtcacgaactctgaccccccagaaatacccaaacacagaaagctctctccgccgtgaatctcgatcccacatcccgtcggctttcttcaacctctcttcccggagcgccccccaatccacgagtggcagccgcgggactgtcgcgtcggcgcccgacgccggagtcagcagggcgcaaaagcgccggtagatcatggcaaccatagaagaaattgcacatcaaattattgaacaacagatgggagagattgttacagagcagcaaactgggcagaaaatccagattgtgacagcacttgatcataatacccaaggcaagcagttcattctgacaaatcacgacggctctactccaagcaaagtcattctggccaggcaagattccactccgggaaaagttttccttacaactccagatgcagcaggtgtcaaccagttattttttaccactcctgatctgtctgcacaacacctgcagctcctaacagataattctccagaccaaggaccaaataaggtttttgatctttgcgtagtatgtggagacaaagcatcaggacgtcattatggagcagtaacttgtgaaggctgcaaaggattttttaaaagaagcatccgaaaaaatttagtatattcatgtcgaggatcaaaggattgtattattaataagcaccaccgaaaccgctgtcaatactgcaggttacagagatgtattgcgtttggaatgaagcaagactctgtccaatgtgaaagaaaacccattgaagtatcacgagaaaaatcttccaactgtgccgcttcaacagaaaaaatctatatccgaaaggaccttcgtagcccattaactgcaactccaacttttgtaacagatagtgaaagtacaaggtcaacaggactgttagattcaggaatgttcatgaatattcatccatctggagtaaaaactgagtcagctgtgctgatgacatcagataaggctgaatcatgtcagggagatttaagtacattggccaatgtggttacatcattagcgaatcttggaaaaactaaagatctttctcaaaatagtaatgaaatgtctatgattgaaagcttaagcaatgatgatacctctttgtgtgaatttcaagaaatgcagaccaacggtgatgtttcaagggcatttgacactcttgcaaaagcattgaatcctggagagagcacagcctgccagagctcagtagcgggcatggaaggaagtgtacacctaatcactggagattcaagcataaattacaccgaaaaagaggggccacttctcagcgattcacatgtagctttcaggctcaccatgccttctcctatgcctgagtacctgaatgtgcactacattggggagtctgcctccagactgctgttcttatcaatgcactgggcactttcgattccttctttccaggctctagggcaagaaaacagcatatcactggtgaaagcttactggaatgaactttttactcttggtcttgcccagtgctggcaagtgatgaatgtagcaactatattagcaacatttgtcaattgtcttcacaatagtcttcaacaagataaaatgtcaacagaaagaagaaaattattgatggagcacatcttcaaactacaggagttttgtaacagcatggttaaactctgcattgatggatacgaatatgcctacctgaaggcaatagtactcttcagtccagatcatccaagcctagaaaacatggaacagatagagaaatttcaggaaaaggcttatgtggaattccaagattatataaccaaaacatatccagatgacacctacaggttatccagactactactcagattgccagctttaagactgatgaatgctaccatcactgaagaattgtttttcaaaggtctcattggcaatatacgaattgacagtgttatcccacatattttgaaaatggagcctgcagattataactctcaaataattggtcacagcatttgaaaactgtgactgcagtgctgtaaacttaactgttctttgccagaacacaagacaccaaattgaactcactgcttttgaggcatctggaaatttttactttaaaaagtaaccagaatccaaggtatttttattttagcttcccttaagaatttttgaagtgactgggcaggcagcagaaattaaatgaatttttcttcctgattcctttaaatgaatatgaaacactacaaatttattcttggtgaagatgatacctgaagctgtcacctcttgattatctaaactaagcgctcattctattttataaaacaaataaattagtctcttttttctgaa

SEQ ID NO: 1491 - DNA, 1822 bp, Homo sapiens
cgagccgagaaagaggtcacgaactctgaccccccagaaatacccaaacacagaaagctctctccgccgtgaatctcgatcccacatcccgtcggctttcttcaacctctcttcccggagcgccccccaatccacgagtggcagccgcgggactgtcgcgtcggcgcccgacgccggagtcagcagggcgcaaaagcgccggtagatcatggcaaccatagaagaaattgcacatcaaattattgaacaacagatgggagagattgttacagagcagcaaactgggcagaaaatccagattgtgacagcacttgatcataatacccaaggcaagcagttcattctgacaaatcacgacggctctactccaagcaaagtcattctggccaggcaagattccactccgggaaaagttttccttacaactccagatgcagcaggtgtcaaccagttattttttaccactcctgatctgtctgcacaacacctgcagctcctaacagataattctccagaccaaggaccaaataaggtttttgatctttgcgtagtatgtggagacaaagcatcaggacgtcattatggagcagtaacttgtgaaggctgcaaaggattttttaaaagaagcatccgaaaaaatttagtatattcatgtcgaggatcaaaggattgtattattaataagcaccaccgaaaccgctgtcaatactgcaggttacagagatgtattgcgtttggaatgaagcaagactctgtccaatgtgaaagaaaacccattgaagtatcacgagaaaaatcttccaactgtgccgcttcaacagaaaaaatctatatccgaaaggaccttcgtagcccattaactgcaactccaacttttgtaacagatagtgaaagtacaaggtcaacaggactgttagattcaggaatgttcatgaatattcatccatctggagtaaaaactgagtcagctgtgctgatgacatcagataaggctgaatcatgtcagggagatttaagtacattggccaatgtggttacatcattagcgaatcttggaaaaactaaagatctttctcaaaatagtaatgaaatgtctatgattgaaagcttaagcaatgatgatacctctttgtgtgaatttcaagaaatgcagaccaacggtgatgtttcaagggcatttgacactcttgcaaaagcattgaatcctggagagagcacagcctgccagagctcagtagcgggcatggaaggaagtgtacacctaatcactggagattcaagcataaattacaccgaaaaagaggggccacttctcagcgattcacatgtagctttcaggctcaccatgccttctcctatgcctgagtacctgaatgtgcactacattggggagtctgcctccagactgctgttcttatcaatgcactgggcactttcgattccttctttccaggctctagggcaagaaaacagcatatcactggtgaaagcttactggaatgaactttttactcttggtcttgcccagtgctggcaagtgatgaatgtagcaactatattagcaacatttgtcaattgtcttcacaatagtcttcaacaagcagaggggtaatcaccttaaaatgtcatcaaaaatagatctactagaaggcagcatcacattcccatcttacttatggactcctacccctggttcatgtcttatatgcctgtaatggttataaagcctaccttcaggaaagctatggttgactaattactaatggatgggttttaaacatgtccctctacaataaattaaaatctttattgtaaaacttta

SEQ ID NO: 1492 - DNA, 433 bp, Homo sapiens
gggagagccgcgcgcagcgccggggcttccagggcgcacggctaacgccggcacgagtgagacgtgggagaggccgaccctcggctagtggccgcaagtcccggcctgcatcccgtcactaactcccgtgctttcacgggacggacagaatgactccccccactttcacttttctctcacggcaaatctggccagggtcgtcgctgcctgtgggcctggatcttttcagaagaaatggaacggccccagggttctcactgcagggggcatgtccaagcttccgatagatagctcttttgttaagaaataattcttccaactcgggcagataccatttttgtgcagtacgaatgttgccaggttgtcccataatcttcagtagatcatggcaaccatagaagaaattgcacatcaaattattgaacaacagatg

SEQ ID NO: 1493 - DNA, 1991 bp, Homo sapiens
cagcagcagagttaagtagtattgctttaattgcaacaagctgagctaatgtgggaagaatgcagtagagtggcacagaagaatgctaacccgaaactctaagcctgttccctggaatcttccatctggatggaggagagaaagttgacctggagtgaggttcaatgtaaggacaagatctgcacccggagaagctctctctcggagagcacaggcggcctgaggagtcaaaacaggtggcctgtggagtcagcacaggcagcctggaggaggtgaggaactgaagtttggacagattgagtcactttctcagggacacatggctggccggtgatggagaaggcgtgagcccctcgctccagtgccgcgtgtgcggagacagcagcagcgggaagcactatggcatctatgcctgcaacggctgcagcggcttcttcaagaggagcgtacggcggaggctcatctacaggtgccaggtgggggcagggatgtgccccgtggacaaggcccaccgcaaccagtgccaggcctgccggctgaagaagtgcctgcaggcggggatgaaccaggacgccgtgcagaacgagcgccagccgcgaagcacagcccaggtccacctggacagcatggagtccaacactgagtcccggccggagtccctggtggctcccccggccccggcagggcgcagcccacggggccccacacccatgtctgcagccagagccctgggccaccacttcatggccagccttataacagctgaaacctgtgctaagctggagccagaggatgctgatgagaatattgatgtcaccagcaatgaccctgagttcccctcctctccatactcctcttcctccccctgcggcctggacagcatccatgagacctcggctcgcctactcttcatggccgtcaagtgggccaagaacctgcctgtgttctccagcctgcccttccgggatcaggtgatcctgctggaagaggcgtggagtgaactctttctcctcggggccatccagtggtctctgcctctggacagctgtcctctgctggcaccgcccgaggcctctgctgccggtggtgcccagggccggctcacgctggccagcatggagacgcgtgtcctgcaggaaactatctctcggttccgggcattggcggtggaccccacggagtttgcctgcatgaaggccttggtcctcttcaagccagagacgcggggcctgaaggatcctgagcacgtagaggccttgcaggaccagtcccaagtgatgctgagccagcacagcaaggcccaccaccccagccagcccgtgaggtttgggaaattgctcctgctcctcccgtctttgaggtttatcactgcggaacgcatcgagctcctctttttccgcaagaccatagggaatactccaatggagaagctcctttgtgatatgttcaaaaactagtgggggtggaggtgaaatgtttccaagcactctggaaaacaatctactgaaacgaaacatttgcctactctttgccccagcaattcctcgtaggtgtgtgtacccagcagaaatgcccaccgaaagatattgtaagaatattcatagcagctttattcataatagccccaaactgtatattgatggtaggatgaattaacaagttgtggtatattcatataatgaaaaataatttaaaaagaatgaattacggatacatgtggcaacacaggtaaacttcacagacataaaagttgaatgaaagaagccaggccgaagttccatttatgcagagttcaggaacaggcaagactaattgacaataatagaagttggaatagtggttacttctgggtggtgggggattgatacagagggggctcatgggagccctctggtgtaccagaaatgttgattttgatctgggcagtggtttcacaaatgtattcatacgtaataattcattgagctgtgcactttattttgttagacctc

SEQ ID NO: 1494 - DNA, 2102 bp, Homo sapiens
agaaatctcctcaagccagagcctgtgctgtgaggggcttcgggaccttggggcagctcctgagttcagacagagttcaggaagggagacaggggcacagagagacagaggttcatggactgaggcaaaggctgggccaggctcagcaacccaggcctcccgcaggcaggcagaggctgccctgtaacccatggagaccagaccaacagctctgatgagctccacagtggctgcagctgcgcctgcagctggggctgcctccaggaaggagtctccaggcagatggggcctgggggaggatcccacaggcgtgagcccctcgctccagtgccgcgtgtgcggagacagcagcagcgggaagcactatggcatctatgcctgcaacggctgcagcggcttcttcaagaggagcgtacggcggaggctcatctacaggtgccaggtgggggcagggatgtgccccgtggacaaggcccaccgcaaccagtgccaggcctgccggctgaagaagtgcctgcaggcggggatgaaccaggacgccgtgcagaacgagcgccagccgcgaagcacagcccaggtccacctggacagcatggagtccaacactgagtcccggccggagtccctggtggctcccccggccccggcagggcgcagcccacggggccccacacccatgtctgcagccagagccctgggccaccacttcatggccagccttataacagctgaaacctgtgctaagctggagccagaggatgctgatgagaatattgatgtcaccagcaatgaccctgagttcccctcctctccatactcctcttcctccccctgcggcctggacagcatccatgagacctcggctcgcctactcttcatggccgtcaagtgggccaagaacctgcctgtgttctccagcctgcccttccgggatcaggtgatcctgctggaagaggcgtggagtgaactctttctcctcggggccatccagtggtctctgcctctggacagctgtcctctgctggcaccgcccgaggcctctgctgccggtggtgcccagggccggctcacgctggccagcatggagacgcgtgtcctgcaggaaactatctctcggttccgggcattggcggtggaccccacggagtttgcctgcatgaaggccttggtcctcttcaagccagagacgcggggcctgaaggatcctgagcacgtagaggccttgcaggaccagtcccaagtgatgctgagccagcacagcaaggcccaccaccccagccagcccgtgaggtgacctgagcatgcgcccacccactcatctgtccctgacctctaacctttctctgcctctcccacactctcccagagctcactgattagacagcacaagggtctcagttcaacagcatacagccaacatctatggtgtcccaggcacagtgccaggccccgggagtggggaccaagatgtacataagacaaagctactgccttctagagacaaccggcagtgacctcactgaagacaaaaactgccctagccaggtactgagggttgcatgaatctgcaggagacagagatccccttgcatgggaaacataaagcagaattgggagggactttgtggagacagggctggacttgaaaggaagaagaagtctaaaagaaaacatcatttgcaaagggagagaggggcaagcatgatatgttgttagaacaggagcccactttgaaggtataacaggttcctgccagtgagaaatggggagaataagccagaaaagtaccctaggaccagcccgttcaggactttgaatgccagccaaaggccacgtctgacttgggaggcagagggcagctactgcaggtttccgagcagagggtcatacacagggctggacctcacgcagactggcatggccatgggtccagaggatactactgggaaggggatggcagctactgccaccttccagatggttccatggagttctgatctttgggcatggccaggggaagcagaagggagactctaggagttgaaatgggtcagacccggtgtttgggtgaaggtaaggaatgagggaagaggagctctttg

SEQ ID NO: 1495 - DNA, 1890 bp, Homo sapiens
gcggcgcggaggggcgcggagcggcgcggagccgggcggctcggggcccagagagagccgcggccgggagctcgcgggctcctgacaacctcctcccctcggcggacgacgaccacggcgactagggcgccggtcatggcggagcaacaaacccggcgcggaccctaggcaccaccgcatggagcgggacgaaccgccgcctagcggagggggaggcggcgggggctcggcggggttcctggagcctcccgccgcgctccctccgccgccgcgcaacggtttctgtcaggatgaattggcagagcttgacccaggcactaatgatcgggctgaacaacgaacctgtctcatttgtggggaccgcgctacaggcttgcactatgggatcatctcctgtgagggctgcaaagggtttttcaagcggagcatttgcaacaaacgggtatatcgatgcagtcgtgacaagaactgtgtcatgtctcggaagcagaggaacaggtgccagtactgccgcctgctcaaatgcctccagatggggatgaaccggaaggctatcagagaagatggcatgcctggaggccggaataagagcattgggccagtccagatatcggaagaagaaatcgaaaggatcatgtctgggcaggagtttgaggaagaggccaatcactggagcaaccatggtgatagtgaccacagttcccctgggaacagggcttcggagagcaaccagccctcaccaggctccacactgtcttccagtaggtctgtggaactgaatggattcatggccttcagggaacagtacatgggaatgtctgtgcctccacattaccaatatataccgcacctttttagctattctggccactcaccacttctgccccaacaagctcgcagcctggatccccagtcatacagtctgattcaccagctgttatcagccgaggacctggaaccattgggcacgcccatgttgattgaagatggatacgctgtgacacaggcagaactatttgccctgctttgccgcctggccgacgagctgctctttaggcagattgcctggatcaagaaactgcctttcttctgcgagctctcaatcaaggattacacgtgcctcttgagctctacgtggcaggagctaatcctgctgtcttccctcaccgtttacagcaagcagatctttggggaactggctgatgtcactgccaagtactcgccctccgatgaagaactacacagatttagtgatgaagggatggaggtgatcgagcggctcatctacctctatcacaagttccatcagctaaaggtcagcaacgaggagtatgcttgcatgaaagcaattaacttcctaaatcaagatatcaggggtctgaccagtgcctcacagctggaacaattgaataaacgatactggtacatttgccaggattttactgaatataaatacacacatcagccgaaccgctttcctgatctcatgatgtgcttacctgagattcgatatattgcaggaaagatggtgaatgtgcccctggagcagctgcccctcctctttaaggtggtgctgcattcctgcaagaccagtgtgggcaaggaatgacctgttccaggcgccctcctcaggccaaccacagcgtcttgggtgggcaggacaggctctggagggaaaagccagagagaccaagatggaggctgtggagcagcatttcccgttgcctccatagcaagaagagtttttgtttgtttgtctgtttttttaacctcatttttctatatatttatttcacgacagagttgaatgtatggccttcaacatgatgcacatgcttttgtgtgaatgcagccaatgcattttcttacagtttacagaatgtgaagatg

SEQ ID NO: 1496 - DNA, 1898 bp, Homo sapiens
gtgctgagggggcgcggcgcggaggggcgcggagcggcgcggagccgggcggctcggggcccagagagagccgcggccgggagctcgcgggctcctgacaacctcctcccctcggcggacgacgaccacggcgactagggcgccggtcatggcggagcaacaaacccggcgcggaccctaggcaccaccgcatggagcgggacgaaccgccgcctagcggagggggaggcggcgggggctcggcggggttcctggagcctcccgccgcgctccctccgccgccgcgcaacggtttctgtcaggatgaattggcagagcttgacccaggcactaatgatcgggctgaacaacgaacctgtctcatttgtggggaccgcgctacaggcttgcactatgggatcatctcctgtgagggctgcaaagggtttttcaagcggagcatttgcaacaaacgggtatatcgatgcagtcgtgacaagaactgtgtcatgtctcggaagcagaggaacaggtgccagtactgccgcctgctcaaatgcctccagatggggatgaaccggaaggctatcagagaagatggcatgcctggaggccggaataagagcattgggccagtccagatatcggaagaagaaatcgaaaggatcatgtctgggcaggagtttgaggaagaggccaatcactggagcaaccatggtgatagtgaccacagttcccctgggaacagggcttcggagagcaaccagccctcaccaggctccacactgtcttccaggtctgtggaactgaatggattcatggccttcagggaacagtacatgggaatgtctgtgcctccacattaccaatatataccgcacctttttagctattctggccactcaccacttctgccccaacaagctcgcagcctggatccccagtcatacagtctgattcaccagctgttatcagccgaggacctggaaccattgggcacgcccatgttgattgaagatggatacgctgtgacacaggcagaactatttgccctgctttgccgcctggccgacgagctgctctttaggcagattgcctggatcaagaaactgcctttcttctgcgagctctcaatcaaggattacacgtgcctcttgagctctacgtggcaggagctaatcctgctgtcttccctcaccgtttacagcaagcagatctttggggaactggctgatgtcactgccaagtactcgccctccgatgaagaactacacagatttagtgatgaagggatggaggtgatcgagcggctcatctacctctatcacaagttccatcagctaaaggtcagcaacgaggagtatgcttgcatgaaagcaattaacttcctaaatcaagatatcaggggtctgaccagtgcctcacagctggaacaattgaataaacgatactggtacatttgccaggattttactgaatataaatacacacatcagccgaaccgctttcctgatctcatgatgtgcttacctgagattcgatatattgcaggaaagatggtgaatgtgcccctggagcagctgcccctcctctttaaggtggtgctgcattcctgcaagaccagtgtgggcaaggaatgacctgttccaggcgccctcctcaggccaaccacagcgtcttgggtgggcaggacaggctctggagggaaaagccagagagaccaagatggaggctgtggagcagcatttcccgttgcctccatagcaagaagagtttttgtttgtttgtctgtttttttaacctcatttttctatatatttatttcacgacagagttgaatgtatggccttcaacatgatgcacatgcttttgtgtgaatgcagccaatgcattttcttacagtttacagaatgtgaaga

SEQ ID NO: 1497 - DNA, 6697 bp, Homo sapiens
gcggcgcggagccgggcggctcggggcccagagagagccgcggccgggagctcgcgggctcctgacaacctcctcccctcggcggacgacgaccacggcgactagggcgccggtcatggcggagcaacaaacccggcgcggaccctaggcaccaccgcatggagcgggacgaaccgccgcctagcggagggggaggcggcgggggctcggcggggttcctggagcctcccgccgcgctccctccgccgccgcgcaacggtttctgtcaggatgaattggcagagcttgacccaggcactatttctgtttcagatgatcgggctgaacaacgaacctgtctcatttgtggggaccgcgctacaggcttgcactatgggatcatctcctgtgagggctgcaaagggtttttcaagcggagcatttgcaacaaacgggtatatcgatgcagtcgtgacaagaactgtgtcatgtctcggaagcagaggaacaggtgccagtactgccgcctgctcaaatgcctccagatggggatgaaccggaaggctatcagagaagatggcatgcctggaggccggaataagagcattgggccagtccagatatcggaagaagaaatcgaaaggatcatgtctgggcaggagtttgaggaagaggccaatcactggagcaaccatggtgatagtgaccacagttcccctgggaacagggcttcggagagcaaccagccctcaccaggctccacactgtcttccagtaggtctgtggaactgaatggattcatggccttcagggaacagtacatgggaatgtctgtgcctccacattaccaatatataccgcacctttttagctattctggccactcaccacttctgccccaacaagctcgcagcctggatccccagtcatacagtctgattcaccagctgttatcagccgaggacctggaaccattgggcacgcccatgttgattgaagatggatacgctgtgacacaggcagaactatttgccctgctttgccgcctggccgacgagctgctctttaggcagattgcctggatcaagaaactgcctttcttctgcgagctctcaatcaaggattacacgtgcctcttgagctctacgtggcaggagctaatcctgctgtcttccctcaccgtttacagcaagcagatctttggggaactggctgatgtcactgccaagtactcgccctccgatgaagaactacacagatttagtgatgaagggatggaggtgatcgagcggctcatctacctctatcacaagttccatcagctaaaggtcagcaacgaggagtatgcttgcatgaaagcaattaacttcctaaatcaagatatcaggggtctgaccagtgcctcacagctggaacaattgaataaacgatactggtacatttgccaggattttactgaatataaatacacacatcagccgaaccgctttcctgatctcatgatgtgcttacctgagattcgatatattgcaggaaagatggtgaatgtgcccctggagcagctgcccctcctctttaaggtggtgctgcattcctgcaagaccagtgtgggcaaggaatgacctgttccaggcgccctcctcaggccaaccacagcgtcttgggtgggcaggacaggctctggagggaaaagccagagagaccaagatggaggctgtggagcagcatttcccgttgcctccatagcaagaagagtttttgtttgtttgtctgtttttttaacctcatttttctatatatttatttcacgacagagttgaatgtatggccttcaacatgatgcacatgcttttgtgtgaatgcagccaatgcattttcttacagtttacagaatgtgaagatgtttaatgttacagtgttgtcattgtttagaaatagttcttttgtattttgagggagagggtgggatggggctaagatgactatttccataatgttgacaaagatgactacctcaatggaaatggggggtgtggccatccctactttttccacattttctcagcagactcatacatttgtctgtcagagagcaaattgccttttttagccacagaattgccagataaaacggcacactgtaagggggcaaagtgttgttaggagattcactaagcaaggttggtgagacggcaacagggtaggaggtgaggattgagccacgtcctttccttggaaagcgtgaaaattaagagagtagggcacagtgaccatatttaaggcaggtgtccttccacccaacaagtcctaagggcagaagaatttctgttctcacaccttgctgccccccttacccctgcaccaccatcattgtctaccactgcgaactttccatctaggcaaagtcctggcaatcacttgatccacaggactcgcctcccagctccctcggggcccccagctacctagtttccttacctggatctcctgaggcccaccttcctccttcccactcccttacacatttgacttcctattggccctttgaaaaaccagctgagcagaatgccatgttctgaagcctggtgcccactactgatttattctcctttcaccttgttttcttcaaagggtagtagggcaaggccagactgcaaaaagaatagacactccccttttgaaatctgttcctctcccctccccttcctaccgcaccctcaggtctaaatccgaaaacttcaggcttttttaaacaatgagaaggaccattcacctgtctgctgaccagaaatgttgcccctaagttcttctccaagttctccttttctctccagagtgagaccagttttcctcagggacccaggacacaaagcccaaggcccagagtggctcagctgccccttacttcagcagtggactggccagccaaggcctggagggctggagccagaagcacctggaagggaaggggggctttaaactacctcaggttcctaatggcccggctgctacctctgcagacatggcctggactccttgacctctcactacctgccccaccttatcccaggacgtgttccttaccctcttgactttggccagcgctacaccaggtctgtctttgaactctttcaggtgcttgtcctgcctacacccaggtatctttcacagccagtgtggcaagcagaccacttagttggctgcatgcctgggtaggttggaagggcccacggcaccttcttctgcctatttagtcaaaggctgtttgctgtctcctcaactcaacctagtaaagctacccaggagggcaccacgtcgtgtgcatactgggtagtccatgtctgattgtaattgtttctttctggtgaaatgttacgggtaccagcagagtgatgattttggcccttgatggatctaaaactcggaacattactcctcaatgccgtttccccagttgctctgagaaggaagagacatgttcctcaggaaaagctccagctagcatgtttttcacgtcagtgggaagattcttgtgtgttcgtgtgtatctgtttatttctaagttcacgatacttgttcccctgaattttatttaaccaactagatcacattctttggccacaggtcagactctgagctgctttcctccagatcgggaaggagacacatatcacagatgccttctctaagacagctcctgtgtacagcatcgttctttgctgaggcctctatctgtccaattattatttttgaaattgcttttcaaattaaacattttacccgttgtgttgggtgtcaaaagaaattgctctctgatgaggcaagaacatgtctctccaacaacgtagtattgaacagagcaagttgttaatttgtggagtaggggaaaggttctgcaagttgccattgtacaaatccagttttacaaatgtttgcagcagattccacagaacaaagagcccattcattgccgagagccctgcagaatctcagagcaaagtggctgtgtgttccgagccggagcctgacctgtggaccgtctttaatgtcttctgcaccagtccttttatgacgtgggctttttttaaacagggtaaagtgaatgtgttgcattgcaaactcaggtattatgaggagaaggtaggagtgtagctagcagcgtggagacattaggtcagccactagatgtatttgtgaatttggtttgaaggacacggagaaaggttggaggggaggtttggtgtgtttgttttttgctttcttccccataatgtttggttaacaggtagcctttttgcgagtggaaggagagaaaagttgtgcatgttttctctaatttctctttctgccctctctctgatccccaaccaccaaaagcactcactttgagtgaggatttttttttttttttttttttttttttttgaggcggagtctcgctctgtcgctcaggctggagtgcagtggtgcgatcttggctcactgcaagctccgcctcccgggttcatgccattctcctgcctcagcctcctgagtagctgggactacaggcgcccgccaccacacccggctaactttttttgtatttttagtagaaacattgtttcaccacgttagccaggatggtctccatctcctgacctcgtgatccgcctgcctcggcctcccaaagtgctgggattacaggcgtgagccactgcacccagccgagtgagaatttttatgccataaaaatacgactctgaaagctacatggaaaaggagaatcccacctccttgcactacattgaaacatgcaagcctttccctccctctcctttttgatgttttcttgtcccaagacaaaagtttggcatcttggaacttattcatgctctctggctgcctttgtagacttttggagtcctttgcaaggtttggtggtctcgtcgttaatctggagaaattccccagaatctgtctcaaagcgctcaacctggctcagaggacacccagcccctatgccccactcacaagagaggtgggcaagcccccagggataggaggaagtaagcaggatcctccctgtcctgtttcccagaaccagagcaaggaatggggaatcctaagggtttctgtggcatcactgaatgtcacccactccacatcaacctgcctctcacctgccaccctttttcagggaggtgagtacctgccatggtcactgttaccagatccttaaaatcctgggctctgagctaggtgcattgctctgttacccatttcctacatttgtttgtttgttcttgatttcctgggggaatgggactgatggagacagacaaacccactgtgggcagcatctaagccatgtccaaggttggtcgaattaagggaaccctggcctctcagcaggacagaaagctgagctgtggttccaggccctcctctctgggcccctggtgtgtatcttttttccttgttgcttttgaaatttttgcaattattttaagaatccagtctttcagaccagcccttttattaagctttgaatttttaattgatttttttaaagtaaaaaaaaaaaaaacccaaaaaacaaacaaaatttaacaaaaaaatccgctactcttactcccctgcctccccctaccccagcccatgagagttcccttgcactcccctctgcctttgcaactgatcatcctccctttctccttggcttgaagcatctatgtccagtatctgtgaaatgatgttttatctgtgtgtcaggatgagaaacggcagtcattccaccaagtgttggaaactggttagcctggagacaagggtttctggggccacagctcagggatgtgtatttaattacaggatccccagaaactcctctctaggctgccacagcaacattttttctgggcttgggagccatacctgaactgtttcctccaaggcgggaactccagagagcctgccaagtctggagcaagctggggcttctgctttggccagacctgggccaccatgagacttgaaggcttctagctgtcctacgacacgagccacggtggccctgcctctccccgctcatagaagcctggtccctctgtctagcccagttcccatctagcatccgtcttctgggcctgaagccctaaatggaccacagcctgcacaggaatcaactgtaggctcaaagggaggcggtgagtaaggtcagagcctgctccaagcccaagaacaaaagttgtgttatgggtggaggctagtcccccagatctagccctgccgtctttgccctttaatgaccattgttttctttctctaaaatgtcttgtaataggtgataatgttgttgattcaaatttccatgaaaaagaaaaaaaaaactacctcttaagcgacatcctggtcgattcctctctgaggaatcctgtgggaaaagaatactgtagctcctgctctgtttacatgtttctgtcgggaaagaagccccgcctgccctggggtgttggtgtttttgtctgtgttgccatcccaggtctgccataggggctggtggctgcattgtgatgtctgggctgtgtctggggattccttcccacctacccagccagggactagtcacccccctgaagaggcctccatttccttcctgtgctccagggcatagggagcaccactcccacagacaccacctttaagggctctagtggcacacacatccacgagccta

SEQ ID NO: 1498 - DNA, 2541 bp, Homo sapiens
cgtgacgacatcggcgtcagcgtcacggaggcgtcggccacgttcagcggacacgggagcaagatggcgattccgggcaggcagtatgggcttattttgccaaagaaaacacagcagttgcaccctgttttgcaaaaaccatcagtgtttgggaatgattctgatgatgatgatgagacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataagaaaaaactgcaagagagagctgaagaagaagaaagagaaaagagggctgctgcactggaagcatgtttggatgtaaccaagcagaaagatctcagtggattttataggcacctattaaatcaagcagttggtgaagaggaagtacctaaatgcagctttcgtgaagccagatctggtataaaggaagaaaaatcaaggggcttctccaatgaagtaagttcaaaaaacagaataccacaagagaaatgcattcttcaaactgatgtgaaagtagaggaaaacccagatgcagacagtgacttcgatgctaagagcagtgcggatgatgaaatagaagaaactagagtgaactgcagaagggaaaaggtcatagagacccctgagaatgacttcaagcaccacaggagtcaaaaccactctcggtcacctagtgaagaaagagggcacagtaccaggcaccacacgaaaggatcacgaacgtcgagaggacatgagaaaagggaagatcagcaccagcagaagcaatccagagaccaagagaaccattacactgaccgtgattaccggaaagaaagggattctcataggcacagagaggccagtcatagagattcccattggaagaggcatgaacaggaagataaaccaagggcgagggaccaaagagaaagaagtgacagagtatggaaaagggagaaagatagggagaaatattcccaaagagaacaagaaagagatagacaacaaaatgatcagaaccgacccagtgagaaaggagagaaggaagagaaaagcaaagcaaaggaagagcatatgaaagtaaggaaggaaagatatgaaaataatgataaatacagagatagagaaaaacgagaggtaggtgttcagtcttcagaaagaaatcaagacagaaaggaaagcagcccaaattctagggcaaaggataaatttcttgaccaagaaagatccaacaaaatgagaaacatggcaaaggacaaagaaagaaaccaagagaaaccctctaattctgaatcatcactgggagcaaaacacagactcacagaggaagggcaagagaagggtaaagaacaagagagaccacctgaggcagtgagcaagtttgcaaagcggaacaatgaagaaactgtaatgtcagctagagacaggtacttggccaggcagatggcgcgggttaatgcaaagacctatattgagaaagaagatgattgatggctaccccaagagaaagatttaaggaagcacagaaaactgtaattcctggaacctgctgcgtaaaaccataaaggagtgtgttaccagtagtttggagggcatttttaaatttattttcaaaattttaagttaaaagtcagtcttacagcttggatgtttggatgtggatgtttggctgaatttatatatagtgtgtactcatcaataccacattctttgttgtattcaagaaccgttaagagtgtgctaattccctgtaggtacataatgaggaaaatttgctccactacaaccattaaaaaataattttggccagatacggtagctcgtgcctgtaataccaacattttgggaggccaaggcagaaggatattgaggctaggcattcaagaccagcctaggcaggataataagaccttgtctctatttaaaaaacaaaaagcctagcatggtagtccatgcctgtagtcccagctgttcgagaggctgaggcaagaagatcacttgagcctaggaatttgatgttacagtgaggtatgatcatgccactgcactccaacctgggcaacagaatgagaccctgtctctaaaaaattttttttaaataaataatttaactcttctaataatgttttgttgcaggaaatgtatttcagataaaatatggatttgaaaaacagaaaatatactttatgttctgaaatttgtatttaagtataaaatgtgaatcatcttgtctaaatagcttacagcatagttggcttaaatgaaaataaaatgatatgcttatacatttta

SEQ ID NO: 1499 - DNA, 2306 bp, Homo sapiens
ctaaaaatgaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataagaaaaaactgcaagagagagctgaagaagaagaaagagaaaagagggctgctgcactggaagcatgtttggatgtaaccaagcagaaagatctcagtggattttataggcacctattaaatcaagcagttggtgaagaggaagtacctaaatgcagctttcgtgaagccagatctggtataaaggaagaaaaatcaaggggcttctccaatgaagtaagttcaaaaaacagaataccacaagagaaatgcattcttcaaactgatgtgaaagtagaggaaaacccagatgcagacagtgacttcgatgctaagagcagtgcggatgatgaaatagaagaaactagagtgaactgcagaagggaaaaggtcatagagacccctgagaatgacttcaagcaccacaggagtcaaaaccactctcggtcacctagtgaagaaagagggcacagtaccaggcaccacacgaaaggatcacgaacgtcgagaggacatgagaaaagggaagatcagcaccagcagaagcaatccagagaccaagagaaccattacactgaccgtgattaccggaaagaaagggattctcataggcacagagaggccagtcatagagattcccattggaagaggcatgaacaggaagataaaccaagggcgagggaccaaagagaaagaagtgacagagtatggaaaagggagaaagatagggagaaatattcccaaagagaacaagaaagagatagacaacaaaatgatcagaaccgacccagtgagaaaggagagaaggaagagaaaagcaaagcaaaggaagagcatatgaaagtaaggaaggaaagatatgaaaataatgataaatacagagatagagaaaaacgagaggtaggtgttcagtcttcagaaagaaatcaagacagaaaggaaagcagcccaaattctagggcaaaggataaatttcttgaccaagaaagatccaacaaaatgagaaacatggcaaaggacaaagaaagaaaccaagagaaaccctctaattctgaatcatcactgggagcaaaacacagactcacagaggaagggcaagagaagggtaaagaacaagagagaccacctgaggcagtgagcaagtttgcaaagcggaacaatgaagaaactgtaatgtcagctagagacaggtacttggccaggcagatggcgcgggttaatgcaaagacctatattgagaaagaagatgattgatggctaccccaagagaaagatttaaggaagcacagaaaactgtaattcctggaacctgctgcgtaaaaccataaaggagtgtgttaccagtagtttggagggcatttttaaatttattttcaaaattttaagttaaaagtcagtcttacagcttggatgtttggatgtggatgtttggctgaatttatatatagtgtgtactcatcaataccacattctttgttgtattcaagaaccgttaagagtgtgctaattccctgtaggtacataatgaggaaaatttgctccactacaaccattaaaaaataattttggccagatacggtagctcgtgcctgtaataccaacattttgggaggccaaggcagaaggatattgaggctaggcattcaagaccagcctaggcaggataataagaccttgtctctatttaaaaaacaaaaagcctagcatggtagtccatgcctgtagtcccagctgttcgagaggctgaggcaagaagatcacttgagcctaggaatttgatgttacagtgaggtatgatcatgccactgcactccaacctgggcaacagaatgagaccctgtctctaaaaaattttttttaaataaataatttaactcttctaataatgttttgttgcaggaaatgtatttcagataaaatatggatttgaaaaacagaaaatatactttatgttctgaaatttgtatttaagtataaaatgtgaatcatcttgtctaaatagcttacagcatagttggcttaaatgaaaataaaatgatatgctt

SEQ ID NO: 1500 - DNA, 1785 bp, Homo sapiens
gtcggccacgttcagcggacacgggagcaagatggcgattccgggcaggcaacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaggaggaaaataatcccaaattgcttttggggaaagacagaaagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataagaaaaaactgcaagagagagctgaagaagaagaaagagaaaagagggctgctgcactggaagcatgtttggatgtaaccaagcagaaagatctcagtggattttataggcacctattaaatcaagcagttggtgaagaggaagtacctaaatgcagctttcgtgaagccagatctggtataaaggaagaaaaatcaaggggcttctccaatgaagtaagttcaaaaaacagaataccacaagagaaatgcattcttcaaactgatgtgaaagtagaggaaaacccagatgcagacagtgacttcgatgctaagagcagtgcggatgatgaaatagaagaaactagagtgaactgcagaagggaaaaggtcatagagacccctgagaatgacttcaagcaccacaggagtcaaaaccactctcggtcacctagtgaagaaagagggcacagtaccaggcaccacacgaaaggatcacgaacgtcgagaggacatgagaaaagggaagatcagcaccagcagaagcaatccagagaccaagagaaccattacactgaccgtgattaccggaaagaaagggattctcataggcacagagaggccagtcatagagattcccattggaagaggcatgaacaggaagataaaccaagggcgagggaccaaagagaaagaagtgacagagtatggaaaagggagaaagatagggagaaatattcccaaagagaacaagaaagagatagacaacaaaatgatcagaaccgacccagtgagaaaggagagaaggaagagaaaagcaaagcaaaggaagagcatatgaaagtaaggaaggaaagatatgaaaataatgataaatacagagatagagaaaaacgagaggtaggtgttcagtcttcagaaagaaatcaagacagaaaggaaagcagcccaaattctagggcaaaggataaatttcttgaccaagaaagatccaacaaaatgagaaacatggcaaaggacaaagaaagaaaccaagagaaaccctctaattctgaatcatcactgggagcaaaacacagactcacagaggaagggcaagagaagggtaaagaacaagagagaccacctgaggcagtgagcaagtttgcaaagcggaacaatgaagaaactgtaatgtcagctagagacaggtacttggccaggcagatggcgcgggttaatgcaaagacctatattgagaaagaagatgattgatggctaccccaagagaaagatttaaggaagcacagaaaactgtaattcctggaacctgctgcgtaaaaccataaaggagtgtgttaccagtagtttggagggcatttttaaatttattttcaaaattttaagttaaaagtcagtcttacagcttggatgtttggatgtggatg

SEQ ID NO: 1501 - DNA, 3608 bp, Homo sapiens
acgtgacctggtgacagtgctgacttggctgtacagctcgatctaggttctgcggcacgggatggcggaggcgcctcctgtctcaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacaggttctctaattgaacaactaacaacagaaaaatacgagtgcatggtgtgctgtgaattggttcgtgtcacggccccagtgtggagttgtcagagctgttaccatgtgtttcatttgaactgcataaagaaatgggcaaggtctccagcatctcaagcagatggccagagtggttggaggtgccctgcctgtcagaatgtttctgcacatgttcctaatacctacacttgtttctgtggcaaggtaaagaatcctgagtggagcagaaatgaaattccacatagctgtggtgaggtttgtagaaagaaacagcctggccaggactgcccacattcctgtaaccttctctgccatccaggaccctgcccaccctgccctgcctttatgacaaaaacatgtgaatgtggacgaaccaggcacacagttcgctgtggtcaggctgtctcagtccactgttctaacccatgtgagaatattttgaactgtggtcagcaccagtgtgctgagctgtgccatgggggtcagtgccagccttgccagatcattttgaaccaggtatgctattgcggcagcacctcccgagatgtgttatgtggaaccgatgtaggaaagtctgatggatttggggatttcagctgtttaaagatatgtggcaaggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttagatttcattcatacctgtgaaaagctctgccatgaaggagactgtggaccatgctctcgcacatcagttatttcctgcagatgctctttcagaacaaaggagcttccatgtaccagtctcaaaagtgaagatgctacatttatgtgtgacaagcggtgtaacaagaaacggttgtgtggacggcataaatgtaatgagatatgctgtgtggataaggagcacaagtgtcctttgatttgtgggaggaaactccgttgtggccttcataggtgtgaagaaccttgtcatcgtggaaactgccagacatgctggcaagccagttttgatgaattaacctgccattgtggtgcatcagtgatttaccctccagttccctgtggtactaggccccctgaatgtacccaaacctgcgctagagtccatgagtgtgaccatccagtatatcattcttgtcatagtgaggagaagtgtcccccttgcactttcctaactcagaagtggtgcatgggcaagcatgagtttcggagcaacatcccctgtcacctggttgatatctcttgcggattaccctgcagtgccacgctaccatgtgggatgcacaaatgtcagagactctgtcacaaaggggagtgtcttgtggatgagccctgcaagcagccctgcaccacccccagagctgactgtggtcacccgtgtatggcaccctgccataccagctcaccctgccctgtgactgcttgtaaagctaaggtggtagagctacagtgtgaatgtggacgaagaaaagagatggtgatttgctctgaagcatctagtacttatcaaaggttagtaatagctgcaatctccatggcctctaagataacagacatgcagcttggaggttcagtggagatcagcaagttaattaccaaaaaggaagttcatcaagccaggctggagtgtgatgaggagtgttcagccttggaaaggaaaaagagattagcagaggcatttcatatcagtgaggattctgatcctttcaatatacgttcttcagggtcaaaattcagtgatagtttgaaagaagatgccaggaaggacttaaagtttgtcagtgacgttgagaaggaaatggaaaccctcgtggaggccgtgaataaggttgaagtcgaaacatcccactggacatttctctaaggccagcttgatgaaaaaaaaaaagcaatcaagtcctggaaacactttcaacctagagtagttgtaggaaaaagtcacaacttctttgaggatccttatctttctcaaaacacagccattataacatctgtggaagcctgtcctggttcaggacagttgactgcagaaaagatctacagtcggctgggcacagtgtctcatgcctgtaatgccagcactttgggaggccaaggcaggcagatcacttgaggtcaggagttctagatcagcttggccaacatgacgaaaccctgtctctactaaaaatataaaaattagctgggtgtggtggcgggcacctgttattccagctacttgcaaggcttaggcaggagaattccttgaacccgggaggcagaggttgctgtgagctgagattctgccactgcactccagcctgggcaacaagagtgaaactctgtct

SEQ ID NO: 1502 - DNA, 3513 bp, Homo sapiens
cagctcgatctaggttctgcggcacgggatggcggaggcgcctcctgtctcaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacaggttctctaattgaacaactaacaacagaaaaatacgagtgcatggtgtgctgtgaattggttcgtgtcacggccccagtgtggagttgtcagagctgttaccatgtgtttcatttgaactgcataaagaaatgggcaaggtctccagcatctcaagcagatggccagagtggttggaggtgccctgcctgtcagaatgtttctgcacatgttcctaatacctacacttgtttctgtggcaaggtaaagaatcctgagtggagcagaaatgaaattccacatagctgtggtgaggtttgtagaaagaaacagcctggccaggactgcccacattcctgtaaccttctctgccatccaggaccctgcccaccctgccctgcctttatgacaaaaacatgtgaatgtggacgaaccaggcacacagttcgctgtggtcaggctgtctcagtccactgttctaacccatgtgagaatattttgaactgtggtcagcaccagtgtgctgagctgtgccatgggggtcagtgccagccttgccagatcattttgaaccaggtatgctattgcggcagcacctcccgagatgtgttatgtggaaccgatgtaggaaagtctgatggatttggggatttcagctgtttaaagatatgtggcaaggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttagatttcattcatacctgtgaaaagctctgccatgaaggagactgtggaccatgctctcgcacatcagttatttcctgcagatgctctttcagaacaaaggagcttccatgtaccagtctcaaaagtgaagatgctacatttatgtgtgacaagcggtgtaacaagaaacggttgtgtggacggcataaatgtaatgagatatgctgtgtggataaggagcacaagtgtcctttgatttgtgggaggaaactccgttgtggccttcataggtgtgaagaaccttgtcatcgtggaaactgccagacatgctggcaagccagttttgatgaattaacctgccattgtggtgcatcagtgatttaccctccagttccctgtggtactaggccccctgaatgtacccaaacctgcgctagagtccatgagtgtgaccatccagtatatcattcttgtcatagtgaggagaagtgtcccccttgcactttcctaactcagaagtggtgcatgggcaagcatgagcagtcccactactgggcgtctacccagaagaaaagaagtcattatatgaaaaagatacctgcacacgcatgtttatagcagcacaattcacaattgcaaaaatgtggaaccagcccaactgcccatcagtcaacaagtggataaagaaattgtggtgtatctatacgtaccatggaatactactcagccaggaacgaaataatggcattcacagcaacctggatggatttggagaccattattctaagtgaagtaactcaggaatggaaaaccaaacatcgtatgttctcaattataagagggagctaagctatgaggacgcaaaggcatgagaatgatacaatggactttggggactctggggaaaggacgggaggcgggtgagggataaaaaactacacactgggtccgagcacggtggctcatgcctataatcccagcactttgggaggccaaggcaggtagattatgaggtcgggagttcgaaaccagcctggccaacaaggtgagaccccccccatctctactaaaataattagccgggcctggtggcgcatccctgtaatcccagctactttacttgggaggctgaggcaggagaattgcttgaactcgggaggcggatgttgcagtgagccaatatcgcaccactgcactccagcctgggcaacagagcaagactccgtctcgaaaaaaaaaataaattttaaaaactacacattgggtacaatgtacactcctcgggtgatgggtgcaccaaaatctcaaaaatcactactaaggaacttatccatgtaaccaaacaccacctgttccccaagaactattgaaataagaaaaaagaaaaaaaaaaaatcactgattgcaggtcaccctaacagatataataatgaaaaagtctgagatgttgcgagaattaccaaaatgtgatgcagacacgaaatgagcatgtgctgttggaaaagtggaacagatagacttgctggagacagggttgccacaaagtttcaatttgtaaaaaatgtgatatctatgaaatgcaataaagtgaagtccaataa

SEQ ID NO: 1503 - DNA, 3609 bp, Homo sapiens
acgtgacctggtgacagtgctgacttggctgtacagctcgatctaggttctgcggcacgggatggcggaggcgcctcctgtctcaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacaggttctctaattgaacaactaacaacagaaaaatacgagtgcatggtgtgctgtgaattggttcgtgtcacggccccagtgtggagttgtcagagctgttaccatgtgtttcatttgaactgcataaagaaatgggcaaggtctccagcatctcaagcagatggccagagtggttggaggtgccctgcctgtcagaatgtttctgcacatgttcctaatacctacacttgtttctgtggcaaggtaaagaatcctgagtggagcagaaatgaaattccacatagctgtggtgaggtttgtagaaagaaacagcctggccaggactgcccacattcctgtaaccttctctgccatccaggaccctgcccaccctgccctgcctttatgacaaaaacatgtgaatgtggacgaaccaggcacacagttcgctgtggtcaggctgtctcagtccactgttctaacccatgtgagaatattttgaactgtggtcagcaccagtgtgctgagctgtgccatgggggtcagtgccagccttgccagatcattttgaaccaggtatgctattgcggcagcacctcccgagatgtgttatgtggaaccgatgtaggaaagtctgatggatttggggatttcagctgtttaaagatatgtggcaaggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttagatttcattcatacctgtgaaaagctctgccatgaaggagactgtggaccatgctctcgcacatcagttatttcctgcagatgctctttcagaacaaaggagcttccatgtaccagtctcaaaagtgaagatgctacatttatgtgtgacaagcggtgtaacaagaaacggttgtgtggacggcataaatgtaatgagatatgctgtgtggataaggagcacaagtgtcctttgatttgtgggaggaaactccgttgtggccttcataggtgtgaagaaccttgtcatcgtggaaactgccagacatgctggcaagccagttttgatgaattaacctgccattgtggtgcatcagtgatttaccctccagttccctgtggtactaggccccctgaatgtacccaaacctgcgctagagtccatgagtgtgaccatccagtatatcattcttgtcatagtgaggagaagtgtcccccttgcactttcctaactcagaagtggtgcatgggcaagcatgagtttcggagcaacatcccctgtcacctggttgatatctcttgcggattaccctgcagtgccacgctaccatgtgggatgcacaaatgtcagagactctgtcacaaaggggagtgtcttgtggatgagccctgcaagcagccctgcaccacccccagagctgactgtggtcacccgtgtatggcaccctgccataccagctcaccctgccctgtgactgcttgtaaagctaaggtagagctacagtgtgaatgtggacgaagaaaagagatggtgatttgctctgaagcatctagtacttatcaaagaatagctgcaatctccatggcctctaagataacagacatgcagcttggaggttcagtggagatcagcaagttaattaccaaaaaggaagttcatcaagccaggctggagtgtgatgaggagtgttcagccttggaaaggaaaaagagattagcagaggcatttcatatcagtgaggattctgatcctttcaatatacgttcttcagggtcaaaattcagtgatagtttgaaagaagatgccaggaaggacttaaagtttgtcagtgacgttgagaaggaaatggaaaccctcgtggaggccgtgaataaggttgaagtcgaaacatcccactggacatttctctaaggccagcttgatgaaaaaaaaaaagcaatcaagtcctggaaacactttcaacctagagtagttgtaggaaaaagtcacaacttctttgaggatccttatctttctcaaaacacagccattataacatctgtggaagcctgtcctggttcaggacagttgactgcagaaaagatctacagtcggctgggcacagtgtctcatgcctgtaatgccagcactttgggaggccaaggcaggcagatcacttgaggtcaggagttctagatcagcttggccaacatgacgaaaccctgtctctactaaaaatataaaaattagctgggtgtggtggcgggcacctgttattccagctacttgcaaggcttaggcaggagaattccttgaacccgggaggcagaggttgctgtgagctgagattctgccactgcactccagcctgggcaacaagagtgaaactctgtctcaaaaagaaa

SEQ ID NO: 1504 - DNA, 4604 bp, Homo sapiens
cacgtgacctggtgacagtgctgacttggctgtacagctcgatctaggttctgcggcacgggatggcggaggcgcctcctgtctcaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacaggttctctaattgaacaactaacaacagaaaaatacgagtgcatggtgtgctgtgaattggttcgtgtcacggccccagtgtggagttgtcagagctgttaccatgtgtttcatttgaactgcataaagaaatgggcaaggtctccagcatctcaagcagatggccagagtggttggaggtgccctgcctgtcagaatgtttctgcacatgttcctaatacctacacttgtttctgtggcaaggtaaagaatcctgagtggagcagaaatgaaattccacatagctgtggtgaggtttgtagaaagaaacagcctggccaggactgcccacattcctgtaaccttctctgccatccaggaccctgcccaccctgccctgcctttatgacaaaaacatgtgaatgtggacgaaccaggcacacagttcgctgtggtcaggctgtctcagtccactgttctaacccatgtgagaatattttgaactgtggtcagcaccagtgtgctgagctgtgccatgggggtcagtgccagccttgccagatcattttgaaccaggtatgctattgcggcagcacctcccgagatgtgttatgtggaaccgatgtaggaaagtctgatggatttggggatttcagctgtttaaagatatgtggcaaggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttagatttcattcatacctgtgaaaagctctgccatgaaggagactgtggaccatgctctcgcacatcagttatttcctgcagatgctctttcagaacaaaggagcttccatgtaccagtctcaaaagtgaagatgctacatttatgtgtgacaagcggtgtaacaagaaacggttgtgtggacggcataaatgtaatgagatatgctgtgtggataaggagcacaagtgtcctttgatttgtgggaggaaactccgttgtggccttcataggtgtgaagaaccttgtcatcgtggaaactgccagacatgctggcaagccagttttgatgaattaacctgccattgtggtgcatcagtgatttaccctccagttccctgtggtactaggccccctgaatgtacccaaacctgcgctagagtccatgagtgtgaccatccagtatatcattcttgtcatagtgaggagaagtgtcccccttgcactttcctaactcagaagtggtgcatgggcaagcatgagtttcggagcaacatcccctgtcacctggttgatatctcttgcggattaccctgcagtgccacgctaccatgtgggatgcacaaatgtcagagactctgtcacaaaggggagtgtcttgtggatgagccctgcaagcagccctgcaccacccccagagctgactgtggtcacccgtgtatggcaccctgccataccagctcaccctgccctgtgactgcttgtaaagctaaggtagagctacagtgtgaatgtggacgaagaaaagagatggtgatttgctctgaagcatctagtacttatcaaagaatagctgcaatctccatggcctctaagataacagacatgcagcttggaggttcagtggagatcagcaagttaattaccaaaaaggaagttcatcaagccaggctggagtgtgatgaggagtgttcagccttggaaaggaaaaagagattagcagaggcatttcatatcagtgaggattctgatcctttcaatatacgttcttcagggtcaaaattcagtgatagtttgaaagaagatgccaggaaggacttaaagtttgtcagtgacgttgagaaggaaatggaaaccctcgtggaggccgtgaataagggaaagaatagtaagaaaagccacagcttccctcccatgaacagagaccaccgccggatcatccatgacttggcccaagtttatggcctggagagcgtgagctatgacagtgaaccgaagcgcaatgtggtggtcactgccatcagggggaagtccgtttgtcctcctaccacgctgacaggtgtgcttgaaagggaaatgcaggcacggcctccaccaccgattcctcatcacagacatcagtcagacaagaatcctgggagcagtaatttacagaaaataaccaaggagccaataattgactattttgacgtccaggactaagaagatcatgatgcacttagataaaagaatgattaggtatagtggagacttatttgccagcagataaatcatgcccgttcccctctgcctggcagaatcacagtctcacatactgtcttgtactgacacatccaaagcatgagtgtgtcagaaatcccttgtctattcctgtctgtataaagtgtttcattatgaccagatctctgattgtatggtcactaggtatgcaatcacgcattcaaagaggctctttacaccatcactgtgattgctctgagagttgagggactattgggctttatttggacaaaccaaacttttagcctgaaaccaactttatgccactaagtcatagcctcagttgtcccagttatttgtcctcctgaaaatgcctgaaacatcagacagacattgcttgctttacccaaactgatcaaaatctttaggagcacaaatgaattttttagtctgaaataccaaataatgaattggtataccatatccggaatcacacatgttatcttaaacccagccatcatacctaagtcttttgccaaaacctctcataggtatatctagctgaacttattttggcattttcaatgtgatcagttctagacctagaagggggtcaggctgctttacagaattctatttccttaagtccctggcacttctcataccacatcactgaacctgttcagtaacaatcagtttggccgtcccccatgatggtaggaaatatagagagcaagttcttctgccagggtcacactgtggtctctgaactgaccagtatatccctaactcctctttgatagagaaagagtctcaaatggacaactgtcctgtgttgctttccctaggccttcagcagcctattggctctccctgcctctgagctctggactctgtttgaatattccaagtagtatatggacagtccagggcttatgcccagcagcccactggaggcattcttcaggctcctttaaggcaggtgcattgatagttccattagtgtgacccttgcattggcacccctccagcctggaggccaggcttccagcaacttccttctgccctagagcaagccatgagccccagagcagtagcaggagacttgagaagtagagtgacaaaaacaagcacttaattaaattataaaatttaacttta

SEQ ID NO: 1505 - DNA, 4598 bp, Homo sapiens
acgtgacctggtgacagtgctgacttggctgtacagctcgatctaggttctgcggcacgggatggcggaggcgcctcctgtctcaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacaggttctctaattgaacaactaacaacagaaaaatacgagtgcatggtgtgctgtgaattggttcgtgtcacggccccagtgtggagttgtcagagctgttaccatgtgtttcatttgaactgcataaagaaatgggcaaggtctccagcatctcaagcagatggccagagtggttggaggtgccctgcctgtcagaatgtttctgcacatgttcctaatacctacacttgtttctgtggcaaggtaaagaatcctgagtggagcagaaatgaaattccacatagctgtggtgaggtttgtagaaagaaacagcctggccaggactgcccacattcctgtaaccttctctgccatccaggaccctgcccaccctgccctgcctttatgacaaaaacatgtgaatgtggacgaaccaggcacacagttcgctgtggtcaggctgtctcagtccactgttctaacccatgtgagaatattttgaactgtggtcagcaccagtgtgctgagctgtgccatgggggtcagtgccagccttgccagatcattttgaaccaggtatgctattgcggcagcacctcccgagatgtgttatgtggaaccgatgtaggaaagtctgatggatttggggatttcagctgtttaaagatatgtggcaaggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttagatttcattcatacctgtgaaaagctctgccatgaaggagactgtggaccatgctctcgcacatcagttatttcctgcagatgctctttcagaacaaaggagcttccatgtaccagtctcaaaagtgaagatgctacatttatgtgtgacaagcggtgtaacaagaaacggttgtgtggacggcataaatgtaatgagatatgctgtgtggataaggagcacaagtgtcctttgatttgtgggaggaaactccgttgtggccttcataggtgtgaagaaccttgtcatcgtggaaactgccagacatgctggcaagccagttttgatgaattaacctgccattgtggtgcatcagtgatttaccctccagttccctgtggtactaggccccctgaatgtacccaaacctgcgctagagtccatgagtgtgaccatccagtatatcattcttgtcatagtagaagtgtcccccttgcactttcctaactcagaagtggtgcatgggcaagcatgagtttcggagcaacatcccctgtcacctggttgatatctcttgcggattaccctgcagtgccacgctaccatgtgggatgcacaaatgtcagagactctgtcacaaaggggagtgtcttgtggatgagccctgcaagcagccctgcaccacccccagagctgactgtggtcacccgtgtatggcaccctgccataccagctcaccctgccctgtgactgcttgtaaagctaaggtagagctacagtgtgaatgtggacgaagaaaagagatggtgatttgctctgaagcatctagtacttatcaaagaatagctgcaatctccatggcctctaagataacagacatgcagcttggaggttcagtggagatcagcaagttaattaccaaaaaggaagttcatcaagccaggctggagtgtgatgaggagtgttcagccttggaaaggaaaaagagattagcagaggcatttcatatcagtgaggattctgatcctttcaatatacgttcttcagggtcaaaattcagtgatagtttgaaagaagatgccaggaaggacttaaagtttgtcagtgacgttgagaaggaaatggaaaccctcgtggaggccgtgaataagggaaagaatagtaagaaaagccacagcttccctcccatgaacagagaccaccgccggatcatccatgacttggcccaagtttatggcctggagagcgtgagctatgacagtgaaccgaagcgcaatgtggtggtcactgccatcagggggaagtccgtttgtcctcctaccacgctgacaggtgtgcttgaaagggaaatgcaggcacggcctccaccaccgattcctcatcacagacatcagtcagacaagaatcctgggagcagtaatttacagaaaataaccaaggagccaataattgactattttgacgtccaggactaagaagatcatgatgcacttagataaaagaatgattaggtatagtggagacttatttgccagcagataaatcatgcccgttcccctctgcctggcagaatcacagtctcacatactgtcttgtactgacacatccaaagcatgagtgtgtcagaaatcccttgtctattcctgtctgtataaagtgtttcattatgaccagatctctgattgtatggtcactaggtatgcaatcacgcattcaaagaggctctttacaccatcactgtgattgctctgagagttgagggactattgggctttatttggacaaaccaaacttttagcctgaaaccaactttatgccactaagtcatagcctcagttgtcccagttatttgtcctcctgaaaatgcctgaaacatcagacagacattgcttgctttacccaaactgatcaaaatctttaggagcacaaatgaattttttagtctgaaataccaaataatgaattggtataccatatccggaatcacacatgttatcttaaacccagccatcatacctaagtcttttgccaaaacctctcataggtatatctagctgaacttattttggcattttcaatgtgatcagttctagacctagaagggggtcaggctgctttacagaattctatttccttaagtccctggcacttctcataccacatcactgaacctgttcagtaacaatcagtttggccgtcccccatgatggtaggaaatatagagagcaagttcttctgccagggtcacactgtggtctctgaactgaccagtatatccctaactcctctttgatagagaaagagtctcaaatggacaactgtcctgtgttgctttccctaggccttcagcagcctattggctctccctgcctctgagctctggactctgtttgaatattccaagtagtatatggacagtccagggcttatgcccagcagcccactggaggcattcttcaggctcctttaaggcaggtgcattgatagttccattagtgtgacccttgcattggcacccctccagcctggaggccaggcttccagcaacttccttctgccctagagcaagccatgagccccagagcagtagcaggagacttgagaagtagagtgacaaaaacaagcacttaattaaattataaaatttaacttt

SEQ ID NO: 1506 - DNA, 3333 bp, Homo sapiens
cggcgccagcggccgcacgccgcggagcaggggctcggaggtcccgggattacggtgctcgagcacgctggtgggaaaggacccgggacttgaacagtgttgtgcggcgccatgcaggtctccagcctcaatgaggtgaagatttacagcctcagctgcggcaagtcccttcctgagtggctttctgataggaagaagagagcgctacagaagaaagatgtagatgtccgtaggagaattgaacttattcaggactttgaaatgcctactgtgtgtaccactattaaggtgtcaaaagatggacagtacattttagcaactggaacatataaacctcgggttcgatgttatgacacctatcaattatccttgaagtttgaaaggtgtttagattcagaagttgtcacctttgaaattttgtctgatgactactcaaagattgtcttcttacataatgatagatacattgaatttcattcgcaatcaggtttttactacaaaaccagaataccaaagtttgggagagatttctcttaccactatccatcctgtgacttgtactttgttggtgcaagttctgaagtttataggttaaacttagaacaaggacgatacctgaatcctctacaaactgatgctgcggagaataatgtttgtgacataaattcagtgcatggcttgtttgccacaggaaccatagagggtagagtggagtgctgggacccaagaactcgaaacagagttggcctgttagactgcgccttaaacagtgtcacagcagattcagagataaacagtttaccaacaatctctgctttgaaatttaatggtgccttgaccatggcagttggaacaaccacagggcagggaaaaatatttacttccttggagccagagcatgaccttaatgatgtttgtctctaccccaactcaggcatgcttctgacggccaatgaaacccccaagatgggcatctattacattccagttttgggtcctgctcctcggtggtgttccttcttagacaacttgaccgaagaattagaagagaatccagaaagcacagtctatgatgattataaatttgtcaccaagaaagaccttgaaaatttagggctcacccacctcattggatctcctttcctccgggcatatatgcatgggtttttcatggatataagactctatcacaaggtgaaactgatggtaaatccatttgcttatgaagaatataggaaagataaaatacgacagaaaatagaagaaacacgtgcacagagagtccagttaaagaaattgccaaaagttaacaaagagctggcacttaaattaattgaggaagaagaggagaagcagaaatctacatggaaaaagaaagttaagagtcttcctaatattctcaccgatgatcgatttaaagttatgtttgagaaccctgacttccaagtagatgaagagagtgaagaatttaggcttctgaatccacttgtttcaaaaattagtgaaaaaaggaagaagaaactaagactcttagagcaacaagaacttcgtgaaaaagaagaggaggaagagccggaaggaaaaccaagtgatgcagaaagttcggagagttcagatgatgaaaaagcctgggttgaagaggtcaggaagcaacgcagactcctccagcaggaggaaaaagtgaagcggcaggaacgactcaaggaggaccagcagacagtcctaaagccccagttttatgagatcaaagcaggagaagaatttagaagcttcaaagattctgccacaaagcagaaactgatgaacaaaacccttgaagatcgtttgaaaattgaagcaaaaaatgggacattgagtgtatccgacaccaccgttggcagcaaacaattgacattcacgttaaagaggtctgaacagcagaagaagcaacaggaggctgagaaactgcatcgacaagaaaggaaaagactccgtcgttcggccggacacctgaagtcaagacacaaaagaggacggtcgtttcattgatttgggaagtggtcctacctgtgattagggaggggtacgtctcccccaaactgatcatcgttagggtgttaaacacagacgaggaaacacacgtttttaaagttcatgtacgttcttgtacacagaggtaaagatttgaaaacctgtgccttgtgggttggactttgaagctggccccgccgacggccaccgcacagccccaggggtgtgcttgcgagtcgttgctccctggaaacattgtcctttccccacggcgttaatcatgaaaaccaggctggggtttttttaatattgtgaaatgtacaccatgaaatgaaaggtttatcctgtgccagaaaccaaggtttatcatgctctaggaacttttttcttacactgcctaccgccattcatgattaaaccatccagaaataccatccctgttttacctggtgtctgtgtattgcctgtgtttgtgtttataagtttatgctgataggtttgttcggcttgtttatgtattagtttgggatttgtttttaaataatttataccaagagagtataatctaatggtgcaggttgagagcatcccaaatccgaaaatctaaaactgtttgagcactgtatttatctgttcttgcactgctataaagaactacctgaaactgggtaatttataagtaaagaaaagaggtttaattgactcacagttctacaggtggtacaggaagcatggctgtggaggccctgggaagcttacaatcgtggcagaaggtgaagcggaagcaggtatgtcctgcgtggctagagccagaggaggagggcaaaggggcagatgctgcacactttcaaacaccagatctccaagaactcactaacacagaatagcaagggggaagtctgcccccatgtttcagtcacctccctccaggcccctcctccaacaccgaagattacaatttgacatgagatttgtgtggggacacagagcaaaaccatatcaagcactgacatgacattggaggaaaatgctcattagagcttttcaggttttggattttcagatttgggatacttgactagtaaatataatacagatattccaaaacacacaaaaaaaccaaagtctaaaagacttctggtcccaagcatttcagataagggatacccaacctgtaataatgggaaacaagcagtagaggctgttggttaatcttggcacaagtttaattacaggttttttttttttcctgtttcttaagtacagtcaaacataaacttactggaggaaacatttataaaaataaatatactttcatttgaa

SEQ ID NO: 1507 - DNA, 2589 bp, Homo sapiens
ccagcggccgcacgccgcggagcaggggctcggaggtcccgggattacggtgctcgagcacgctggtgggaaaggacccgggacttgaacagtgttgtgcggcgccatgcaggtctccagcctcaatgaggtgaagatttacagcctcagctgcggcaagtcccttcctgagtggctttctgataggaagaagagagcgctacagaagaaagatgtagatgtccgtaggagaattgaacttattcaggactttgaaatgcctactgtgtgtaccactattaaggtgtcaaaagatggacagtacattttagcaactggaacatataaacctcgggttcgatgttatgacacctatcaattatccttgaagtttgaaaggtgtttagattcagaagttgtcacctttgaaattttgtctgatgactactcaaagattgtcttcttacataatgatagatacattgaatttcattcgcaatcaggtttttactacaaaaccagaataccaaagtttgggagagatttctcttaccactatccatcctgtgacttgtactttgttggtgcaagttctgaagtttataggttaaacttagaacaaggacgatacctgaatcctctacaaactgatgctgcggagaataatgtttgtgacataaattcagtgcatggcttgtttgccacaggaaccatagagggtagagtggagtgctgggacccaagaactcgaaacagagttggcctgttagactgcgccttaaacagtgtcacagcagattcagagataaacagtttaccaacaatctctgctttgaaatttaatggtgccttgaccatggcagttggaacaaccacagggcaggttttattatatgaccttcgatctgataagccattgctagttaaagatcaccagtatgggctgcccattaagtccgttcatttccaggattcattagatctgattttgtctgctgactctcgaattgtcaagatgtggaataagaactccggaaaaatatttacttccttggagccagagcatgaccttaatgatgtttgtctctaccccaactcaggcatgcttctgacggccaatgaaacccccaagatgggcatctattacattccagttttgggtcctgctcctcggtggtgttccttcttagacaacttgaccgaagaattagaagagaatccagaaagcacagtctatgatgattataaatttgtcaccaagaaagaccttgaaaatttagggctcacccacctcattggatctcctttcctccgggcatatatgcatgggtttttcatggatataagactctatcacaaggtgaaactgatggtaaatccatttgcttatgaagaatataggaaagataaaatacgacagaaaatagaagaaacacgtgcacagagagtccagttaaagaaattgccaaaagttaacaaagagctggcacttaaattaattgaggaagaagaggagaagcagaaatctacatggaaaaagaaagttaagagtcttcctaatattctcaccgatgatcgatttaaagttatgtttgagaaccctgacttccaagtagatgaagagagtgaagaatttaggcttctgaatccacttgtttcaaaaattagtgaaaaaaggaagaagaaactaagactcttagagcaacaagaacttcgtgaaaaagaagaggaggaagagccggaaggaaaaccaagtgatgcagaaagttcggagagttcagatgatgaaaaagcctgggttgaagaggtcaggaagcaacgcagactcctccagcaggaggaaaaagtgaagcggcaggaacgactcaaggaggaccagcagacagtcctaaagccccagttttatgagatcaaagcaggagaagaatttagaagcttcaaagattctgccacaaagcagaaactgatgaacaaaacccttgaagatcgtttgaaaattgaagcaaaaaatgggacattgagtgtatccgacaccaccgttggcagcaaacaattgacattcacgttaaagaggtctgaacagcagaagaagcaacaggaggctgagaaactgcatcgacaagaaaggaaaagactccgtcgttcggccggacacctgaagtcaagacacaaaagaggacggtcgtttcattgatttgggaagtggtcctacctgtgattagggaggggtacgtctcccccaaactgatcatcgttagggtgttaaacacagacgaggaaacacacgtttttaaagttcatgtacgttcttgtacacagaggtaaagatttgaaaacctgtgccttgtgggttggactttgaagctggccccgccgacggccaccgcacagccccaggggtgtgcttgcgagtcgttgctccctggaaacattgtcctttccccacggcgttaatcatgaaaaccaggctggggtttttttaatattgtgaaatgtacaccatgaaatgaaaggtttatcctgtgccagaaaccaaggtttatcatgctctaggaacttttttcttacactgcctaccgccattcatgattaaaccatccagaaatacca

SEQ ID NO: 1508 - DNA, 2301 bp, Homo sapiens
agtcggcgccagcggccgcacgccgcggagcaggggctcggaggtcccgggattacggtgctcgagcacgctggtgggaaaggacccgggacttgaacagtgttgtgcggcgccatgcaggtctccagcctcaatgaggtgaagatttacagcctcagctgcggcaagtcccttcctgagtggctttctgataggaagaagagagcgctacagaagaaagatgtagatgtccgtaggagaattgaacttattcaggactttgaaatgcctactgtgtgtaccactattaaggtgtcaaaagatggacagtacattttagcaactgttgtcacctttgaaattttgtctgatgactactcaaagattgtcttcttacataatgatagatacattgaatttcattcgcaatcaggtttttactacaaaaccagaataccaaagtttgggagagatttctcttaccactatccatcctgtgacttgtactttgttggtgcaagttctgaagtttataggttaaacttagaacaaggacgatacctgaatcctctacaaactgatgctgcggagaataatgtttgtgacataaattcagtgcatggcttgtttgccacaggaaccatagagggtagagtggagtgctgggacccaagaactcgaaacagagttggcctgttagactgcgccttaaacagtgtcacagcagattcagagataaacagtttaccaacaatctctgctttgaaatttaatggtgccttgaccatggcagttggaacaaccacagggcaggttttattatatgaccttcgatctgataagccattgctagttaaagatcaccagtatgggctgcccattaagtccgttcatttccaggattcattagatctgattttgtctgctgactctcgaattgtcaagatgtggaataagaactccggaaaaatatttacttccttggagccagagcatgaccttaatgatgtttgtctctaccccaactcaggcatgcttctgacggccaatgaaacccccaagatgggcatctattacattccagttttgggtcctgctcctcggtggtgttccttcttagacaacttgaccgaagaattagaagagaatccagaaagcacagtctatgatgattataaatttgtcaccaagaaagaccttgaaaatttagggctcacccacctcattggatctcctttcctccgggcatatatgcatgggtttttcatggatataagactctatcacaaggtgaaactgatggtaaatccatttgcttatgaagaatataggaaagataaaatacgacagaaaatagaagaaacacgtgcacagagagtccagttaaagaaattgccaaaagttaacaaagagctggcacttaaattaattgaggaagaagaggagaagcagaaatctacatggaaaaagaaagttaagagtcttcctaatattctcaccgatgatcgatttaaagttatgtttgagaaccctgacttccaagtagatgaagagagtgaagaatttaggcttctgaatccacttgtttcaaaaattagtgaaaaaaggaagaagaaactaagactcttagagcaacaagaacttcgtgaaaaagaagaggaggaagagccggaaggaaaaccaagtgatgcagaaagttcggagagttcagatgatgaaaaagcctgggttgaagaggtcaggaagcaacgcagactcctccagcaggaggaaaaagtgaagcggcaggaacgactcaaggaggaccagcagacagtcctaaagccccagttttatgagatcaaagcaggagaagaatttagaagcttcaaagattctgccacaaagcagaaactgatgaacaaaacccttgaagatcgtttgaaaattgaagcaaaaaatgggacattgagtgtatccgacaccaccgttggcagcaaacaattgacattcacgttaaagaggtctgaacagcagaagaagcaacaggaggctgagaaactgcatcgacaagaaaggaaaagactccgtcgttcggccggacacctgaagtcaagacacaaaagaggacggtcgtttcattgatttgggaagtggtcctacctgtgattagggaggggtacgtctcccccaaactgatcatcgttagggtgttaaacacagacgaggaaacacacgtttttaaagttcatgtacgttcttgtacacagaggtaaagatttgaaaacctgtgccttgtgggttggactttgaagctggccccgccgacggccaccgcacagc

SEQ ID NO: 1509 - DNA, 2404 bp, Homo sapiens
agtcggcgccagcggccgcacgccgcggagcaggggctcggaggtcccgggattacggtgctcgagcacgctggtgggaaaggacccgggacttgaacagtgttgtgcggcgccatgcaggtctccagcctcaatgaggtgaagatttacagcctcagctgcggcaagtcccttcctgagatgtccgtaggagaattgaacttattcaggactttgaaatgcctactgtgtgtaccactattaaggtgtcaaaagatggacagtacattttagcaactggaacatataaacctcgggttcgatgttatgacacctatcaattatccttgaagtttgaaaggtgtttagattcagaagttgtcacctttgaaattttgtctgatgactactcaaagattgtcttcttacataatgatagatacattgaatttcattcgcaatcaggtttttactacaaaaccagaataccaaagtttgggagagatttctcttaccactatccatcctgtgacttgtactttgttggtgcaagttctgaagtttataggttaaacttagaacaaggacgatacctgaatcctctacaaactgatgctgcggagaataatgtttgtgacataaattcagtgcatggcttgtttgccacaggaaccatagagggtagagtggagtgctgggacccaagaactcgaaacagagttggcctgttagactgcgccttaaacagtgtcacagcagattcagagataaacagtttaccaacaatctctgctttgaaatttaatggtgccttgaccatggcagttggaacaaccacagggcaggttttattatatgaccttcgatctgataagccattgctagttaaagatcaccagtatgggctgcccattaagtccgttcatttccaggattcattagatctgattttgtctgctgactctcgaattgtcaagatgtggaataagaactccggaaaaatatttacttccttggagccagagcatgaccttaatgatgtttgtctctaccccaactcaggcatgcttctgacggccaatgaaacccccaagatgggcatctattacattccagttttgggtcctgctcctcggtggtgttccttcttagacaacttgaccgaagaattagaagagaatccagaaagcacagtctatgatgattataaatttgtcaccaagaaagaccttgaaaatttagggctcacccacctcattggatctcctttcctccgggcatatatgcatgggtttttcatggatataagactctatcacaaggtgaaactgatggtaaatccatttgcttatgaagaatataggaaagataaaatacgacagaaaatagaagaaacacgtgcacagagagtccagttaaagaaattgccaaaagttaacaaagagctggcacttaaattaattgaggaagaagaggagaagcagaaatctacatggaaaaagaaagttaagagtcttcctaatattctcaccgatgatcgatttaaagttatgtttgagaaccctgacttccaagtagatgaagagagtgaagaatttaggcttctgaatccacttgtttcaaaaattagtgaaaaaaggaagaagaaactaagactcttagagcaacaagaacttcgtgaaaaagaagaggaggaagagccggaaggaaaaccaagtgatgcagaaagttcggagagttcagatgatgaaaaagcctgggttgaagaggtcaggaagcaacgcagactcctccagcaggaggaaaaagtgaagcggcaggaacgactcaaggaggaccagcagacagtcctaaagccccagttttatgagatcaaagcaggagaagaatttagaagcttcaaagattctgccacaaagcagaaactgatgaacaaaacccttgaagatcgtttgaaaattgaagcaaaaaatgggacattgagtgtatccgacaccaccgttggcagcaaacaattgacattcacgttaaagaggtctgaacagcagaagaagcaacaggaggctgagaaactgcatcgacaagaaaggaaaagactccgtcgttcggccggacacctgaagtcaagacacaaaagaggacggtcgtttcattgatttgggaagtggtcctacctgtgattagggaggggtacgtctcccccaaactgatcatcgttagggtgttaaacacagacgaggaaacacacgtttttaaagttcatgtacgttcttgtacacagaggtaaagatttgaaaacctgtgccttgtgggttggactttgaagctggccccgccgacggccaccgcacagccccaggggtgtgcttgcgagtcgttgctccctggaaacattgtcctttccccacggcgttaatcatgaaaa

SEQ ID NO: 1510 - DNA, 2506 bp, Homo sapiens
aaaatggcagcgctggaggaagaattcacgttgtcttcggtagtcctgagcgccgggcctgaaggactcctaggcgtggagcagagcgacaaaacagaccagtttctagtgacagacagcggcaggacagtcatcctctataaggtttctgatcagaaacccttggggagctggtcagtgaaacaaggtcaaattataacatgtccagctgtgtgcaactttcaaactggagagtatgttgttgtacacgataataaggttttaagaatatggaataatgaagatgtaaacctggataaagtatttaaagctacattgtcagcagaagtatataggatactttcagtgcaagggacagaacccttggtgctcttcaaggaaggtgctgttcgtggtttagaggccttgcttgcagacccccagcagaaaattgaaactgttatctctgatgaagaagtgattaaatggacaaagtttttcgtagtattcagacatcctgttttaatttttattactgaaaaacatggaaattactttgcttacgtgcaaatgtttaactcacgtatcttaaccaaatatacactcttacttggacaagacgaaaactctgttataaagagttttactgcatctgtagatcggaaattcatctctttgatgtcattaagctctgatggttgtatatatgaaaccttgataccaatacgtccagctgacccagaaaaaaatcagagcttagttaaatcactgctgctcaaggctgttgtatctggtaacgctcgaaatggagttgcactcactgccctggatcaggatcacgtcgcagtcctaggaagtccactagcagcttctaaggaatgcctctctgtatggaacataaaatttcaaacactacagacttcaaaagagttaccacaagggaccagtggtcaactctggtattatggagaacatttgtttatgctacatggaaaatctctaactgtgattccatacaagtgtgaagtgtcatcattagcaggtgctcttggaaaactcaagcatagtcaagatccaggaactcatgtcgtgtcccattttgtaaactgggagacacctcaaggatgtggacttgggttccagaactcagagcagtcaagaagaattttaaggagacgaaaaattgaagtgagtttacagccagaggttccaccatccaaacaacttttgtcaaccataatgaaagattcagaaaaacacattgaagtagaagtacggaaatttttggctctgaagcagacacctgactttcatactgtcattggggacacagtaacaggacttctggaaaggtgtaaagcagaaccatcattttatccccggaactgtctgatgcagcttatccaaacgcatgtgctttcttacagtttgtgccccgacttaatggagattgccttaaaaaagaaagatgtacagttgttacaactctgtctacagcagttccctgacattcctgaatcagtcacctgtgcttgcttaaaaattttcttgagcattggtgatgacagtcttcaagaaacagatgttaatatggagtcagtttttgactatagtataaattctgtacatgatgagaaaatggaagagcaaactgaaattcttcaaaatggcttcaatcctgaagaagataaatgcaataactgtgatcaagagttaaataaaaagccccaggacgaaacaaaggagagcacttcatgccctgtggtacaaaaaagagcagctctacttaatgcaattcttcattcagcatatagcgagacatttcttctgcctcatttgaaagacatcccagcacagcatatcacgctgtttcttaagtatttgtatttcctgtacctgaagtgtagcgaaaatgctactatgactcttcctggaatacacccacctaccttgaaccagattatggattggatatgtctacttctggatgcaaattttactgttgttgtaatgatgccagaagcaaagaggctactgataaatctttacaagcttgtaaaatctcagatatctgtttattctgagctcaacaagattgaagtaagttttcgggagctacagaaattaaatcaagaaaagaataatagaggattatattcaattgaagtgctggagctcttctgatattatcaattctccttcatagacattttataaagctcttttatgtgaactcttgcttcatccaggcaagaacggtgttttgtttgcgaccatctcagtgtcaagagaaacgtgtcagtgagtacctggaccatcacttaactgatgctccggggtaggactgcaggtttcacatgaacctgttctaggctgtggacattggtgtggagaggttctgcaattttttaaaaatatgtaactgggttgattttaagtaaaattatttgtgtattgataaaagtctaatttcttatcatgtgttttgaattttttcttttaataaaaaatgaccattgaagcagtg

SEQ ID NO: 1511 - DNA, 2448 bp, Homo sapiens
aaaatggcagcgctggaggaagaattcacgttgtcttcggtagtcctgagcgccgggcctgaaggactcctaggcgtggagcagagcgacaaaacagaccagtttctagtgacagacagcggcaggacagtcatcctctataaggtttctgatcagaaacccttggggagctggtcagtgaaacaaggtcaaattataacatgtccagctgtgtgcaactttcaaactggagagtatgttgttgtacacgataataaggttttaagaatatggaataatgaagatgtaaacctggataaagtatttaaagctacattgtcagcagaagtatataggatactttcagtgcaagggacagaacccttggtgctcttcaaggaaggtgctgttcgtggtttagaggccttgcttgcagacccccagcagaaaattgaaactgttatctctgatgaagaagtgattaacatggaaattactttgcttacgtgcaaatgtttaactcacgtatcttaaccaaatatacactcttacttggacaagacgaaaactctgttataaagagttttactgcatctgtagatcggaaattcatctctttgatgtcattaagctctgatggttgtatatatgaaaccttgataccaatacgtccagctgacccagaaaaaaatcagagcttagttaaatcactgctgctcaaggctgttgtatctggtaacgctcgaaatggagttgcactcactgccctggatcaggatcacgtcgcagtcctaggaagtccactagcagcttctaaggaatgcctctctgtatggaacataaaatttcaaacactacagacttcaaaagagttaccacaagggaccagtggtcaactctggtattatggagaacatttgtttatgctacatggaaaatctctaactgtgattccatacaagtgtgaagtgtcatcattagcaggtgctcttggaaaactcaagcatagtcaagatccaggaactcatgtcgtgtcccattttgtaaactgggagacacctcaaggatgtggacttgggttccagaactcagagcagtcaagaagaattttaaggagacgaaaaattgaagtgagtttacagccagaggttccaccatccaaacaacttttgtcaaccataatgaaagattcagaaaaacacattgaagtagaagtacggaaatttttggctctgaagcagacacctgactttcatactgtcattggggacacagtaacaggacttctggaaaggtgtaaagcagaaccatcattttatccccggaactgtctgatgcagcttatccaaacgcatgtgctttcttacagtttgtgccccgacttaatggagattgccttaaaaaagaaagatgtacagttgttacaactctgtctacagcagttccctgacattcctgaatcagtcacctgtgcttgcttaaaaattttcttgagcattggtgatgacagtcttcaagaaacagatgttaatatggagtcagtttttgactatagtataaattctgtacatgatgagaaaatggaagagcaaactgaaattcttcaaaatggcttcaatcctgaagaagataaatgcaataactgtgatcaagagttaaataaaaagccccaggacgaaacaaaggagagcacttcatgccctgtggtacaaaaaagagcagctctacttaatgcaattcttcattcagcatatagcgagacatttcttctgcctcatttgaaagacatcccagcacagcatatcacgctgtttcttaagtatttgtatttcctgtacctgaagtgtagcgaaaatgctactatgactcttcctggaatacacccacctaccttgaaccagattatggattggatatgtctacttctggatgcaaattttactgttgttgtaatgatgccagaagcaaagaggctactgataaatctttacaagcttgtaaaatctcagatatctgtttattctgagctcaacaagattgaagtaagttttcgggagctacagaaattaaatcaagaaaagaataatagaggattatattcaattgaagtgctggagctcttctgatattatcaattctccttcatagacattttataaagctcttttatgtgaactcttgcttcatccaggcaagaacggtgttttgtttgcgaccatctcagtgtcaagagaaacgtgtcagtgagtacctggaccatcacttaactgatgctccggggtaggactgcaggtttcacatgaacctgttctaggctgtggacattggtgtggagaggttctgcaattttttaaaaatatgtaactgggttgattttaagtaaaattatttgtgtattgataaaagtctaatttcttatcatgtgttttgaattttttcttttaataaaaaatgaccattgaagcagtg

SEQ ID NO: 1512 - DNA, 2852 bp, Homo sapiens
gcgcccgggaggatgagtacgctacacccggaagtgtcttcagggagaggaagccggcggcctcactgctatgggccgcaacaagaagaagaagcgagatggtgacgaccggcggccgaggctcgttcttagcttcgacgaggagaagaggcgggagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgagggaggggctggagacaggtctgaggaggaggcgtcatccacggagaaaccaaccaaagccttgcccaggaagtccagagaccccctgctctctcagcggatctcctccctcacagcatcactacatgcacacagccgcaaaaaggtcaagaggaaacatccccgacgggcccaggactccaaaaagcccccaagggcccctcgtaccagcaaggcccagcgccgccgtctcacaggcaaagcacggcacagcggggagtgagaccgagaacgaagcggtgccccagtctaggctgcggggacctgtccttgctcagcttggctgtccctgtagcccagcctgcacctaggtaatgactgcacagctcaaggttgggaagccaggacctctctggcctggggccagctgcctttgcctggggtcagctgcctttgcctggggtttgaattcccgaaggagcaggcagctgagagcaggcctcccccaggaagagccttcagagccacgtgggggcatcttcccaaatgtgcaccccacctggcactcatcagatttgtgcgcttgtgatttgtttgtccttgataccacgcacaagggcaggtttttggggtggtggaaatggccagggcccatgggtctgtctccagcagttagccctgtggctgcaataaagtacagttctccctgtgttaagatcctaaccagggttaaggatcagtgtgtccgttgctagaatccagagcccacctgctgctctgaaaagcaggctcctgaggccagtgggggagcagtgccccccatgcccttcaccgaggagcctctgtgcctgtcccttgtcctcggccccaggagtctcctcaactgacactgaagtggtggaagcagttgagtgccaggtcatcccccatcaccacactggggcagcgtccccaggcttccagcagctcccaggtgggtcccaacgtggaaggattaattaattctttctaaagcagttgcagccgggcttggtggctcacgcctgtaatcccagcactttgggaggcccaggcgggcagatcacttaaggtcgggagctcgagaccagcctggccaacatggtgaaaccctgtctctactaaaaatgcaaaaattagccaggtgtggtggcacacgcgtgtaatcccagctacttgggaggctgaggtggaagaatcacttgaaccctggaggcggaggctgcagtgagccgagatcacgccattgcactccagcctgggcaacgttgtgaccttgtctcaaaaaaaaactaaaaaataaagcagttgcatcttgactcgtacaaaagtagcccccaccagagtagaccctgcgggtgccagctagaactccacaaggggccatgtcttcacactccttccagatggatgagttgatggaaaccctgtcccttccttgtcccagcttgtcagtcctgggcaggagagaatttcaggttgtgccttggttagaggagctgtgttgggtcctaaacactaggaccacaaaggggagtgaactgtgttcccagggcttgctgacgcccgtggactatggagtcaggatgacaggacagtgcggtgaggggcatctgcgacaggactgcgggctctacccgccctgatgtgggagctcctggagtgggggtgagcagtgagccagggtctgcagggctgtcctctctccacagccaacagccaggccttacagtggggcaggcttagtgactgtgcctcagttatgctgtacctgggagtgggcaggccctctcccatgtcaccatcaaaacccactgatgaaggctggtgggagtctgagggctgcacccgggtatggtgagttcccctcagggattgtgctgagcgccttggcctggcttcttggctccgcccacctgctctccctgccaccaagttgtcttccccgggtggcatgtgccacttggctgcctcgtgcctgggcacagtggtgcctattatgggccctccaggtggctctggtgctcagcctgctgtgagcaggaacagctgagtcccaggggttcttgcacacagcagggctcgggtttgaatccaggctctgctgcttggtcgctgcatgagcttctgctgtgctgacctctctggtttgtctcgtcatgtgtaaggtgacaccagatacctacctcttagggctgccccgagactaaaataagaccatgtgcatgaaccacttaccaaagtgcctgttgctctccaggtgtgcctaccgcatgttgccgctgctgtttctgctgggacgtctgactccagttccttctcccctctccagtgacaaggtcatttacaacttacatttacaatttatagtgtttaccagtattaaattctcagccactcctttc

SEQ ID NO: 1513 - DNA, 945 bp, Homo sapiens
gcgcccgggaggatgagtacgctacacccggaagtgtcttcagggagaggaagccggcggcctcactgctatgggccgcaacaagaagaagaagcgagatggtgacgaccggcggccgaggctcgttcttagcttcgacgaggagaagaggcgggagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgagggaggggctggagacaggtctgaggaggaggcgtcatccacggagaaaccaaccaaagccttgcccaggaagtccagagaccccctgctctctcagcggatctcctccctcacagcatcactacatgcacacagccgcaaaaaggtcaagaggaaacatccccgacgggcccaggactccaaaaagcccccaagggcccctcgtaccagcaaggcccagcgccgccgtctcacaggcaaagcacggcacagcggggagtgagaccgagaacgaagcggtgccccagtctaggctgcggggacctgtccttgctcagcttggctgtccctgtagcccagcctgcacctaggtgtgcctaccgcatgttgccgctgctgtttctgctgggacgtctgactccagttccttctcccctctccagtgacaaggtcatttacaacttacatttacaatttatagtgtttaccagtattaaattctcagccactcctttc

SEQ ID NO: 1514 - DNA, 3957 bp, Homo sapiens
ggatggtcctggtcacaaaatattaaagagaccgaccgctaagggaacaggaaaaacgtccgagacagccgttgcaattacgaatggaccagacttggtagcacggggcattgattgctggtgcccaaccggaccctcctcccctcttcccatcccttcccccacccaaagcaggctcccgctgcggccgggacctcgcatccctgcaacgtggccggggctgcatttttcatgagcctagggtgaacaggtgcgaagtgcgctgggagcatccggccagcggccgagcgcggggaacatggagagcgagcgcgacatgtaccgccagttccaggactggtgcctcaggacttacggggactcaggcaagaccaagacggtgacccgtaaaaaatacgaacggatcgtccagctcctcaatggctccgagtcgagctccacggacaacgccaaatttaaattctgggtcaaatcgaagggcttccagctgggccagccggacgaggtccgcgggggaggcggcggcgccaagcaagtgctctacgtgcctgtcaagaccacggatggcgtaggggtagatgagaagctatctttacgacgggtagctgtggttgaagatttctttgacattatttattcgatgcatgtggaaacggggccaaatggagaacaaattcggaaacacgctggacaaaagagaacttacaaagcaatttcagagagctatgccttcctaccaagagaagcggtgacacgatttctaatgagctgctcagagtgccagaaaagaatgcatttaaacccagatggaacagatcataaagataatggaaaacctcccactttggtgaccagcatgattgactacaacatgccaattaccatggcctacatgaaacacatgaagctgcagctgctaaactcacagcaagatgaggatgaaagttcaatagaaagtgatgaatttgacatgagtgattcaacacggatgtcagctgtgaactctgatcttagctccaatcttgaagaaagaatgcaaagtccccagaatcttcatggccagcaagatgatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatatgtttgtcaggctgtttgtagatgaaaacttggaccgaatggtcccaatctctaagcagcccaaagaaaagatccaggctatcattgactcatgcaggcgacaattccctgagtatcaagagcgtgccagaaaacgtatacgtacttacctcaagtcctgcaggcggatgaaaagaagtggttttgagatgtctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgttaaaagaa

SEQ ID NO: 1515 - DNA, 3575 bp, Homo sapiens
cgttgcaattacgaatggaccagacttggtagcacggggcattgattgctggtgcccaaccggaccctcctcccctcttcccatcccttcccccacccaaagcaggctcccgctgcggccgggacctcgcatccctgcaacgtggccggggctgcatttttcatgagcctagggtgaacaggtgcgaagtgcgctgggagcatccggccagcggccgagcgcggggaacatggagagcgagcgcgacatgtaccgccagttccaggactggtgcctcaggacttacggggactcaggcaagaccaagacggtgacccgtaaaaaatacgaacggatcgtccagctcctcaatggctccgagtcgagctccacggacaacgccaaatttaaattctgggtcaaatcgaagggcttccagctgggccagccggacgaggtccgcgggggaggcggcggcgccaagcaagtgctctacgtgcctgtcaagaccacggatggcgtaggggtagatgagaagctatctttacgacgggtagctgtggttgaagatttctttgacattatttattcgatgcatgtggaaacggggccaaatggagaacaaattcggaaacacgctggacaaaagagaacttacaaagcaatttcagagagctatgccttcctaccaagagaagcggtgacacgatttctaatgagctgctcagagtgccagaaaagaatgcatttaaacccagatggaacagatcataaagataatggaaaacctcccactttggtgaccagcatgattgactacaacatgccaattaccatggcctacatgaaacacatgaagctgcagctgctaaactcacagcaagatgaggatgaaagttcaatagaaagtgatgaatttgacatgagtgattcaacacggatgtcagctgtgaactctgatcttagctccaatcttgaagaaagaatgcaaagtccccagaatcttcatggccagcaagatgatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatgatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgtt

SEQ ID NO: 1516 - DNA, 2707 bp, Homo sapiens
atggaccaaactatgttggatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaattctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgtt

SEQ ID NO: 1517 - DNA, 1853 bp, Homo sapiens
cttactgtgcagaggagagaatttaggggaagtcagactaatccctgggtgcacttcgagagaaaggttggacctcgcctgagggatgctggatctgcaatgatagaattggcctgccacagacattggtatttaagttgaagagcagaattcacaatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatatgtttgtcaggctgtttgtagatgaaaacttggaccgaatggtcccaatctctaagcagcccaaagaaaagatccaggctatcattgactcatgcaggcgacaattccctgagtatcaagagcgtgccagaaaacgtatacgtacttacctcaagtcctgcaggcggatgaaaagaagtggttttgagatgtctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcata

SEQ ID NO: 1518 - DNA, 2193 bp, Homo sapiens
acaaataaagccgcagctagaagatgaacaacaaagaaagatgggtttaggcgctatcgaatggtgtgtgtatttgttcctttttctggggtggctctagtctcatggccacaaagctctagcccaggcgccgcgaggcactggcattgagagcccaatgcatctcagcctcacgctgcagaagccagtggggctggggagccgcagcagcgtcgattttcttcacaagaagatgggaactgtgggctacaagtaggatggcagatctgatgcaggagacctttctgcatcatgccacggatggcgtaggggtagatgagaagctatctttacgacgggtagctgtggttgaagatttctttgacattatttattcgatgcatgtggaaacggggccaaatggagaacaaattcggaaacacgctggacaaaagagaacttacaaagcaatacagaaaaatgtgtgaaatgctcaaagtttcaaatacagatttcagagagctatgccttcctaccaagagaagcggtgacacgatttctaatgagctgctcagagtgccagaaaagaatgcatttaaacccagatggaacagatcataaagataatggaaaacctcccactttggtgaccagcatgattgactacaacatgccaattaccatggcctacatgaaacacatgaagctgcagctgctaaactcacagcaagatgaggatgaaagttcaatagaaagtgatgaatttgacatgagtgattcaacacggatgtcagctgtgaactctgatcttagctccaatcttgaagaaagaatgcaaagtccccagaatcttcatggccagcaagatgatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaattctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggc

SEQ ID NO: 1519 - DNA, 1979 bp, Homo sapiens
aagaagatgggaactgtgggctacaagtaggatggcagatctgatgcaggagacctttctgcatcatgccacggatggcgtaggggtagatgagaagctatctttacgacgggtagctgtggttgaagatttctttgacattatttattcgatgcatgtggaaacggggccaaatggagaacaaattcggaaacacgctggacaaaagagaacttacaaagcaatttcagagagctatgccttcctaccaagagaagcggtgacacgatttctaatgagctgctcagagtgccagaaaagaatgcatttaaacccagatggaacagatcataaagataatggaaaacctcccactttggtgaccagcatgattgactacaacatgccaattaccatggcctacatgaaacacatgaagctgcagctgctaaactcacagcaagatgaggatgaaagttcaatagaaagtgatgaatttgacatgagtgattcaacacggatgtcagctgtgaactctgatcttagctccaatcttgaagaaagaatgcaaagtccccagaatcttcatggccagcaagatgatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatatgtttgtcaggctgtttgtagatgaaaacttggaccgaatggtcccaatctctaagcagcccaaagaaaagatccaggctatcattgactcatgcaggcgacaattccctgagtatcaagagcgtgccagaaaacgtatacgtacttacctcaagtcctgcaggcggatgaaaagaagtggttttgagatgtctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatca

SEQ ID NO: 1520 - DNA, 6649 bp, Homo sapiens
agattctcgcgcggtaggccctgaggacccagcatggcggactcgggactgctgctaaagcggggttcctgccgttccacttggctgcgggtccgcaaggcccggccccagctcatcctcagccgccggccccgccgccggctcgggagcctgcgctggtgcggtcggcggcgcctacggtggcggttactgcaagcccaggcgtccggcgtggactggagggagggagcccgccaggtgtcgcgcgcggcggcggcccggagacccaacaccgcgacccccagcccgatccctagcccgaccccggcctccgaacccgagtccgaacccgaactcgaatccgcctcgagttgccaccggcctctcctcatcccaccggtgcggcccgtgggccccggccgcgcgttgctgctgctgccggtcgagcagggttttacttttagtgggatctgtcgtgtgacttgcctctatggccaggtgcaggtatttggttttaccatcagccaaggccagcctgcccaagacatcttctctgtgtatacccactcttgcttgagtatccatgcacttcactactcacagcctgagaaaagcaagaaggaactgaaaagggaagcccggaatttgctcaaatctcatcttaaccttgatgacaggcgttggtcgatgcagaatttttctcctcagtgttccattgtgttgctagaacatctgaaaactgccactgtaaacttcataaccagctatccgggttcatcctacatttttgtgcaagagagtccaactccccagattaaacctgaatatttagccttgaggtctgttggcatcagaagagagaaaaaaaggaaaggccttcagttaactgagagtaccctttcagccctggaagagttagtcaatgtttcctgtgaagaagtagatggctgccctgtcattctagtttgtggatcccaggatgttggaaagtcaacatttaatagatacctgattaaccatttgttaaatagtcttccctgcgttgactatttggaatgtgatctgggacagacagaatttacccctcctggttgcatttctttgcttaatattacagaaccagttctgggaccacctttcactcacctgaggactccacagaagatggtatattatgggaaaccttcttgtaaaaacaactatgagaattatattgacatagtgaaatatgtgttcagcgcttacaagagagagtcccctctcatcgtcaacactatgggatgggtttcagaccaggggctcctgcttctcattgatctgatccgattgctgtctcccagccacgtggttcagttccgctctgaccacagtaaatatatgccagaccttaccccgcagtatgtagatgacatggatggcttgtacacaaaaagcaagaccaagatgagaaatcgacgtttcagactcgcagcatttgcagatgctttggaatttgctgatgaagaaaaagagagtccagttgagttcactggacataaactgataggtgtttatacagactttgcattcagaataactccaagaaatagagagtcacataacaaaattcttcgagatctgtccatcttgagttaccttagccagctgcagcccccgatgcccaaaccactttctcctttacatagcctgacaccctatcaggtccctttcaatgcagtcgcactccggattacccactctgatgtcgcccctacccatatactatatgctgtaaacgccagctgggttggtctttgcaagatccaggatgacgtcagaggatacacgaatgggcccatcctgcttgcccagactccaatctgtgactgcttgggctttggcatctgtagaggcattgacatggagaagcggctgtaccacatcctcacccctgtgcccccggaagagctaaggaccgtgaattgtctgctcgttggagctattgccattccacattgtgtccttaagtgccagcgtgggatcgaagggacagtaccttatgtcacaacggattacaattttaaacttcctggagcatcagagaaaattggagcaagagaacctgaggaggcacataaagagaaaccataccgaagacctaagttctgtcgaaaaatgaagtgatgctcgcgtttttaataagggaagaaactttcctaccagaaagctttgtctcaagcctgaccacaagagacatgatggagtttcatggccatgaatggtgcccttattagcaacagtgttttttgtgtaattcgtgaatgtcatatagtagtcttaagtttctcttttaaagctgcatgagctagaatttgttctagtcttctgtgtgatactcatacttgctgtccagagggagtaaaacagcagagaacagtttgtgtgccattaaaacagagattcctcagaaagttcttcagggacctggttattagaatcaggataaaaataaggaaactggggccattacaatgtaccgagaaggaaggaagaaggccgacctgcaggatctcaagcataatggatacaagggctcgccacgggccttgcctgagccatgtgcagagctggggtccagcggtctgcttccttggagccagtgtggatggttacagcccatccatttggtgcagttgtacttggtctgttatattcaatcaaggtttaatagatagggctgggcatggtggctcatgcacacctgtaatcctagcactttgggaggctgaggcgggaggattgcttgagcctcggagttccaggctggagtacaccaactactccagcctgagcgacagagtaagaccttatcttttaaaaaagaaaagaaaaatttaaacgggtttgatagatataaatttggacccaagagcccttccttttttttaatcctgaggttttatgctgaggaaatttctttcaaatctggaaaacctcggggccaggcgcagtggctcacgcctgtaattccagcactttgggaggccaaggcaggcggttcacgaggtcaggagattgagaccatcctggctaacacagtgaaactccgtctctactaaaaatacaaaaaactagctgggcgtggtggtgggcgcctatagtcccagctactcaggaggctgaggcaggagaatggcatgaacccaggaggcggagcttgcagtgagccgaggtcacgccactgcactccagcctgggcaacaagagcaagactccatctcaaaaaaaaaaaataataatctggaaaacctcttctgggggctcttataaaagtagatttgtccaaattgacttctgatctgaggccagagacaaccacagggcagagctggagactgggctgttttgaaggaagaaggactggcagaccagctcttgggaaagctccattattgcctgtgggaggctggacctgaacttgcacctatgaacaaccctgccatttagagctttttcctgggggtgccggcggctggtgaccagactgccattctccacgttctccctggtgcttccgactctgtcctctaggttggaagtggtttgtgtaaacgggtgatgggaccaggtcacatcatttctgcatttaagacagcaggatacttcctggggctgaggttcaaactggtattgtgaccaccgctttgacagaattccatcttcccagcatgatcacattgtaagactattaggatgtgtgggttttaacacttatatacacttatacaactgttggttatcattgtctttagtattttacagtggcccctcagcacctcttagacccaacagcaaaggacttaaaataagcacaggaaaccttgctatggtgattagttttgatacctttgagacaattgagtctagcttcttagttgccccttatttatgttgaaatctggctcattcatatgatgttttactgtgctggccttgtaaagaattttaagacaatccatcaccatcaatgttttgcctttctccactttcgtgtatcttacagttatactcactggaggtcatttgcagcaaggctctggaagaatgaaactggtgccctgtaattgcatttgcattcaatctaggtttgccttcaggctttaaatgcggcctgtatgaaggtcaagtctttttcttcagtccctatcagtaaagaaaaatcgttgcctctagagggagctatcagctgtgggtcaggtggccgtactggggctagagttggcccaggaagctgtacagggtttagggaaggaggttcggagacagggagccaaggcctctgtcaggtctagcttgtgccggtcagacctgcagcagcaccattctccaggatgacaattcatcccattattgatggcagtggcctttttatccttttttttttttttttttttttttgagatggagtttcgctcttgttgcccaggctggagtgcagtggcgcaatctgggctcactgccacctccgcctcccgggttcaagtgattctcttgcctcaacctcccgagtagctgggattacaggcatgcgccaccatgcctggctgattttctatttttagtagagaaggggtttcaccatgttggccaggctggttttgaactcctgtcctcaggtgatccacctgccttggcctcccaaagtgttgggattacaggcatgagccaccgcacccggctggtggcagtggctttaagggcatttagaagaaggacaagattggactttttatcatttccacagtctgttatgggtcagattaggtagtaaggagttctccattggagctattcttttttttttttctttttttttgagacagagtctcgctctgtcacccaggctggggtgcagtggcacgaccttggctcactacagcctctcccctcccgggttcaagtgattcttctgccccagcctcccaagtagctgggattacaggtgagcgccaccatgcctggctaatttttatatttttagtagagatagggtttcaccgtattggctaggctggtctcgatctcctgaccttgtgatccgcttgcctcggcctcccaaagtgctgaagcaatttcttttttttttttttttttgagacagagtctagctctgtcgcccaggctggggtgcagtggagtgatctcggctcactgcaacttccgcctcccaggtttaagcgattctcctgcctcagcctcctgagtagctgggattacaggcgtatgccaccacgcccagctaatttttgtatttttagtagagacagggtttcaccatgttggtcaggctggtctcgaactcctgacctcgtgatccgcccgccttggcctccgaaagtgctgggattacaggcgtgagccactgcgcctggcctgaagctattctttacaaaagctcttagtttttgtttgtttgtttgtttttttcttttgcgacggactctctgtcgccaaggctggagtgcagtggcctgatctcaggtcactgcaacctctgcctcctgggttcaagcgattctcctgcttcagcctcccaagtagctgggattacaggcgcctgccaccacacccagctaatttttgtatttttagtagagatggcgtttcactttattggtcaggctggtctcgaacttccaacctcaggggatccgcctgccttggcctcccaaggtgttgggattacaggcataagacactgtgcctgggcctcttagtaatttttgtatgtaattttcaaagtatccgggattacaggcgcccgccactacactagctaattttttttgtatttttagtagagatggggttttactatgttggctaggctggtctcgagctcctgacctcgtgatccgtccaccttggcctcccaaagtgctgggattacaggcgtgagccaccgcgcccggcctaggtcatttgtttttgggtttggatggcaagatcatggataagacagcaggctttgattatagagctctgagttcaaatcctggctctaccacttgtcagtggtgtaacttggaggaagatgcttagcctgagcctgttttatgttttgaagattgggtaattgtccttccttcagtgttcctgggtgaggagtaagtgaagtcatgtctataagagatgtagcacagtctccggcatgtagaaacggtcagtaactcctagtgtgtagctagcctctgatgagatggtaaactcaggaggctggcaccacggctgtgctactcacggtcatgctggagggatgcagaaactaaatgaatccacagctacttactcatcttgcctctggcaggttcaccttaaaattgttgctaccaagcttcctgtggtcaaagagcccttgaggaagcaagctccacggccaccatagataacccattcctgaaagtttttcataaacccccacttgttgcttttaaaattttataagcagcttacacatgtagaaaatgatcctccagcccaccaccacatagtaatcactgacactgtgaggtgtctcagctggggttctgctgtgtgtgtgtgtattttacaaaatatgtatggtttctgttcagctcttttcagttaacagatgaacttttgtatcattaaatatttttgaaaacatgaa

SEQ ID NO: 1521 - DNA, 6077 bp, Homo sapiens
cacgcgtttcgaaagatggcggcgtccaggagcgcgggagaggccggcccgggcggctcccagggacgcgtggtccgcatgaagcgcagaggcgggcgcgggccgcgccgcggtcctgctggcggtggggagaaggccctgaagaggctgaagctagcggtggaggagttcgtgcacgcgacttcggaaggcgaggctcccgggggttgcgaggggcgcggcgccccggtgagctttcgcccgggagggagaaaaagccgtaaggaactgaggaaggagaagcggcacctgcggaaagcacgccggctgcagaggacggcgggccccgaacagggtcccggcctgggaggccgaagcggagccgaagaagccagcggtcaccggcaggacacggaggagcgcgcccgcccagcccctagtcgggacccctcgcctcccaggaagccgcggccgtcccgggtcaaggccaaggccacggccgccaccgcaaagaccagaccctccgcagccgccaccgccgctgcccggaaacgggcgcttttagcggcgaacgaggaggaggaccgagagatccgaaagctggagcgttgcctcggtttgaacaagcgcaaaaagaaggacggcagcagctccgtgccgctgagctttgcacgcgacggtcttgactatattctgggagccctggagtctgggaaaaatagcggcttgtacgacagcagtggtgaggaggaggaagatgccggacagacactccccgaaagtgacttagagagtgactcccaggacgaaagtgaggaggaggaggagggagacgtagaaaaggaaaagaaggcgcaggaagcagaagcgcagagcgaggacgacgacgaggatacagaagaggaacagggggaagaaaaggaaaagggagcgcaggagaaaaggagggggaagagagtccgttttgcagaagatgaagaaaagagtgaaaattcctcggaggacggtgacataacggataagagtctttgtggaagtggtgaaaagtacatcccacctcatgtgaggcaagctgaggagacagtggacttcaagaaaaaggaagaactagaaaggctgaagaaacatgtaaaaggtctacttaacaggttgagtgaacccaacatggcttccatcagtgggcagctggaggaactgtacatggcccacagcagaaaggacatgaatgacaccctgacctccgctctcatgggtgcctgcgtcactgcctcggccatgcccagcagactgatgatggagcatgttctcttagtcagcatccttcaccacacagttggaatcgaggtcggtgcccactttctggaggcagtggtgaggaagttcgatgccatctataaatacggaagcgaagggaaagagtgtgacaacctgttcaccgtcattgcccatttatacaacttccacgtggtacagtctctcctcatcttcgacattttgaaaaaactgattggaactttcaccgaaaaagatattgaactgatcttgttaatgctgaaaaacgtgggtttttcattgaggaaagatgatgctttatcacttaaggaattgatcactgaagcccagaccaaagccagcggggcaggcagcgagtttcaggaccagaccaggattcggtttatgctagagacgatgttggccctgaagaacaatgacatgcgcaaaattccaggctatgaccccgagcccgtggagaagctgaggaaactgcagagagctttggtccgcaacgccggctcaggttctgagacgcagcttcgcgtctcctgggacagtgtcttgagtgcggagcagacgggtcgctggtggattgtggggtccgcctggagtggggccccgatgatcgacaacagtcaccatacgcacctgcagaagcagcttgtggggacggtcagttcaaagatcctagaactcgcccggaagcagaggatgaacacagacatccggagaaacatattctgcacaataatgacaagtgaagattttttggatgcttttgaaaagcttctgaagcttggacttaaggatcagcaggagagagaaatcattcacgttctcatggattgctgccttcaagagaaaacttacaatcccttctatgctttcctggctagcaaattctgtgaatatgaaaggagatttcagatgactttccagttcagcatatgggacaaatttcgggacttggaaaacttgccagctacgaatttctctaatttggttcatctggtggcccacttgttgaagacaaaatcgctttccctttccatcttaaaggtagttgaattcagtgaattggacaaacccagagtccgttttttacgaaaagtattaagtatcctattaatggaaacagaagttgaagacctcagtttaattttcacaagagtatctgacaacccaaagctgggggtgttacgtgagggtttgaagcttttcatcagccacttcttgctaaagaacgcacaggcccacagaagcgccgacgaagccaacgtgctgagagagaaagctgaccttgcaacgaagtgtctgcaaggaaaagcttccctgagaatgtagtcagggaaggaaggagggcaggtggccctttgactgtaaaatgtccttggtaaacccaaaggcttattctgttgcctgcgtgtgaatgtttggtagagctatatcattgtctgttaatgtattatattttgagattttttttgatctaaggttttattgtttgtatttcaagccattttcaaataactatcttgggggtgagaggagaaggagggagggaaaaggggtcaggcacactggacagggttctctaagcagtgaggctggtgtgtatgattgtcttaaaattttttaatagatatggccgagcgtgatggctcacccctgtaatcccagcactttgtgaggccaaggtgggcggatcacttgaggccaggaatttgaaaccagcctgggcaaaaccctgtctctactaaaaatataaaaattagccaggcatgatggcacatgctggtaatagcagctactgaggtggctgaggcacaagaattgcttggaccctggaggtagaggctgcagtgagccaagattgtaccactgtactccagcctgggctggacagtgagacttttgacagtgagactgtcaaaaaaaaaaaaaaaattaatagataaaacaggccactagagggtgcagttataaagaaattgatgaggtttttacctttttaaaatattggttagaagttcaaaaaccatcccttaaaggtgattgtttttttgagacagagtcttgctctgtcacccagagtggagtgcagtgtcctgtaatctcagctcactgcaacctctacctcccgggttcaagcgattctcctgcctcagcctctttagctgggactacaggcgcacgccaccacgcccggctaatttttgtattttagtagagatgggtttcaccatgttggcaaggctggtcttgaactcctgacctcaggtgatacacccatctcggcctcccaaagtgctgggattacaggcttgagccaccacgcccagcttaaatgtgattcttgatactgttttaagtatttaggttgcaattaactttggcaaagtcagtcgacataagccctgtggatatggccttatgtacactgtaatgcagacaggtgcttttcatcattcatgtaacattctcacacagttgaggatattcatctcctcaccaattccagattgtaaatgtaccatcttaaacaactctgaggtcaccaaacagtagttatttgactgttaataggtgctacttgcttgcaaggatttggagatgtaaacatgaagaaaatatagttactgcctgcaaagaattaacatccgtctagtgggagaaacaaacacaccccactcactaagtatggaaaactgattctgggaggaagcagaaatgtccctagataacagcatgtattgcagatacccaaatgtttattgttttctcagcccttcaattttgcttttctctctcaaatgctacagactcaatttaaatcttacctttgattgttgaaaaaagtcactaagatgtgaatacagaatagacattgagaggttatatatgtccaaaactcatctgtccagcagtcaccgtcctcttcagagtggtcacgttgggcagatgggcacaggtgctggtgatgcctctcctgggcaaaacgccccatttgtggcactttcagatactatttatttactttttaagagagagacaggctcactctgtcacccaggccagagtgcagtggcacgatcatagttaccgcagcatcaaattcctggactgaagcggtccttttgcctcagcctcgcggatagctaggaccacaagcagtagagacaagatctccgtatgttatacaggctggcctcaagtgatcctcttaccttggcctcccaaacaccgggattataggcgtgagcccccgtgcctggcctcaaattttattttagctcgaccctatggcagtttgtgtttggaaatcgtgatgtgaagtcatcagtatctgtgcatatccctaaactaatggtttaagctttgaagcatgcgcaagcaacatgaacaactgaatacagaaagtaactgaaagcagcacagagactgtgtcgtccctacagacttctaaccctgcattcagcaacatcattcgacccgaagccagattcaaaccctatgtcttctagcaggttctgaatttagaggacaaataaggtgacaggtactaagagaagagtgaattaagtgaaaatcttccctttgttaaggagctttttaacaagagtgtctttgctgggtggtgattgggatgtaacagatcagttctactggacttgtagcttgatagtgaaataaggagcttgggctaaggtataaatcaacacactgcttccttcctccagaaggtcttactgtgaaggaaaaaatgtcagttgaactaaattgtgcttcacgcctcggtagatttgcattctgatgcaagcccccaacctcacggaccaagaggatccctggctgcctgtgaatggcccacatttgagtggtgctaacttgatgtgagtaggcattaattatgggtgcggctactaagatgggaaaaactatcacgacagtggcaccacctgatttcatgatgtaccatatgcagtaacccatgtttgaggtacagaattgaagctgatttttctgcaaaagatgaatttctataaacaatcccatttttatattttattattaaaacaaaaatacctctctttgctagagagttatatgtatgacttaaattattagctatggtttgcatttagtacatggcagattgcctgtaagtctgttcattttaacaacatacagggctgggcacggtggctcacgcctgtaatcccagcactttgggaggttgcgggtggatcacttgaggtcaggagttcgagaccagcctggccaacatggcaaaaccccgtctctatgaaaaatataaaaattagctgggcatggtggcaggcacctgtaatcccagctactcgggaggctgaggcaggagaatcgcttgaacctgggaggcggatgttgcagtgagcagagatcgtgccattgcactccagcctgggaacaagagtgaaactctcaaaagcagaaacaaaaacccaacatatatgggctgttagatagtaattgtaatttcgtataaatagtaaatgagtacatcttgattaaaagctatgaattcagaattgcttttaaatatatagggggttttttgaaatttattacagtgcaattgaaaatacacttaaaatactgcaggatgcttagtgctcagtgttatgtatgaacttgtggactttacaatgcaggttgagaactgctaatgtatagaatgactaaacagctgtctttcagggtatcatttttaaaggtataaggaacaaactttaatgtattgaaatgcataaataaaatttattttttatattttgtttaga

SEQ ID NO: 1522 - DNA, 5356 bp, Homo sapiens
tagggcgagcgggcgcgcgaagatggcggcggccgccggcgggccgtgtgtgaggagcagtagagaactgtggactattctgcttggaaggtcagctctgagagagctgagtcagattgaggcagaactgaataaacattggcggcgattgttagaggggctttcttactacaaacctcccagtccaagttcagctgaaaaagtgaaagctaataaagatgtagcttcaccattgaaggaactgggtttaagaatcagcaagtttttgggtcttgatgaagaacagagtgtgcagttactccagtgttacctgcaagaggactacaggggtactcgggactcagtaaagacagtattatactttgagatggcacccagtgacttacttgtattaaccaagatgtttaaagagcaaggatttggtagtaggcagaccaataggcacctggtggatgagactatggatccttttgtagatcggattggctacttcagtgccctcatcctggtggagggcatggatatcgagtccttgcataagtgtgctttggatgacagaagagaactgcatcagtttgcgcaggatgggcttatttgtcaggatatggactgtttaatgttgacctttggggacattccacatcatgccccagtgcttttggcctgggctctcctccgtcacactctgaacccagaagagacaagcagtgtggtccggaagataggtggcacagccatccagctgaatgtgtttcagtacttgacccgattgctccagtcccttgccagtgggggaaatgattgcaccaccagcactgcatgcatgtgtgtctatggactgctctctttcgttctgacctcgttggagctgcacaccctgggcaatcagcaggatataattgatacagcatgtgaagtattggccgacccttctcttccggaactgttctggggaacagagccaacttctggccttgggatcattctggacagtgtgtgtggaatgtttccccaccttctctccccactcctgcaactgctccgagccctggtatcagggaagtccacagccaaaaaggtgtatagcttcttggataagatgtctttctacaatgaactttataaacacaagcctcatgatgtgatctcccatgaagatggaactctttggcggagacaaacacccaaactcctttatccccttgggggtcaaaccaaccttcgcatacctcaaggcactgtgggccaagtaatgttggatgatagggcatacctggtacgctgggaatactcctatagcagctggaccctctttacctgcgagattgaaatgttgcttcatgttgtttcaactgcagatgtgattcagcactgccagcgagtcaaacccatcattgatctcgtccataaggtcatcagtacagacctgtcgatagcagactgtctcctgcccatcacatctcgcatctacatgctgctgcagcggttaacgacagtgatctccccacctgtggatgtcattgcttcttgtgtcaactgcttaactgttttggctgcccgcaatccagcaaaggtctggactgatcttcgtcacacaggttttttaccatttgtggcccatcctgtctccagcctgagtcagatgattagtgcggaagggatgaatgctggagggtacggaaacctcttgatgaacagtgaacagcctcagggcgagtatggggttactattgcctttctgcgcttgatcaccacccttgtcaaggggcaacttggtagtacccagagccaaggacttgtaccctgtgtaatgtttgtgctgaaggagatgcttcccagctaccataagtggcgctacaactctcatggagtgagggaacagattggttgcctgatcttggagctgattcatgcgatactgaacctgtgccacgagacagacctgcacagcagtcatactcccagcctgcagtttctctgcatctgcagcctggcatacacagaagcaggacagacagttatcaatatcatgggcattggcgtggacaccattgacatggtgatggctgctcagcctcgaagtgatggggcagagggccaggggcagggccagctgctgatcaagacagtgaaactggcattctccgtcaccaacaatgttattcggctgaaacctccttctaatgtggtgtcccccctggaacaggctctctcacaacatggtgctcatggaaacaacctcattgctgttctagccaaatacatctaccacaaacatgaccctgctttgccacgtcttgccattcagctgctgaaacgtctggccacggtggccccaatgtcagtgtatgcttgtctgggcaatgatgcggctgccattcgtgatgccttcctgacccgattgcagagcaaaattgaggacatgcgcatcaaagtcatgattctagagttcctcactgttgcagtagagacccagccaggcctcatcgaactgtttctgaacctggaagttaaggatggcagtgatggctcaaaggaattcagccttgggatgtggagctgtctccatgcagtgctggagctgattgattcccaacagcaagatcgatactggtgcccacccctgctgcatcgtgccgccattgcctttttgcatgctctgtggcaggatcggagggacagtgccatgctggtcctccgaaccaaacccaagttttgggaaaatttaaccagtccgctgtttggaaccctttctcctccctctgaaacatcagagcccagcatcctggaaacctgtgccctaatcatgaagataatttgcttggagatatactatgtagtaaagggttcattagaccagtcattaaaggatacactgaagaaattttccatcgagaaacgctttgcctactggtcagggtatgtcaagtcattggcagttcacgtggccgaaacagaaggcagcagctgcacctccttgttagagtaccagatgctggtgtccgcctggaggatgcttctcatcattgccaccactcatgcagatataatgcacctgactgactctgtggtgcgtcgccagctctttcttgacgtgcttgatggaaccaaagcattactcctagttccagcctcagtgaactgccttcgccttggctccatgaagtgcactctgctgcttatcctcctccggcagtggaagagagagttaggttctgtggatgaaatccttggacccttgacggagatcctggagggagtgctgcaggccgaccagcaactcatggagaagaccaaggccaaggtgttctcagcattcatcacagtgttgcaaatgaaggagatgaaagtaagtgacatcccccagtactcccagctggtgctgaatgtctgtgagaccctccaagaggaagtgattgcactcttcgaccagacccgccacagtctggcattaggcagtgccacagaggacaaggacagcatggagactgacgactgttctcggtcccggcacagggaccagcgtgatggggtgtgtgtcctgggcctgcacctggccaaggagctgtgtgaggtagacgaggatggtgactcctggctgcaggtaacccgcaggctccccatcctacccaccctcctcaccactctagaggtgagccttcgcatgaagcagaacctgcatttcactgaggccacattgcatctgctcctcaccctggctcgcactcagcagggagccacagcagtggctggagctggcatcacccagagcatttgtttgccccttctgagtgtgtaccagctgagcaccaacggcacagcacagacacctagtgcctctcggaagtccctggatgccccctcttggccaggagtctaccgcctgtccatgtccctgatggagcagctgctcaaaactctgcgctacaacttcctgcctgaggccctggacttcgtgggtgtccaccaggagcggaccttacagtgcctcaacgcagtgaggacagtgcagagtctggcctgcctggaggaggcggaccacaccgtgggttttattctgcagctctctaacttcatgaaggagtggcacttccacctgcctcagctcatgcgtgatatccaggtcaacctgggttacttgtgccaggcatgtacctctctcctgcacagtcgaaagatgctgcagcattacttacagaacaaaaatggggatggcctcccctcagctgttgcccagcgagtccagaggccaccgtctgctgcttctgctgccccctcctcctcaaagcagcccgctgctgacacagaggcatcagagcagcaggccttgcacacagtccagtatggccttctcaagatcctcagcaagacgctggcagccctgcgccacttcaccccagatgtctgccagattctgctggatcagtccctggaccttgctgaatacaacttcctgtttgccctgagctttaccactcccacctttgactccgaagtggccccctccttcgggacccttctggccacagtgaatgtggccctcaacatgcttggagagctggacaagaaaaaggagcccctcacccaggcagtggggctcagcacacaggcagaagggaccaggacgttaaagtccctcctgatgtttaccatggaaaactgcttctacctgctcatctctcaggcgatgcggtaccttagggacccggctgtgcacccccgggacaaacagcggatgaagcaggagctcagctctgagttgagcacgctgctgtccagcctctcgcgctacttccgccggggagcccccagctcccctgccactggtgtcctcccctcgccgcagggcaagtccacctctctctccaaagccagccctgagagtcaggagcctctgatccagttggtgcaggcgtttgtccggcatatgcaaagatagggcagtgctgttctgcccacctacccctctccaccagcctacactgcaccctggctggcaggggtgctgctggctgctagggcctatacaatggagggcacctcctgtcacccccctcccggagtagccacgactccagccaccacccactgacgttatttttatactagatgaagaggtcaacagcaggcatggggagccgagtcttctgtgctcaggtcctcacgctgcagacgccccctagaggaactttccttcctttccagcattccccacagcactgccggccaggggagaggcggcagcccagcagagggctctatgcacgggtttcaaacctgttttccacactctgtctttgcagttttggtaattctgtggtctatttatacagatattaaaatcttgtttatagac

SEQ ID NO: 1523 - DNA, 5689 bp, Homo sapiens
agggcgagcgggcgcgcgaagatggcggcggccgccggcgggccgtgtgtgaggagcagtagagaactgtggactattctgcttggaaggtcagctctgagagagctgagtcagattgaggcagaactgaataaacattggcggcgattgttagaggggctttcttactacaaacctcccagtccaagttcagctgaaaaagtgaaagctaataaagatgtagcttcaccattgaaggaactgggtttaagaatcagcaagtttttgggtcttgatgaagaacagagtgtgcagttactccagtgttacctgcaagaggactacaggggtactcgggactcagtaaagacagtactgcaagatgagaggcagagccaggccttaatcctgaagattgcagattattattatgaagaaagaacctgtattcttcgttgtgtcttacaccttctcacttacttccaagatgaaagacacccctatagggttgaatatgcagactgtgttgataaattggagaaggaactagtttcaaaatacagacagcagttcgaagagctttataaaactgaagcaccaacttgggagacacatggaaatctcatgacagagcgccaagtgtctcgctggtttgttcagtgccttcgggaacagtccatgctgctagaaattattttcctttattatgcatactttgagatggcacccagtgacttacttgtattaaccaagatgtttaaagagcaaggatttggtagtaggcagaccaataggcacctggtggatgagactatggatccttttgtagatcggattggctacttcagtgccctcatcctggtggagggcatggatatcgagtccttgcataagtgtgctttggatgacagaagagaactgcatcagtttgcgcaggatgggcttatttgtcaggatatggactgtttaatgttgacctttggggacattccacatcatgccccagtgcttttggcctgggctctcctccgtcacactctgaacccagaagagacaagcagtgtggtccggaagataggtggcacagccatccagctgaatgtgtttcagtacttgacccgattgctccagtcccttgccagtgggggaaatgattgcaccaccagcactgcatgcatgtgtgtctatggactgctctctttcgttctgacctcgttggagctgcacaccctgggcaatcagcaggatataattgatacagcatgtgaagtattggccgacccttctcttccggaactgttctggggaacagagccaacttctggccttgggatcattctggacagtgtgtgtggaatgtttccccaccttctctccccactcctgcaactgctccgagccctggtatcagggaagtccacagccaaaaaggtgtatagcttcttggataagatgtctttctacaatgaactttataaacacaagcctcatgatgtgatctcccatgaagatggaactctttggcggagacaaacacccaaactcctttatccccttgggggtcaaaccaaccttcgcatacctcaaggcactgtgggccaagtaatgttggatgatagggcatacctggtacgctgggaatactcctatagcagctggaccctctttacctgcgagattgaaatgttgcttcatgttgtttcaactgcagatgtgattcagcactgccagcgagtcaaacccatcattgatctcgtccataaggtcatcagtacagacctgtcgatagcagactgtctcctgcccatcacatctcgcatctacatgctgctgcagcggttaacgacagtgatctccccacctgtggatgtcattgcttcttgtgtcaactgcttaactgttttggctgcccgcaatccagcaaaggtctggactgatcttcgtcacacaggttttttaccatttgtggcccatcctgtctccagcctgagtcagatgattagtgcggaagggatgaatgctggagggtacggaaacctcttgatgaacagtgaacagcctcagggcgagtatggggttactattgcctttctgcgcttgatcaccacccttgtcaaggggcaacttggtagtacccagagccaaggacttgtaccctgtgtaatgtttgtgctgaaggagatgcttcccagctaccataagtggcgctacaactctcatggagtgagggaacagattggttgcctgatcttggagctgattcatgcgatactgaacctgtgccacgagacagacctgcacagcagtcatactcccagcctgcagtttctctgcatctgcagcctggcatacacagaagcaggacagacagttatcaatatcatgggcattggcgtggacaccattgacatggtgatggctgctcagcctcgaagtgatggggcagagggccaggggcagggccagctgctgatcaagacagtgaaactggcattctccgtcaccaacaatgttattcggctgaaacctccttctaatgtggtgtcccccctggaacaggctctctcacaacatggtgctcatggaaacaacctcattgctgttctagccaaatacatctaccacaaacatgaccctgctttgccacgtcttgccattcagctgctgaaacgtctggccacggtggccccaatgtcagtgtatgcttgtctgggcaatgatgcggctgccattcgtgatgccttcctgacccgattgcagagcaaaattgaggacatgcgcatcaaagtcatgattctagagttcctcactgttgcagtagagacccagccaggcctcatcgaactgtttctgaacctggaagttaaggatggcagtgatggctcaaaggaattcagccttgggatgtggagctgtctccatgcagtgctggagctgattgattcccaacagcaagatcgatactggtgcccacccctgctgcatcgtgccgccattgcctttttgcatgctctgtggcaggatcggagggacagtgccatgctggtcctccgaaccaaacccaagttttgggaaaatttaaccagtccgctgtttggaaccctttctcctccctctgaaacatcagagcccagcatcctggaaacctgtgccctaatcatgaagataatttgcttggagatatactatgtagtaaagggttcattagaccagtcattaaaggatacactgaagaaattttccatcgagaaacgctttgcctactggtcagggtatgtcaagtcattggcagttcacgtggccgaaacagaaggcagcagctgcacctccttgttagagtaccagatgctggtgtccgcctggaggatgcttctcatcattgccaccactcatgcagatataatgcacctgactgactctgtggtgcgtcgccagctctttcttgacgtgcttgatggaaccaaagcattactcctagttccagcctcagtgaactgccttcgccttggctccatgaagtgcactctgctgcttatcctcctccggcagtggaagagagagttaggttctgtggatgaaatccttggacccttgacggagatcctggagggagtgctgcaggccgaccagcaactcatggagaagaccaaggccaaggtgttctcagcattcatcacagtgttgcaaatgaaggagatgaaagtaagtgacatcccccagtactcccagctggtgctgaatgtctgtgagaccctccaagaggaagtgattgcactcttcgaccagacccgccacagtctggcattaggcagtgccacagaggacaaggacagcatggagactgacgactgttctcggtcccggcacagggaccagcgtgatggggtgtgtgtcctgggcctgcacctggccaaggagctgtgtgaggtagacgaggatggtgactcctggctgcaggtaacccgcaggctccccatcctacccaccctcctcaccactctagaggtgagccttcgcatgaagcagaacctgcatttcactgaggccacattgcatctgctcctcaccctggctcgcactcagcagggagccacagcagtggctggagctggcatcacccagagcatttgtttgccccttctgagtgtgtaccagctgagcaccaacggcacagcacagacacctagtgcctctcggaagtccctggatgccccctcttggccaggagtctaccgcctgtccatgtccctgatggagcagctgctcaaaactctgcgctacaacttcctgcctgaggccctggacttcgtgggtgtccaccaggagcggaccttacagtgcctcaacgcagtgaggacagtgcagagtctggcctgcctggaggaggcggaccacaccgtgggttttattctgcagctctctaacttcatgaaggagtggcacttccacctgcctcagctcatgcgtgatatccaggtcaacctgggttacttgtgccaggcatgtacctctctcctgcacagtcgaaagatgctgcagcattacttacagaacaaaaatggggatggcctcccctcagctgttgcccagcgagtccagaggccaccgtctgctgcttctgctgccccctcctcctcaaagcagcccgctgctgacacagaggcatcagagcagcaggccttgcacacagtccagtatggccttctcaagatcctcagcaagacgctggcagccctgcgccacttcaccccagatgtctgccagattctgctggatcagtccctggaccttgctgaatacaacttcctgtttgccctgagctttaccactcccacctttgactccgaagtggccccctccttcgggacccttctggccacagtgaatgtggccctcaacatgcttggagagctggacaagaaaaaggagcccctcacccaggcagtggggctcagcacacaggcagaagggaccaggacgttaaagtccctcctgatgtttaccatggaaaactgcttctacctgctcatctctcaggcgatgcggtaccttagggacccggctgtgcacccccgggacaaacagcggatgaagcaggagctcagctctgagttgagcacgctgctgtccagcctctcgcgctacttccgccggggagcccccagctcccctgccactggtgtcctcccctcgccgcagggcaagtccacctctctctccaaagccagccctgagagtcaggagcctctgatccagttggtgcaggcgtttgtccggcatatgcaaagatagggcagtgctgttctgcccacctacccctctccaccagcctacactgcaccctggctggcaggggtgctgctggctgctagggcctatacaatggagggcacctcctgtcacccccctcccggagtagccacgactccagccaccacccactgacgttatttttatactagatgaagaggtcaacagcaggcatggggagccgagtcttctgtgctcaggtcctcacgctgcagacgccccctagaggaactttccttcctttccagcattccccacagcactgccggccaggggagaggcggcagcccagcagagggctctatgcacgggtttcaaacctgttttccacactctgtctttgcagttttggtaattctgtggtctatttatacagatattaaaatcttgtttatagaca

SEQ ID NO: 1524 - DNA, 1608 bp, Homo sapiens
aagcctcagtctcggttagcttcacttcagcgggaacctgcccactaaggaggccgattctttccggctcgagcaggtccggacccgcccctctggcgtctagcagtctcggaggcctgcccgtatagttcagggccggacagcgagcggcggcgacttgccagtaagggtttggagtcatcagcaggtttaattttggaggaactttacaggtttggctccagcagctgctgttgccaccaccactagttcaagcaccatgcagtttacctcaatatcaaattctttgacctccactgctgctattgggctctcatttacaacttcaacgactaccaccgccactttcaccaccaacactactaccacaatcaccagtggctttactgtgaaccaaaaccaactgttatcaagagggtttgaaaaccttgtaccttatacttcaactgttagattcgtattttacatggagaagtgaacaaagtgaaactggatcagaaaagattggaacaagaattggattttatcctgtcacagcagcaggaactagaatttctgttgacttatttagaggagtctacgcgtgaccagagtggacttcattatctgcaggatgcagatgaggagcatgtggagatctccaccagatctgcagaattctgaatgcccatatggactccctgcagtggattgatcggaattcaggcatgctgcgaaggaaggtagaagtggtaacacgggttttcgaggattatcgtcacgaggagcatgcacacaatgtcaacactgctttttagtgaatgaccatatcttcagcatgtcgtttctggattattacctacaaattctgatgttaaatagagtagtatttatacttaatatttcatcttgatcataatgaattgtgcatcctttttttcatttaagtattgtactgttgagaattataccttagttttgtttttagtattagaaaatcaaaattatactagcccctttgtccagacagcaacctcttagatgctgactctatatgtgtaatttatgtcttactctccctggcatcagtacacatcatccttctcactccagttgaatcatagggtgatgtctgccaaaagtacatgccaacctatatagtgctagatactgtaaagtctcttctcctcaaaggaacctactgtctagtttgagatataattaatgcttgtctgcataaaaacaatatagataatataaagaagtgcagtatgaattatagaaagtgtgttatagagattcagagcagggaggaaaagttagggtagattattattaaagggttaaggaaaggtaagtttcaaggaatttggttatttttaatgtatggatatactggcattttatttggttttagcatatgatttatagttggtgatttccgtatatttgtttgtttttctttttttttgtttgtttgttttgttttgttttaaataagccttgttcttaggtttggaacagtctggtctcctgtgtttcatgtttcacctaagtcataaataaaggtaatgtcctaaaaaaaaacatgtaatactgaaattaactattaaaagtttttaagtgact

SEQ ID NO: 1525 - DNA, 1871 bp, Homo sapiens
aagcctcagtctcggttagcttcacttcagcgggaacctgcccactaaggaggccgattctttccggctcgagcaggtccggacccgcccctctggcgtctagcagtctcggaggcctgcccgtatagttcagggccggacagcgagcggcggcgacttgccagtaagggtttggagtcatcagcaggtttaattttggaggaactttacaggtttggctccagcagctgctgttgccaccaccactagttcaagcaccatgcagtttacctcaatatcaaattctttgacctccactgctgctattgggctctcatttacaacttcaacgactaccaccgccactttcaccaccaacactactaccacaatcaccagtggctttactgtgaaccaaaaccaactgttatcaagagggtttgaaaaccttgtaccttatacttcaactgttagtgtagtagcaactcctgtgatgacatatggtcatctggagggtcttataaatgagtggaaccttgagctggaagatcaagagaagtactttcttctccaggccactcaggtcaatgcttgggaccatacattgattgagaatggtgagatgattcgtattttacatggagaagtgaacaaagtgaaactggatcagaaaagattggaacaagaattggattttatcctgtcacagcagcaggaactagaatttctgttgacttatttagaggagtctacgcgtgaccagagtggacttcattatctgcaggatgcagatgaggagcatgtggagatttacagattagcagaaagtatagatgctcagctgaaacaaatggcccaagatctcaaggacgttgttaatcacctgaatacatttgaaagttcttctgacactactgatccgctccaccagatctgcagaattctgaatgcccatatggactccctgcagtggattgatcggaattcaggcatgctgcgaaggaaggtagaagtggtaacacgggttttcgaggattatcgtcacgaggagcatgcacacaatgtcaacactgctttttagtgaatgaccatatcttcagcatgtcgtttctggattattacctacaaattctgatgttaaatagagtagtatttatacttaatatttcatcttgatcataatgaattgtgcatcctttttttcatttaagtattgtactgttgagaattataccttagttttgtttttagtattagaaaatcaaaattatactagcccctttgtccagacagcaacctcttagatgctgactctatatgtgtaatttatgtcttactctccctggcatcagtacacatcatccttctcactccagttgaatcatagggtgatgtctgccaaaagtacatgccaacctatatagtgctagatactgtaaagtctcttctcctcaaaggaacctactgtctagtttgagatataattaatgcttgtctgcataaaaacaatatagataatataaagaagtgcagtatgaattatagaaagtgtgttatagagattcagagcagggaggaaaagttagggtagattattattaaagggttaaggaaaggtaagtttcaaggaatttggttatttttaatgtatggatatactggcattttatttggttttagcatatgatttatagttggtgatttccgtatatttgtttgtttttctttttttttgtttgtttgttttgttttgttttaaataagccttgttcttaggtttggaacagtctggtctcctgtgtttcatgtttcacctaagtcataaataaaggtaatgtcctaaaaaaaaacatgtaatactgaaattaactattaaaagtttttaagtgact

SEQ ID NO: 1526 - DNA, 1755 bp, Homo sapiens
agtctcggttagcttcacttcagcgggaacctgcccactaaggaggccgattctttccggctcgagcaggtccggacccgcccctctggcgtctagcagtctcggaggcctgcccgtatagttcagggccggacagcgagcggcggcgacttgccagtaagggtttggagtcatcagcaggtttaattttggaggaactttacaggtttggctccagcagctgctgttgccaccaccactagttcaagcaccatgcagtttacctcaatatcaaattctttgacctccactgctgctattgggctctcatttacaacttcaacgactaccaccgccactttcaccaccaacactactaccacaatcaccagtggctttactgtgaaccaaaaccaactgttatcaagagggtttgaaaaccttgtaccttatacttcaactgttagtgtagtagcaactcctgtgatgacatatggtcatctggagggtcttataaatgagtggaaccttgagctggaagatcaagagaagtactttcttctccaggccactcaggtcaatgcttgggaccatacattgattgagaatggtgagatgattcgtattttacatggagaagtgaacaaagtgaaactggatcagaaaagattggaacaagaattggattttatcctgtcacagcagcaggaactagaatttctgttgacttatttagaggagtctacgcgtgaccagagtggacttcattatctgcaggatgcagatgaggagcatgtggagatctccaccagatctgcagaattctgaatgcccatatggactccctgcagtggattgatcggaattcaggcatgctgcgaaggaaggtagaagtggtaacacgggttttcgaggattatcgtcacgaggagcatgcacacaatgtcaacactgctttttagtgaatgaccatatcttcagcatgtcgtttctggattattacctacaaattctgatgttaaatagagtagtatttatacttaatatttcatcttgatcataatgaattgtgcatcctttttttcatttaagtattgtactgttgagaattataccttagttttgtttttagtattagaaaatcaaaattatactagcccctttgtccagacagcaacctcttagatgctgactctatatgtgtaatttatgtcttactctccctggcatcagtacacatcatccttctcactccagttgaatcatagggtgatgtctgccaaaagtacatgccaacctatatagtgctagatactgtaaagtctcttctcctcaaaggaacctactgtctagtttgagatataattaatgcttgtctgcataaaaacaatatagataatataaagaagtgcagtatgaattatagaaagtgtgttatagagattcagagcagggaggaaaagttagggtagattattattaaagggttaaggaaaggtaagtttcaaggaatttggttatttttaatgtatggatatactggcattttatttggttttagcatatgatttatagttggtgatttccgtatatttgtttgtttttctttttttttgtttgtttgttttgttttgttttaaataagccttgttcttaggtttggaacagtctggtctcctgtgtttcatgtttcacctaagtcataaataaaggtaatgtcctaaaaaaaaacatgtaatactgaaattaactattaaaagtttttaagtgactaga

SEQ ID NO: 1527 - DNA, 618 bp, Homo sapiens
agtctcggttagcttcacttcagcgggaacctgcccactaaggaggccgattctttccggctcgagcaggtccggacccgcccctctggcgtctagcagtctcggaggcctgcccgtatagttcagggccggacagcgagcggcggcgacttgccagtaaggtttggctccagcagctgctgttgccaccaccactagttcaagcaccatgcagtttacctcaatatcaaattctttgacctccactgctgctattgggctctcatttacaacttcaacgactaccaccgccactttcaccaccaacactactaccacaatcaccagtggctttactgtgaaccaaaaccaactgttatcaagagggtttgaaaaccttgtaccttatacttcaactgttagtgtagtagcaactcctgtgatgacatatggtcatctggagggtcttataaatgagtggaaccttgagctggaagatcaagagaagtactttcttctccaggccactcaggtcaatgcttgggaccatacattgattgagaatggtgagatgattcgtattttacatggagaagtgaacaaagtgaaactggatcagaaaagattggaacaagaatt

SEQ ID NO: 1528 - DNA, 688 bp, Homo sapiens
tcctgtgatgacatatggtcatctggagggtcttataaatgagtggaaccttgagctggaagatcaagagaagtactttcttctccaggccactcaggtcaatgcttgggaccatacattgattgagaatggtgagatgattcgtattttacatggagaagtgaacaaagtgaaactggatcagaaaagattggaacaagaattggattttatcctgtcacagcagcaggaactagaatttctgttgacttatttagaggagtctacgcgtgaccagagtggacttcattatctgcaggatgcagatgaggagcatgtggagatttacagattagcagaaagtatagatgctcagctgaaacaaatggcccaagatctcaaggacgttgttaatcacctgaatacatttgaaagttcttctgacactactgatccgctccaccagatctgcagaattctgaatgcccatatggactccctgcagtggattgatcggaattcaggcatgctgcgaaggaaggtagaagtggtaacacgggttttcgaggattatcgtcacgaggagcatgcacacaatgtcaacactgctttttagtgaatgaccatatcttcagcatgtcgtttctggattattacctacaaattctgatgttaaatagagtagtatttatacttaatatttcatctt

SEQ ID NO: 1529 - DNA, 2550 bp, Homo sapiens
tgatagctgcgtaatcatactgcggcaccgtttttttcttgcagcagtagctgcttgcggaggaggtctgcccactgcagctctctgcagtctccggctctctcctgcaggatcggtcaacgcagccgtcgccgccctctgcacccagcccaggtcgccactgcttcagtccggttctcaaagcctcagcaccatcttttatccccgagcagcctggatcgtcgttccctcagtccggacgccactgctaggtccgaccaccgccgcttctgatatttcggtgagtcttttcctgtggaggtttggtctcccgatctctgtggtagccaccttaggcgtgtacggtcctttgaaaaatggccgagtcagagaaccgcaaggagctgtcagaatccagtcaagaagaggctggtaatcagataatggtggaagggctcggggaacatctggagcgcggtgaagatgccgctgctgggcttggagacgatgggaagtgcggtgaagaagctgccgctgggcttggggaagaaggggaaaacggtgaagatactgctgctgggtccggggaagatgggaaaaaaggtggcgatactgatgaggactcagaggcagaccgtccaaaaggacttatcggttatgttttagatacagactttgttgaaagtctacctgtgaaagttaagtaccgtgtgttagcccttaaaaagcttcaaactagagcggccaatttagaatccaaattcctgagggaatttcatgacattgaaagaaagtttgctgaaatgtaccaacccttactggaaaaaagacgtcagatcatcaatgcaatctatgaacctacagaagaggaatgtgaatataaatcagactctgaggactgtgatgatgaggaaatgtgtcatgaagagatgtatggtaatgaggagggtatggtacatgaatatgtggatgaggacgatggttatgaggactattattatgattatgctgtggaagaggaggaggaggaggaggaggaggacgacattgaggctactggagaagagaataaagaagaggaggatcctaagggaattcctgatttttggctaactgttttaaaaaacgttgatacactcactcctttgattaagaaatatgatgagcctattctgaagctcctgacagatattaaagttaagctttcagatcctggcgagcccctcagtttcacactagaatttcacttcaaacccaatgaatatttcaaaaatgagttgttgacaaagacctatgtgctgaagtcaaagctagcatattatgatccccatccctataggggaactgcgattgagtattccacaggctgtgagatagattggaatgaaggaaagaatgtcactttgaaaaccatcaagaagaaacagaaacatcggatctggggaacaatccgaactgtaactgaagattttcccaaggattcatttttcaattttttctctcctcatggaatcacctcaaatggaagggatggaaatgatgattttttacttggtcacaatttacgtacttacataattccaagatcagtattatttttctcaggtgatgcactggaatctcagcaggagggggtagttagagaagttaatgatgcaatttatgacaaaattatttatgataattggatggctgcaattgaggaagttaaagcttgttgcaaaaaccttgaggcattagtagaagacattgatcgttagagcagagtatacatggccctgaaattaactgccctagatatagttactcaaggtataagaagccttgtgttctgtatttttcttgtagtgttagttaaaacatatgtttcaaaaatataagaaaagttcaaaaactaattaatttgaccttgagttttagtagtagaatgttttcaagaaatgtacactgtggtaaatgatttaaaacactagtatagtgttgtgtagcttaatccttctgaagtctttttgtcatgtagctattaatctgtggctatgaaatgatcagaaatgctaagtgagatcaatatttgtttggaaaaaaaatcttgggaaacaacccaagggttttcgctgttgttgtttttctttttctatttttgtttacttagtcctttagctagtggatttaattttgttgtgcctgcttcattttgcaataacaatgcagtagaatttaaaacttggatgcttaagaggcctgcatatagataagaatttcaggcaaaactacatttattgttaataacagcttgttcataggctcttgtattttatgtaactgtgataaataatgaaacttagttatattgaggttattgtttgtcggtgaagtgttagtcacagtattttcaaaagtttgcacatattgttctgtgtaattgtgtaagccataattacagtgtttaattctcttttcctattacatcattcattgaaagtgatcactttaccattttgaaaagatatttcgtgttctttcactgcaaaataaaaagaataaaaatttcagagtgtctcatgtttaaaa

SEQ ID NO: 1530 - DNA, 1812 bp, Homo sapiens
atactgcggcaccgtttttttcttgcagcagtagctgcttgcggaggaggtctgcccactgcagctctctgcagtctccggctctctcctgcaggatcggtcaacgcagccgtcgccgccctctgcacccagcccaggtcgccactgcttcagtccggttctcaaagcctcagcaccatcttttatccccgagcagcctggatcgtcgttccctcagtccggacgccactgctaggtccgaccaccgccgcttctgatatttcgatacagactttgttgaaagtctacctgtgaaagttaagtaccgtgtgttagcccttaaaaagcttcaaactagagcggccaatttagaatccaaattcctgagggaatttcatgacattgaaagaaagtttgctgaaatgtaccaacccttactggaaaaaagacgtcagatcatcaatgcaatctatgaacctacagaagaggaatgtgaatataaatcagactctgaggactgtgatgatgaggaaatgtgtcatgaagagatgtatggtaatgaggagggtatggtacatgaatatgtggatgaggacgatggttatgaggactattattatgattatgctgtggaagaggaggaggaggaggaggaggaggacgacattgaggctactggagaagagaataaagaagaggaggatcctaagggaattcctgatttttggctaactgttttaaaaaacgttgatacactcactcctttgattaagaaatatgatgagcctattctgaagctcctgacagatattaaagttaagctttcagatcctggcgagcccctcagtttcacactagaatttcacttcaaacccaatgaatatttcaaaaatgagttgttgacaaagacctatgtgctgaagtcaaagctagcatattatgatccccatccctataggggaactgcgattgagtattccacaggctgtgagatagattggaatgaaggaaagaatgtcactttgaaaaccatcaagaagaaacagaaacatcggatctggggaacaatccgaactgtaactgaagattttcccaaggattcatttttcaattttttctctcctcatggaatcacctcaaatggaagggatggaaatgatgattttttacttggtcacaatttacgtacttacataattccaagatcagtattatttttctcaggtgatgcactggaatctcagcaggagggggtagttagagaagttaatgatgcaatttatgacaaaattatttatgataattggatggctgcaattgaggaagttaaagcttgttgcaaaaaccttgaggcattagtagaagacattgatcgttagagcagagtatacatggccctgaaattaactgccctagatatagttactcaaggtataagaagccttgtgttctgtatttttcttgtagtgttagttaaaacatatgtttcaaaaatataagaaaagttcaaaaactaattaatttgaccttgagttttagtagtagaatgttttcaagaaatgtacactgtggtaaatgatttaaaacactagtatagtgttgtgtagcttaatccttctgaagtctttttgtcatgtagctattaatctgtggctatgaaatgatcagaaatgctaagtgagatcaatatttgtttggaaaaaaaatcttgggaaacaacccaagggttttcgctgttgttgtttttctttttctatttttgtttacttagtcctttagctagtggatttaattttgttgtgcctgcttcattttgcaataacaatgcagtag

SEQ ID NO: 1531 - DNA, 6117 bp, Homo sapiens
ccattgggccttcgggacagcagaggagcagtgtccggccatggccggagcccgcaggctggagctaggcgaggccctggcgctggggtcgggctggcgtcatgcgtgccacgctctcctctacgcgccggaccctgggatgctcttcggccgcatcccgctgcgctacgccatactgatgcagatgcgcttcgatggacgcctgggcttccccggcggattcgtggacacgcaggacagaagcctagaggacgggctgaaccgcgagctgcgcgaggagctgggcgaagcggctgccgctttccgcgtggagcgcactgactaccgcagctcccacgtcgggtcagggccacgcgttgtggcccacttctatgccaagcgtctgacgctcgaggagctgttggctgtggaggccggcgcaacacgcgccaaggaccacgggctggaggtgctgggcctggtgcgagtgcccctgtataccctgcgggatggtgtaggaggcctgcctaccttcctggagaattcctttattggctctgcgcgggagcagttacttgaagctctccaggacttgggactgctgcagtctggctctatttcaggccttaagattccagctcatcactagaggcagccctccatggacccatgaaaactgagatgaggaccttggtactagggagggagggaaggacgtgggaatgttttcttattggatctgagagatgatacatgataccagatgaaaagaaggagaagtgtgtaccatatgttttgagcagaggaccctccaacttatggcatcaggggcaaaaagtcacagcttatcccaggcaccctggcaggttctcagagcctgcctcctccctgtttatatgcgtacagcctggtaacccccaggcatgcaaatatacaatctgtaacaacacacagcctgacaccttcccctggtcatgtccagtttaaccttgaagtggcatttgtcacactaccctggtccctgattgcaaggagcttctgaagcaagggtgaatccttcccacactcctccatggttgccctccagggtctagcccagcctatttgttagggaggatagagaaacagagcaccccctgtgctttctgaaaatagacttgctcttgtcttgagtggtgaccaaagcagttggctcttaaaaggtgggagagcagcccaaccaatccccaatccttttcttctgaaactgagcaggaagggtaaggaagtggctaggtctccttggactgagcatggacatgagtcctgtgaggactggtgtctctcctctagagctttcatctttgggatgcctgagactccgagactatcagaagggaattgacccaccccagtctagcaccaccctgccttcacttcatctacataaaggtggtataaaaacatagactggaggaggtaatccatggagagagaaaaagaagagggctcaggacaaggccctgaggaggcccaatcctaaaagtttgggcagagggaaccaggcacgttaaagaagacagaaagcggactatgcagagtgcttgtgagggtttcactaaaacagaggcaaaactgtccattgaattcagtaacatgaagtgtttgatgactatgatggcagcagtttcaggaagggcggtatggaaggcaggctgtactggttgagtgaatggaaagttggggagtagaacgtgtgagaagttggccttcaaggggctcaggttaataatagagagctatggagtcaaggcatgtttaagatgggaggtagagcatgccaatattgatggcaacagtcaagatggtgtgatgagagagatgggaggggcacaaagaggaggacccctgaaggagcagagtccatgagaaagaaggagggatgggacctttgtaggaagagacacagtcctgcagcctcatatggctcaataaaacagaaaggggcaagtatagaagattaggatgactaaattaatggggaaatgatgaaggagtttgaatctcttctttgtgaaatgaagtgagactatcagctagttgtgggtggagtgtgttctcagaaggtatgaagtagatgttttcctaggtgttggaaaacaggttgattaaggcaacagcagaagggcagggcaaggctgagctctgagatggtcagtttagagtaggatgctgggcactcaggtgtgtgtgtgttgagtggggctctgcacacacctgtcttcccctcatcaggattcaggagctgggatgggtacacttactgcagtgttggggttttgccagggaagtaaaaggagttgagagaaagatgggtcagttcagaagacatacacaggagaaattgtagtgatgaaatgtgcagtctaaggtttaatctgaccaagaaattggaattgaaaacaggaggtgactagggagggattaggaaattagaggtcttgacaagatagaaactccagcatggtgaggggttgggcagggaggtatatttgagccagacaggagtgctttggaaattgagaggtggagcaatctcaggtaaaggcaaaatagagggtatgacctggggttgctggccagagccagggaggagccttaagaagtgaaatctagggttggcgaggctggagggcagggtgagcctccacatgggtgctgaagcaagaaaccgacagatgttgaggagaatggtgtgacctaggagtcagcatccttggtgaacaagaggagtggccacaaggccagtggcacctgccagaggggaaagcaggcatgacaggatagcatctcccaggtgagagccttttgaggaagggagggtgggcagtggtctggaagcttgatgcagagcagtgtgggtcccactggcagcccttggtcttagaagaatgggagtacccagtgggggagcagctgtacaatgaggtagactcctagaggttaattatcatctcctaatcttaccctgacccttttgtcaaacgttatctagattaaacctcagtataggcaggctgcaggaaatggacattccagtggcccctggggttccagcctgtagcagcttcatctgtgctttgtgcacttggttctcagtcatctctgcaagggaccctgacgcctgggagatcagagccactgaccctttatggcactgctaacagaccccttccctcaggtaattctggatccagaactcattatgggatgtaatccaggtcaacactaataccacttggaaggttccgctctgtctcactctgcttgagtatcccactgatcagtctctcagtgcctgcctactgggcagctcatctgtccacttattcgtattaaatttgctttttatttaggtctctggagatggttgcgtggggaagagcccatgactttcctatatgatcccttgaacatactctccaagtcagtagattacctctcaggcagccttcataaaagtgtttcactgtactggggtttgtgttcatctcactcacatagacagtctctgggtaggcaggtggggggtgatacaagttcacactctgtgtttctcctcctgttagccattcccaccctgctgatgtttaaggaaagccagggatgatgacccacttaagctttccttggccttgttaagtccaatcatctggggcaggaagaagagaaatgctcattgcaatctttgacccccactaactgctgtggtgactttgacccaagcccttgacctccttttccttatctgaaatgttgctgtgattcctgtggtgagatcagatgaggcagcacttgggataagcttgcagagatgcattgagcggtatgaaagtacaggatgctatgtactttcctgcttcacagcacattttgtttcttgcaaggtgagtggcccagccgcctctccacaaacacgtgtttctgcctttctcagcataatcagcaagatgttcccacttctcagcattgcacttttctgctggtgcagaataaaaacactttgagccccaccctgtcctgagacaaagtcctctgtggtcacttggcatatggcaaagctgctgctgtgggctggaacatttgaggcaacagtgacttcctcctttcctagttaccggaacccttagagctgggagccggccagtgaaacagacaaggggaggggaagagaagagggaaggcatgtttcctatatgagtttcagtttgttgcacagaaatgtttttgaaacctttatctccaatagaatcacaaacgggtgtcagagagtcaaaactagaggaaaaagtttagtctgtaaacaaatcattagatggcatcagaatttgaaccaaagtaaaagatgctggaccttggcacttatcagagaagtatagaagagccaggtaggggattttatttacaacatgttcaattctgaggaagaggagtatgggcagggcagaggaaaaaggaaaaatgggaaacccccatggacttagggcccccacaaagagaaaccatgtgccttctccccacttcccttctggcttgggcaaatgaggctccctttaggggtagaggtactctacaggggctatgttccctttaggggtagaggtagtctacaggggccagctgggcagagatgaaatcttgcaaaggaacccttcttacactcgaaaagcaagaatagcaaagggactttgggaaggacataaaacaagaaaaggaagctcctcaccaacagctcccagatggagggagtttgtgtgtctagcattttcaccaaagtgctgctcatcctgatgcacagatgcagattggagctgctgcctgtgccctcaccatgggtatgtacccaccacaggcattcccaggtgatgcgggggcagaggattccctctttccactcaggataacaacccctcgatggggttttcaacaagtatagaaagctcctggactcagccaagaccctcacctacagtcccagtcctcccaccttcttcaggtctctagaagacagaactgatgggtttacaacatcctattatccagcactagtcctaggttgtggatgtagggaaaggccaggtaaacaaggaagggagaacaggtgaatgaccccaattgtttgaaaccaaaagagcagaattgcccctaattgatttaagtaaacagcaagtaacataggtctgttaaatagaagaggatgtgagcaccagatgcacgtgataaagaccatgctctggaagattcattccaaggagtagaagtggtatttactcagggcatttaaggagagcagggactctgaaatgaggtgagagaaaagataagacatgcaggaacagctggcaacaccaagaaagaatttaaggagagggatctctctgttagagaacttaacattaccctaggaacagcaagagcatcatcagccccaggaaaatctacctctgatatggagaccaggcttaagaaaatcccctagaacccagagaaaaagtgcaaaacaaggaaaatggccaaagagaatatcatagatacagagatcagacaatgagaatccagagtcttgttaagtgatagaaggaaaatactaacagaacacatgtaacaggaacaacattttagaggaaacaggacaaaaacttccctaaactcaagatactacaccagaagtgggcagtactcactatgttcaggggaacaaaaagataaaaactaaaaagcatcagactgttttttgtgtgaaggaaatttgtaaggtaggagaattaggtcacttactacagcacaaattgcatgtctatctaaattgacgtttaagtgcaaaagcatggatattactcatgcagttttactggaaaaccatacagatgtttttcaggaatgtacagaatgaatcaaaggaaataactgatcgacaggaaaactgtaggaaatttgtgggctggctgtgaggcagtggctcctattatgtacaattttagtgctaagtactgtgttaatgatggctatcaaacaatatgttaacatctgaaaggaaatatgtatattgagcataataaatattttataaataacaataaatcatttgattttatgcta

SEQ ID NO: 1532 - DNA, 6108 bp, Homo sapiens
cttcgggacagcagaggagcagtgtccggccatggccggagcccgcaggctggagctaggcgaggccctggcgctggggtcgggctggcgtcatgcgtgccacgctctcctctacgcgccggaccctgggatgctcttcggccgcatcccgctgcgctacgccatactgatgcagatgcgcttcgatggacgcctgggcttccccggcggattcgtggacacgcaggacagaagcctagaggacgggctgaaccgcgagctgcgcgaggagctgggcgaagcggctgccgctttccgcgtggagcgcactgactaccgcagctcccacgtcgggtcagggccacgcgttgtggcccacttctatgccaagcgtctgacgctcgaggagctgttggctgtggaggccggcgcaacacgcgccaaggaccacgggctggaggtgctgggcctggtgcgagtgcccctgtataccctgcgggatggtgtaggaggcctgcctaccttcctggagaattcctttattggctctgcgcgggagcagttacttgaagctctccaggacttgggactgctgcagtctggctctatttcaggccttaagattccagctcatcactagaggcagccctccatggacccatgaaaactgagatgaggaccttggtactagggagggagggaaggacgtgggaatgttttcttattggatctgagagatgatacatgataccagatgaaaagaaggagaagtgtgtaccatatgttttgagcagaggaccctccaacttatggcatcaggggcaaaaagtcacagcttatcccaggcaccctggcaggttctcagagcctgcctcctccctgtttatatgcgtacagcctggtaacccccaggcatgcaaatatacaatctgtaacaacacacagcctgacaccttcccctggtcatgtccagtttaaccttgaagtggcatttgtcacactaccctggtccctgattgcaaggagcttctgaagcaagggtgaatccttcccacactcctccatggttgccctccagggtctagcccagcctatttgttagggaggatagagaaacagagcaccccctgtgctttctgaaaatagacttgctcttgtcttgagtggtgaccaaagcagttggctcttaaaaggtgggagagcagcccaaccaatccccaatccttttcttctgaaactgagcaggaagggtaaggaagtggctaggtctccttggactgagcatggacatgagtcctgtgaggactggtgtctctcctctagagctttcatctttgggatgcctgagactccgagactatcagaagggaattgacccaccccagtctagcaccaccctgccttcacttcatctacataaaggtggtataaaaacatagactggaggaggtaatccatggagagagaaaaagaagagggctcaggacaaggccctgaggaggcccaatcctaaaagtttgggcagagggaaccaggcacgttaaagaagacagaaagcggactatgcagagtgcttgtgagggtttcactaaaacagaggcaaaactgtccattgaattcagtaacatgaagtgtttgatgactatgatggcagcagtttcaggaagggcggtatggaaggcaggctgtactggttgagtgaatggaaagttggggagtagaacgtgtgagaagttggccttcaaggggctcaggttaataatagagagctatggagtcaaggcatgtttaagatgggaggtagagcatgccaatattgatggcaacagtcaagatggtgtgatgagagagatgggaggggcacaaagaggaggacccctgaaggagcagagtccatgagaaagaaggagggatgggacctttgtaggaagagacacagtcctgcagcctcatatggctcaataaaacagaaaggggcaagtatagaagattaggatgactaaattaatggggaaatgatgaaggagtttgaatctcttctttgtgaaatgaagtgagactatcagctagttgtgggtggagtgtgttctcagaaggtatgaagtagatgttttcctaggtgttggaaaacaggttgattaaggcaacagcagaagggcagggcaaggctgagctctgagatggtcagtttagagtaggatgctgggcactcaggtgtgtgtgtgttgagtggggctctgcacacacctgtcttcccctcatcaggattcaggagctgggatgggtacacttactgcagtgttggggttttgccagggaagtaaaaggagttgagagaaagatgggtcagttcagaagacatacacaggagaaattgtagtgatgaaatgtgcagtctaaggtttaatctgaccaagaaattggaattgaaaacaggaggtgactagggagggattaggaaattagaggtcttgacaagatagaaactccagcatggtgaggggttgggcagggaggtatatttgagccagacaggagtgctttggaaattgagaggtggagcaatctcaggtaaaggcaaaatagagggtatgacctggggttgctggccagagccagggaggagccttaagaagtgaaatctagggttggcgaggctggagggcagggtgagcctccacatgggtgctgaagcaagaaaccgacagatgttgaggagaatggtgtgacctaggagtcagcatccttggtgaacaagaggagtggccacaaggccagtggcacctgccagaggggaaagcaggcatgacaggatagcatctcccaggtgagagccttttgaggaagggagggtgggcagtggtctggaagcttgatgcagagcagtgtgggtcccactggcagcccttggtcttagaagaatgggagtacccagtgggggagcagctgtacaatgaggtagactcctagaggttaattatcatctcctaatcttaccctgacccttttgtcaaacgttatctagattaaacctcagtataggcaggctgcaggaaatggacattccagtggcccctggggttccagcctgtagcagcttcatctgtgctttgtgcacttggttctcagtcatctctgcaagggaccctgacgcctgggagatcagagccactgaccctttatggcactgctaacagaccccttccctcaggtaattctggatccagaactcattatgggatgtaatccaggtcaacactaataccacttggaaggttccgctctgtctcactctgcttgagtatcccactgatcagtctctcagtgcctgcctactgggcagctcatctgtccacttattcgtattaaatttgctttttatttaggtctctggagatggttgcgtggggaagagcccatgactttcctatatgatcccttgaacatactctccaagtcagtagattacctctcaggcagccttcataaaagtgtttcactgtactggggtttgtgttcatctcactcacatagacagtctctgggtaggcaggtggggggtgatacaagttcacactctgtgtttctcctcctgttagccattcccaccctgctgatgtttaaggaaagccagggatgatgacccacttaagctttccttggccttgttaagtccaatcatctggggcaggaagaagagaaatgctcattgcaatctttgacccccactaactgctgtggtgactttgacccaagcccttgacctccttttccttatctgaaatgttgctgtgattcctgtggtgagatcagatgaggcagcacttgggataagcttgcagagatgcattgagcggtatgaaagtacaggatgctatgtactttcctgcttcacagcacattttgtttcttgcaaggtgagtggcccagccgcctctccacaaacacgtgtttctgcctttctcagcataatcagcaagatgttcccacttctcagcattgcacttttctgctggtgcagaataaaaacactttgagccccaccctgtcctgagacaaagtcctctgtggtcacttggcatatggcaaagctgctgctgtgggctggaacatttgaggcaacagtgacttcctcctttcctagttaccggaacccttagagctgggagccggccagtgaaacagacaaggggaggggaagagaagagggaaggcatgtttcctatatgagtttcagtttgttgcacagaaatgtttttgaaacctttatctccaatagaatcacaaacgggtgtcagagagtcaaaactagaggaaaaagtttagtctgtaaacaaatcattagatggcatcagaatttgaaccaaagtaaaagatgctggaccttggcacttatcagagaagtatagaagagccaggtaggggattttatttacaacatgttcaattctgaggaagaggagtatgggcagggcagaggaaaaaggaaaaatgggaaacccccatggacttagggcccccacaaagagaaaccatgtgccttctccccacttcccttctggcttgggcaaatgaggctccctttaggggtagaggtactctacaggggctatgttccctttaggggtagaggtagtctacaggggccagctgggcagagatgaaatcttgcaaaggaacccttcttacactcgaaaagcaagaatagcaaagggactttgggaaggacataaaacaagaaaaggaagctcctcaccaacagctcccagatggagggagtttgtgtgtctagcattttcaccaaagtgctgctcatcctgatgcacagatgcagattggagctgctgcctgtgccctcaccatgggtatgtacccaccacaggcattcccaggtgatgcgggggcagaggattccctctttccactcaggataacaacccctcgatggggttttcaacaagtatagaaagctcctggactcagccaagaccctcacctacagtcccagtcctcccaccttcttcaggtctctagaagacagaactgatgggtttacaacatcctattatccagcactagtcctaggttgtggatgtagggaaaggccaggtaaacaaggaagggagaacaggtgaatgaccccaattgtttgaaaccaaaagagcagaattgcccctaattgatttaagtaaacagcaagtaacataggtctgttaaatagaagaggatgtgagcaccagatgcacgtgataaagaccatgctctggaagattcattccaaggagtagaagtggtatttactcagggcatttaaggagagcagggactctgaaatgaggtgagagaaaagataagacatgcaggaacagctggcaacaccaagaaagaatttaaggagagggatctctctgttagagaacttaacattaccctaggaacagcaagagcatcatcagccccaggaaaatctacctctgatatggagaccaggcttaagaaaatcccctagaacccagagaaaaagtgcaaaacaaggaaaatggccaaagagaatatcatagatacagagatcagacaatgagaatccagagtcttgttaagtgatagaaggaaaatactaacagaacacatgtaacaggaacaacattttagaggaaacaggacaaaaacttccctaaactcaagatactacaccagaagtgggcagtactcactatgttcaggggaacaaaaagataaaaactaaaaagcatcagactgttttttgtgtgaaggaaatttgtaaggtaggagaattaggtcacttactacagcacaaattgcatgtctatctaaattgacgtttaagtgcaaaagcatggatattactcatgcagttttactggaaaaccatacagatgtttttcaggaatgtacagaatgaatcaaaggaaataactgatcgacaggaaaactgtaggaaatttgtgggctggctgtgaggcagtggctcctattatgtacaattttagtgctaagtactgtgttaatgatggctatcaaacaatatgttaacatctgaaaggaaatatgtatattgagcataataaatattttataaataacaataaatcatttgattttatgcta

SEQ ID NO: 1533 - DNA, 5943 bp, Homo sapiens
aggcgcctaggttcctccccttatccctgcagggattgggccttgcagcaccgcccaggctcggattggtccgagatgcagatgcgcttcgatggacgcctgggcttccccggcggattcgtggacacgcaggacagaagcctagaggacgggctgaaccgcgagctgcgcgaggagctgggcgaagcggctgccgctttccgcgtggagcgcactgactaccgcagctcccacgtcgggtcagggccacgcgttgtggcccacttctatgccaagcgtctgacgctcgaggagctgttggctgtggaggccggcgcaacacgcgccaaggaccacgggctggaggtgctgggcctggtgcgagtgcccctgtataccctgcgggatggtgtaggaggcctgcctaccttcctggagaattcctttattggctctgcgcgggagcagttacttgaagcagccctccatggacccatgaaaactgagatgaggaccttggtactagggagggagggaaggacgtgggaatgttttcttattggatctgagagatgatacatgataccagatgaaaagaaggagaagtgtgtaccatatgttttgagcagaggaccctccaacttatggcatcaggggcaaaaagtcacagcttatcccaggcaccctggcaggttctcagagcctgcctcctccctgtttatatgcgtacagcctggtaacccccaggcatgcaaatatacaatctgtaacaacacacagcctgacaccttcccctggtcatgtccagtttaaccttgaagtggcatttgtcacactaccctggtccctgattgcaaggagcttctgaagcaagggtgaatccttcccacactcctccatggttgccctccagggtctagcccagcctatttgttagggaggatagagaaacagagcaccccctgtgctttctgaaaatagacttgctcttgtcttgagtggtgaccaaagcagttggctcttaaaaggtgggagagcagcccaaccaatccccaatccttttcttctgaaactgagcaggaagggtaaggaagtggctaggtctccttggactgagcatggacatgagtcctgtgaggactggtgtctctcctctagagctttcatctttgggatgcctgagactccgagactatcagaagggaattgacccaccccagtctagcaccaccctgccttcacttcatctacataaaggtggtataaaaacatagactggaggaggtaatccatggagagagaaaaagaagagggctcaggacaaggccctgaggaggcccaatcctaaaagtttgggcagagggaaccaggcacgttaaagaagacagaaagcggactatgcagagtgcttgtgagggtttcactaaaacagaggcaaaactgtccattgaattcagtaacatgaagtgtttgatgactatgatggcagcagtttcaggaagggcggtatggaaggcaggctgtactggttgagtgaatggaaagttggggagtagaacgtgtgagaagttggccttcaaggggctcaggttaataatagagagctatggagtcaaggcatgtttaagatgggaggtagagcatgccaatattgatggcaacagtcaagatggtgtgatgagagagatgggaggggcacaaagaggaggacccctgaaggagcagagtccatgagaaagaaggagggatgggacctttgtaggaagagacacagtcctgcagcctcatatggctcaataaaacagaaaggggcaagtatagaagattaggatgactaaattaatggggaaatgatgaaggagtttgaatctcttctttgtgaaatgaagtgagactatcagctagttgtgggtggagtgtgttctcagaaggtatgaagtagatgttttcctaggtgttggaaaacaggttgattaaggcaacagcagaagggcagggcaaggctgagctctgagatggtcagtttagagtaggatgctgggcactcaggtgtgtgtgtgttgagtggggctctgcacacacctgtcttcccctcatcaggattcaggagctgggatgggtacacttactgcagtgttggggttttgccagggaagtaaaaggagttgagagaaagatgggtcagttcagaagacatacacaggagaaattgtagtgatgaaatgtgcagtctaaggtttaatctgaccaagaaattggaattgaaaacaggaggtgactagggagggattaggaaattagaggtcttgacaagatagaaactccagcatggtgaggggttgggcagggaggtatatttgagccagacaggagtgctttggaaattgagaggtggagcaatctcaggtaaaggcaaaatagagggtatgacctggggttgctggccagagccagggaggagccttaagaagtgaaatctagggttggcgaggctggagggcagggtgagcctccacatgggtgctgaagcaagaaaccgacagatgttgaggagaatggtgtgacctaggagtcagcatccttggtgaacaagaggagtggccacaaggccagtggcacctgccagaggggaaagcaggcatgacaggatagcatctcccaggtgagagccttttgaggaagggagggtgggcagtggtctggaagcttgatgcagagcagtgtgggtcccactggcagcccttggtcttagaagaatgggagtacccagtgggggagcagctgtacaatgaggtagactcctagaggttaattatcatctcctaatcttaccctgacccttttgtcaaacgttatctagattaaacctcagtataggcaggctgcaggaaatggacattccagtggcccctggggttccagcctgtagcagcttcatctgtgctttgtgcacttggttctcagtcatctctgcaagggaccctgacgcctgggagatcagagccactgaccctttatggcactgctaacagaccccttccctcaggtaattctggatccagaactcattatgggatgtaatccaggtcaacactaataccacttggaaggttccgctctgtctcactctgcttgagtatcccactgatcagtctctcagtgcctgcctactgggcagctcatctgtccacttattcgtattaaatttgctttttatttaggtctctggagatggttgcgtggggaagagcccatgactttcctatatgatcccttgaacatactctccaagtcagtagattacctctcaggcagccttcataaaagtgtttcactgtactggggtttgtgttcatctcactcacatagacagtctctgggtaggcaggtggggggtgatacaagttcacactctgtgtttctcctcctgttagccattcccaccctgctgatgtttaaggaaagccagggatgatgacccacttaagctttccttggccttgttaagtccaatcatctggggcaggaagaagagaaatgctcattgcaatctttgacccccactaactgctgtggtgactttgacccaagcccttgacctccttttccttatctgaaatgttgctgtgattcctgtggtgagatcagatgaggcagcacttgggataagcttgcagagatgcattgagcggtatgaaagtacaggatgctatgtactttcctgcttcacagcacattttgtttcttgcaaggtgagtggcccagccgcctctccacaaacacgtgtttctgcctttctcagcataatcagcaagatgttcccacttctcagcattgcacttttctgctggtgcagaataaaaacactttgagccccaccctgtcctgagacaaagtcctctgtggtcacttggcatatggcaaagctgctgctgtgggctggaacatttgaggcaacagtgacttcctcctttcctagttaccggaacccttagagctgggagccggccagtgaaacagacaaggggaggggaagagaagagggaaggcatgtttcctatatgagtttcagtttgttgcacagaaatgtttttgaaacctttatctccaatagaatcacaaacgggtgtcagagagtcaaaactagaggaaaaagtttagtctgtaaacaaatcattagatggcatcagaatttgaaccaaagtaaaagatgctggaccttggcacttatcagagaagtatagaagagccaggtaggggattttatttacaacatgttcaattctgaggaagaggagtatgggcagggcagaggaaaaaggaaaaatgggaaacccccatggacttagggcccccacaaagagaaaccatgtgccttctccccacttcccttctggcttgggcaaatgaggctccctttaggggtagaggtactctacaggggctatgttccctttaggggtagaggtagtctacaggggccagctgggcagagatgaaatcttgcaaaggaacccttcttacactcgaaaagcaagaatagcaaagggactttgggaaggacataaaacaagaaaaggaagctcctcaccaacagctcccagatggagggagtttgtgtgtctagcattttcaccaaagtgctgctcatcctgatgcacagatgcagattggagctgctgcctgtgccctcaccatgggtatgtacccaccacaggcattcccaggtgatgcgggggcagaggattccctctttccactcaggataacaacccctcgatggggttttcaacaagtatagaaagctcctggactcagccaagaccctcacctacagtcccagtcctcccaccttcttcaggtctctagaagacagaactgatgggtttacaacatcctattatccagcactagtcctaggttgtggatgtagggaaaggccaggtaaacaaggaagggagaacaggtgaatgaccccaattgtttgaaaccaaaagagcagaattgcccctaattgatttaagtaaacagcaagtaacataggtctgttaaatagaagaggatgtgagcaccagatgcacgtgataaagaccatgctctggaagattcattccaaggagtagaagtggtatttactcagggcatttaaggagagcagggactctgaaatgaggtgagagaaaagataagacatgcaggaacagctggcaacaccaagaaagaatttaaggagagggatctctctgttagagaacttaacattaccctaggaacagcaagagcatcatcagccccaggaaaatctacctctgatatggagaccaggcttaagaaaatcccctagaacccagagaaaaagtgcaaaacaaggaaaatggccaaagagaatatcatagatacagagatcagacaatgagaatccagagtcttgttaagtgatagaaggaaaatactaacagaacacatgtaacaggaacaacattttagaggaaacaggacaaaaacttccctaaactcaagatactacaccagaagtgggcagtactcactatgttcaggggaacaaaaagataaaaactaaaaagcatcagactgttttttgtgtgaaggaaatttgtaaggtaggagaattaggtcacttactacagcacaaattgcatgtctatctaaattgacgtttaagtgcaaaagcatggatattactcatgcagttttactggaaaaccatacagatgtttttcaggaatgtacagaatgaatcaaaggaaataactgatcgacaggaaaactgtaggaaatttgtgggctggctgtgaggcagtggctcctattatgtacaattttagtgctaagtactgtgttaatgatggctatcaaacaatatgttaacatctgaaaggaaatatgtatattgagcataataaatattttataaataacaataaatcatttgattttatgcta

SEQ ID NO: 1534 - DNA, 1552 bp, Homo sapiens
cagaggagcagtgtccggccatggccggagcccgcaggctggagctaggcgaggccctggcgctggggtcgggctggcgtcatgcgtgccacgctctcctctacgcgccggaccctgggatgctcttcggccgcatcccgctgcgctacgccatactgatgcagatgcgcttcgatggacgcctgggcttccccggcggattcgtggacacgcaggacagaagcctagaggacgggctgaaccgcgagctgcgcgaggagctgggcgaagcggctgccgctttccgcgtggagcgcactgactaccgcagctcccacgtcgggtcagggccacgcgttgtggcccacttctatgccaagcgtctgacgctcgaggagctgttggctgtggaggccggcgcaacacgcgccaaggaccacgggctggaggtgggaccagcctgggactctgtccctttcccaatttcctcttctcccaaagctttctctcccccaagaaagcatccctggagaaaagtctttgcccctctgaccttgccctctccccagctttcttggtggagttgggatcgtgatcatctatactctgaattagtactgccaacctgggctttctgtaaaggtctttcccaccctttaccaggagagatcctttctagaacacactcatccatgtctctctgctgttccctattgacagtgtgatagattatcacattatctaggtgtggcaacctaggttttattcttggggtttgcttttcttgtgtaggagatgtggccctgatatttcaggcagggctagtagatagattatgtatgaaggtggttctcaaaatttggcaggtagcagaatcatcggggcgtcttattaaaatagcgatttctctcagcattcctgcattggtggtggggcggggggagaggaaacctgagaatttgtagttttcaaaagttcccaaataatgctgatgcaaataatctgaggaccacattttgacaaccactggtgaaagggtatgaatacatctttgaggcagtagccactagaggtttagaagcagatgtgggaaagattaattgatagagctagataatatgttttgggtcattttcctgcagaaggttgggccactaggctttagtgaggtgtgagccttgggcctggttctgctggagtattaaggggtgaggcctgatctgctggagaaaggatggagttaagggaatgagccacctggggccctagtgtctcctgtctccttccttttacaggtgctgggcctggtgcgagtgcccctgtataccctgcgggatggtgtaggaggcctgcctaccttcctggagaattcctttattggctctgcgcgggagcagttacttgaagctctccaggacttgggactgctgcagtctggctctatttcaggccttaagattccagctcatcactagaggcagccctccatggacccatgaaaactgagatgaggaccttggtactagggagggagggaaggacgtgggaatgttttcttattggatctgagaga

SEQ ID NO: 1535 - DNA, 2276 bp, Homo sapiens
atcgtttccccgcgcgcaggtccgcggggaggggcggcctgccgaccggcccaccccagggcgttcctgaagggcgtcctcggccgcccccaccgcctcccagatgtactatgcggtttcccaggcgcgcgtgaacgcggtccccgggaccatgctgcggccacagcggcccggagacttgcagctcggggcctccctctacgagctggtgggctacaggcagccgccctcctcctcctcctcctccacctcctccacctcctccacttcctcctcctccacgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgccgcgcctgctgctggccgggctgcccctgctcgccgccgcgcccggctccgtgctgctggcgcccggcgccgtaggaccccccgacgcgctgcgccccgccaagtacctgtcgctggcgctggacgagccgccgtgcggccagttcgctctccccggcggcggcgcaggcggccccggcctctgcacctgcgccgtgtgcaagttcccgcacctggtcccggccagcctgggcctggccgccgtgcaggcgcaattctccaagtgagggcgggcctgggcctggggcgcgacctcggcccggcctcccttcgctcagcttctccgcgcccctgctccctgcgtctgggagagcgaggccgagcaaggaaagcatttcgaaccttccagtccagaggaagggactgtcgggcacccccttccccgcccccacccctgggacgttaaagtgaccagagcggatgttcgatggcgcctcggggcagtttggggttctgggtcggttccagcggctttaggcagaaagtgctcgctctcacccagcacatctctctccttgtccctggagttgcgcgcttcgcggggccgatgtagaacttagggcgccttgccgtggttggcgcgccccgggtgcagcgagaggccatccccgagcgctacctccccggagcggagcacgccggctcccagtactaggggctgcgctcgagcagtggcgggggcggaggggtggttcttttccttctcctccgccagaggccacgggcgcccttgttcccgccggccaggtcctatcaaaggaggctgccggaactcaagaggcagaaaaagaccagttaggcggtgcagacggtctgggacgtggcagacggacggaccctcggcggacaggtggtcggcgtcggggtgcggtgggtaggggcgaggacaacgcagggtgcgctgggttgggacgtgggtccacttttgtagaccagctgtttggagagctgtatttaagactcgcgtatccagtgttttgtcgcagagagttttcgctcttaaatcctgggggtttcttagaaagcaacttagaactcgagattcacctttcgtttccctttccccaaaagtagcgtaaccaacatttaagcttgcttaaaaacgaaaaccaaccgccttgcatccagtgttcccgatttactaaaataggtaaccaggcgtctcacagtcgccgtcctgtcaagagcgctaatgaacgttctcattaacacgcaggagtaccgggagccctgaaccgcccgctgctcggcggatcccagctgcggtggcgacggcgggaaggcgctttccgctgttcctcagcgggccgggcccttgaccagcgcggcccgcaggtcttccttctcgccgtcttgcagttgaagagctacatacgtagtcagtttcgatttgttacagacgttaacaaattcctttacccaaggttatgctatgacctttccgcagtttactttgattttctatgtttaaggttttggttgttggtagtagccgaatttaactggcactttattttacttctaaccttgtttcctgacggtgtacagaatcaacaaaataaaacatttaaagtctgatttttt

SEQ ID NO: 1536 - DNA, 2277 bp, Homo sapiens
atcgtttccccgcgcgcaggtccgcggggaggggcggcctgccgaccggcccaccccagggcgttcctgaagggcgtcctcggccgcccccaccgcctcccagatgtactatgcggtttcccaggcgcgcgtgaacgcggtccccgggaccatgctgcggccacagcggcccggagacttgcagctcggggcctccctctacgagctggtgggctacaggcagccgccctcctcctcctcctcctccacctcctccacctcctccacttcctcctcctccacgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgccgcgcctgctgctggccgggctgcccctgctcgccgccgcgcccggctccgtgctgctggcgcccggcgccgtaggaccccccgacgcgctgcgccccgccaagtacctgtcgctggcgctggacgagccgccgtgcggccagttcgctctccccggcggcggcgcaggcggccccggcctctgcacctgcgccgtgtgcaagttcccgcacctggtcccggccagcctgggcctggccgccgtgcaggcgcaattctccaagtgagggcgggcctgggcctggggcgcgacctcggcccggcctcccttcgctcagcttctccgcgcccctgctccctgcgtctgggagagcgaggccgagcaaggaaagcatttcgaaccttccagtccagaggaagggactgtcgggcacccccttccccgcccccacccctgggacgttaaagtgaccagagcggatgttcgatggcgcctcggggcagtttggggttctgggtcggttccagcggctttaggcagaaagtgctcgctctcacccagcacatctctctccttgtccctggagttgcgcgcttcgcggggccgatgtagaacttagggcgccttgccgtggttggcgcgccccgggtgcagcgagaggccatccccgagcgctacctccccggagcggagcacgccggctcccagtactaggggctgcgctcgagcagtggcgggggcggaggggtggttcttttccttctcctccgccagaggccacgggcgcccttgttcccgccggccaggtcctatcaaaggaggctgccggaactcaagaggcagaaaaagaccagttaggcggtgcagacggtctgggacgtggcagacggacggaccctcggcggacaggtggtcggcgtcggggtgcggtgggtaggggcgaggacaacgcagggtgcgctgggttgggacgtgggtccacttttgtagaccagctgtttggagagctgtatttaagactcgcgtatccagtgttttgtcgcagagagttttcgctcttaaatcctgggggtttcttagaaagcaacttagaactcgagattcacctttcgtttccctttccccaaaagtagcgtaaccaacatttaagcttgcttaaaaacgaaaaccaaccgccttgcatccagtgttcccgatttactaaaataggtaaccaggcgtctcacagtcgccgtcctgtcaagagcgctaatgaacgttctcattaacacgcaggagtaccgggagccctgaaccgcccgctgctcggcggatcccagctgcggtggcgacggcgggaaggcgctttccgctgttcctcagcgggccgggcccttgaccagcgcggcccgcaggtcttccttctcgccgtcttgcagttgaagagctacatacgtagtcagtttcgatttgttacagacgttaacaaattcctttacccaaggttatgctatgacctttccgcagtttactttgattttctatgtttaaggttttggttgttggtagtagccgaatttaactggcactttattttacttctaaccttgtttcctgacggtgtacagaatcaacaaaataaaacatttaaagtctgatttttta

SEQ ID NO: 1537 - DNA, 1083 bp, Homo sapiens
gcggccccggcctctgcacctgcgccgtgtgcaagttcccgcacctggtcccggccagcctgggcctggccgccgtgcaggcgcaattctccaagtgagggcgggcctgggcctggggcgcgacctcggcccggcctcccttcgctcagcttctccgcgcccctgctccctgcgtctgggagagcgaggccgagcaaggaaagcatttcgaaccttccagtccagaggaagggactgtcgggcacccccttccccgcccccacccctgggacgttaaagtgaccagagcggatgttcgatggcgcctcggggcagtttggggttctgggtcggttccagcggctttaggcagaaagtgctcgctctcacccagcacatctctctccttgtccctggagttgcgcgcttcgcggggccgatgtagaacttagggcgccttgccgtggttggcgcgccccgggtgcagcgagaggccatccccgagcgctacctccccggagcggagcacgccggctcccagtactaggggctgcgctcgagcagtggcgggggcggaggggtggttcttttccttctcctccgccagaggccacgggcgcccttgttcccgccggccaggtcctatcaaaggaggctgccggaactcaagaggcagaaaaagaccagttaggcggtgcagacggtctgggacgtggcagacggacggaccctcggcggacaggagtaccgggagccctgaaccgcccgctgctcggcggatcccagctgcggtggcgacggcgggaaggcgctttccgctgttcctcagcgggccgggcccttgaccagcgcggcccgcaggtcttccttctcgccgtcttgcagttgaagagctacatacgtagtcagtttcgatttgttacagacgttaacaaattcctttacccaaggttatgctatgacctttccgcagtttactttgattttctatgtttaaggttttggttgttggtagtagccgaatttaactggcactttattttacttctaaccttgtttcctgacggtgtacagaatcaacaaaataaaacatttaaagtctga

SEQ ID NO: 1538 - DNA, 8318 bp, Homo sapiens
caagcgttaccccgggggtggggggggcagaggcaacggggaagcaggaaggggctgaggctggttttggactctgcaccgtagcctctggcctacaagacagagcatcctctagattctggtctggcccctccagatccgcagccctgaccttaccccactggcgggatctagtcccctgggggtctctctgattataggagcccttcccccatctatcccagttcccaggggcccctggggctcacctgtctccaggtgctgagaaaaaggagacccctgcctccccccacattgaagagaagccccagggacaaagaggagtttgcaccagcgacgtctcagaagacaggggatccagcctcagcctccgtgggctggagggtgacaggggctcttagtggtcacccccaggctccagtgcctccagcggccgcactgtaaaaaggccctgcaattagaaggggcctttggcaaccccgaggccgggcagcccattgtacagttggggaaacggaggcccaggtgcccacacatgggcagaggctgacccctggggcgcacggaggccctgacctagccttaggacctcccttttcccccacttcctccacaaagaggttgtgggaagggggctgtgactccgtaggtgtgagtgggagtcgggggaagctgagcttgcagtggggatctagctcctgggggtctgtagggaacggggggggggggggacacgtacattacaggcgaccgtccagccacactcccagaaactccctggagatggacttgggggtgccaggcagaaagccacatctgggactctggagagaatcacacagagacgcgaaatcggagactctgggtcgaggcccccagccccacctgggcagagtctgtcctcggacccccgcccgctgtcccccgggtacggcctgccccagcgggcgcgggcgggcgcagtggccagggacgccgaagccccaagtctggccgacttcggcctgcttggtgctcgagtggggccggggcgggcggagagcgaggctgcgggaggcagcggtggcaggagcgggtgggcgggggcgctgacgtcagacccgggcccgggcgccggcggccgctcccctgccacatcctggtggccgcgctcgcagccgggccgggccgtgcgccgcgcagcctggcagcctcgcgcgcagccaccggggagcgggcgggagtcatgcagcggccttgagcactaggggccggcgctgaggagcgcgcgcggcgggagggcagccgagcatggagctgagcctggagagcctggggggcctgcacagcgtggcccacgcgcaggcgggcgagctgctgagcccgggccacgcgcgctcggcggcggcgcagcaccgcggcctggtggcgcccgggcgcccgggcctggtggccggcatggcgagcctgctggacggcggcggcggcggcggcggtgggggcgccgggggcgcgggcggcgcgggcagcgcgggcggcggcgcggacttccgcggggaactggcgggcccgctgcacccggcaatgggcatggcctgcgaggcgccgggcctgggcggcacctacacgacgctcacgcccctgcagcacctgccgccgctcgcggccgtggccgacaagttccaccagcacgcggcggccgcggccgtggccggggcgcacggcggccatccccacgcgcacccgcacccggcggccgcgccgcccccgccacccccgccgcagcgtctggcggccagcgtgagcggcagcttcaccctcatgcgcgacgagcgggcggcgctcgcctccgtgggccacctctacggaccctacggcaaggagctgcccgccatggggtcgccgctgtcgccgctgcccaacgcgctgccgcccgcgctgcacggcgccccgcagcccccgccgccgccaccacccccgccgctggccgcctacggcccgccaggccacctggctggggacaagctgctgccgcccgccgccttcgagccgcacgccgcgctgctgggacgcgcggaggacgcactggcccgcgggctgcccggaggcggcggcggcacaggcagcggcggagcgggcagcgggagcgccgcggggctgctggcgccgctgggcgggctggcggcggccggggcgcacgggccgcacgggggaggcggcggccccggcgggagcggcggcggccccagcgcgggcgcagcggccgaggagatcaacaccaaggaggtggcgcagcgcatcacggcggagctgaagcgctacagcatcccgcaggcaatcttcgcgcagcggatcctgtgtcgctctcagggcacgctctccgacctgctgcgcaaccccaagccgtggagcaagctcaaatccggccgcgagaccttccgcaggatgtggaagtggctgcaggagccagagttccagcgcatgtcggcgctgcgcttggcagcctgcaagcgcaaggaacaggagcagcagaaggagcgcgccctgcagcccaagaagcagcgcctggtgttcaccgacctgcagcgacgcacgctgatcgccatcttcaaggagaacaagcggccgtccaaggagatgcaggtcaccatctcgcagcagctcggcttggagctcaacaccgtcagcaacttcttcatgaacgcgcggcgccgctgcatgaaccgctgggctgaggagcccagcacggcccccgggggccccgccggcgccacggccactttctccaaggcctgaggcgccccggccccgcgccctccctgcctccacggcctgggcgctgtgcccccacgtcacctccccacatcctgccggcccggagacccgcccccagggggcacctggagggggtgctatccgggccccccacacccggggagggggaagcagcacaccccccagcccaagtgcacaaaaagggccccccttcctccctccatgcccactccctccaggccaaaggaagccctccacccccccccggaggggagggagtgacagaaaggggtttcccagccccctctccattcaggacgcccagagggcctcgagaaaaaccagggctcactgtgttgtcccctaaagcgggtcaagaagcacatactagaaatataaaccgggtatttaaaaatggaattttaaagaataacccctcctccgtcagatcccctgccccaccgagggaggtagtagaaaacttccttcctccccacccgccccggccccctccccagggacctcagccctttccaaagtcgccaaaaacccacatcaagccggatccttacggtcccccaccctctccaaaaccaaccccacccgctggcaggacggcccctgcggccgagaactgagctgcccctctctgcggccaggattcctcgtgccaagaatcgcctgccttaaagtctggggaggggcctgcggcgggcgcccagcacctacgggcgagcacccttcccaccccatcccaggccgcaggggacggggggctcccacgtgcgggtaaattccagacgcccccgccccgccccgtctgttgagttcactttacctttaggcaccttcgtggagcgcaaggaaggacgcagctccggacacgggagaccacgcccaggctcccaggagaaggggacccggccggagaaggcgccgctggggccgcccggaggagcccctctgcacgggcccgtggagacgcttcctgcgtggaaccttctggaatccaccgcccccctttccgcccgcgtcagggtctgaactgggcttgcaggggggcagcggggttgaacgtggtgttggtttccactctcgccaaagagagaagacgccgaggaaggtggattccgcttgctccattttttgccaaaaatatttacaaatgggaagggtcggaaatgaagatgagcgcccccctcccaccccgcgctctcccccgctcctctcatctggtctgggtgacctccgagactggccggccgcgggatcccaggagcccgcctcctccgggggttcaagatccgagtctagaaggaacctcctccctgaaatccccccactcatcggctgcctcccagggaggaggcggcccccctaccccccttgaaaatgcaaaagacatttctagtgaaatgcccctcccctcccccaggtaaaggctacctcactcaagctcatgtctgtgattggaaaatcacgcctgataccaaagatttctcccaaggatttgtgctggatgacaggattccctggcctgggacccggctcggggccccgcctgccgagtgccaccccttcccgaacctgagagcgaaagagagagagagagagagggagagagagggagagaaagggagagagggagggagaggatcgtgaggtcgaagagtgccttcttcttgaaccaaagacgtgtatggagtgttctcttgtccttatcgacttgctctgctcccagctttccaagcgaccggatctgagtgatgcttctagaacatttgggtgttggggggttcccaatagtagaaagggtccccattcctgctcagcaccgcacctctctacccccccacagacacacatgcagacacacacatgcagacaacacgcagacacacacatgcaggcactcacatgcaggcccatgcacacacacgtgcacacacatgcagagacatgcagacacgcaggcacacatgcacacatgcaaagacacgcatgcaggcacacgcagacgcacacagagacacacatgcagatacacatgcacacacacatacacacactggcccctgtttttctgtggtgtcactgggtgccagcaactcggtatctcccacctcccactaaaacctgggccttaatttctctcccgtccccacccctaaattcctgatggatgaacctagagctgtcctgtccactccaggccggactgacgtagcctatgggcccagcaggtccagggcccacgttttaatttctttttaaaaagctttaggtcttgccgggcgcggtggttcacgcctggaatcccagcattttgggaggccgaggcgggtggatcacaaggtcagcagttcaagaccagcctgaccaacatggtgaaaccctgtctctactaaaaatacaaaaaaattagctgggcgaggtggcaggcacctgtaatcccagccacctgggaggctgaggcaggagaatctcttgaaactggaaggcagaggttgcagtgagccgagattgcgccactacactctagcctgggcaacgagagcaaaactccctctcaaaaaaaaaaaaaaaaaaaaaaactttaggtccaagaagatgcaccccattcaacataccatattatttgtctttataccaaggtagcctatagatatacaatgttttaaatttcttttttagaaacagggttttgctctgttacccaggctggagtgcagtggtgcaatcgtagctcactgcagcctcgaccacctgggctcaagtgatcctcctgcctcagcctcccagtagctggggccacaagcacaccccaccatgcccatttaattttttaagggatttcttgtagatatggggtctcactatgctgcccaggctggtcttgaactcctggccccaagggggtcctcctgcctcggcctccaaaagtgctaggattacaggtagatagacatttagtggaggaagaggctctcaaaggcaataaaatgcttctgatccaagagaatcacgctgcagccctggcccagtgagcttcttagaaaatcgatgcctgggcttcaggcactggccggagcacgggcctggcggggtgctgggtctcctagatgccctctgcttggccttcaaggccccaagggtaacacgctagggggcctccagttttgtcccctgctggaaatttaggacttggcttgggatcgttctggttgtggaatgttttagctatgctgaactgtggtcagatcaggtcaagcctcttggtcacagaagtggcccagcagcactttgggaggccgagacaggaggatcgcttgaggccaggagtttgagaccagcctgggcaacacagcaagaccccacttctacaaaaaaaaataaataaagtggcccaggactcctggatccttttcagatatcttcgtatcacacacacacacacacacacacacacacacacacacacacacacacccctacctgtttccggaccccaccccaaacttggccagacccccacagaaggctctatccccgacctgcccgccggcccctcaggccctctcctgcctccccgcatgcccacttggctgtcacataccaaagagcatgcgttctccatgcagggatcaacacctccagcacaattccttcgagcctttgacaattttctctgaaatacctcaaaatatttaatgtatagtttatgtgattaaaaaaaaatccttagctagtttttggaatacgtgacttgaagctttataccgttaaattataattttgcagacgatggcatgtcgtttctttgacgagttccgtgggagacgcattgaatgtcagggctggagaccagagggaaagttagagggagcgtgatcgcgagagagactgcggcagaaaggaccagtggcgtttacagatttcttatttaaatgagtcctttaggaaagaaaggaagagagagagagagcgagcgcaagagagagagagagggagagagagggagagggagagagagaggcagaggtatacctttctgttctctggcttgttctgtttcttgttttctggagtcatgtcttataagagtatttattattctctgtgttctgtgttcaaatgtaatttaagaaaaaaaaaggaagaaaaatgcaaaaaaaaaagacaaaatggaatttgagttggtgcatgactaatgtactctttcttgacgctaattgtaataaagtggtcagggtggggggcggggggcgtggcccggttccgtgtcgcatctgtgtgtctggtgcctgatcggtgctgttcagtggtttttcgttactgtttctttcctcctttctaaggaactgtgtccagccgggacaggtggacggggccccaggtagagggggcgggaacagagcctcagtagccgggtctcctccacctgcctgtccatctccacccgagatgccacctgcctgccccagccaggcgggagccaccgagcgtccccccctcagttcctggttcttgggggcactctggtgtcatcgatatcttagacccccccaaccccccatcacccggttgctttcactctagcatgaattcccaagtgtcttgttcagaggagacagacaatcagcctattcttgtcttgttgcccagggtggtgggggacgggagtgtgccccaacttcctgagatctgaaggaccctcctgagggccccaacagcaggcaccagcaccccctccccccccacctccacccagacagcctcggcctccctccctgggctgggcatgagtccgcctttctgtccagcccgggaggcagggggtgtacgcctgcagagacccctccctcccagcccactttcggagcctacagaacagaggactccccaaaatcatcaaagggggctctgggacaatgtcctctgcctctgactcctcttgtgccatgaggccacgtccctgagccatccccagatagtccctggaggtggaaaggggcacagatgtgccagcttgggaacagaggctggaggagagggcggcaggggagagatgagaggggccgcttttgggacaggccccagtaggggggggcggggtagctaaacggggtgcttctcaccccataaagcagcaagccctggtctggagggctgggcctggggctgagggctcagctgacctcaaatctgaaatgatgccggggccaggatgctccttgcaccagcaggagcttgggccatttcacattctctgccccaagcggtttaagcaaaatcaggccagtagactcctggggctcctcctcgtggccctgtcagaccacgcaggggctggttttggtggaatgagctcagccgggggtgacggaagagccaggaggccctgcggccttgagtgttttgaatagactggaactgagggctgctttcaggggagacaccacttggaccctccaaagtcccctcccctccagggacaggggagagaagcccttttccaccttcacccttgggcgacaggcttaaaagctaaaaaaaaaaaaaaa

SEQ ID NO: 1539 - DNA, 1236 bp, Homo sapiens
gagctgtgcttggggcggggcctggcgtgtattcgaaaggaaggcgccggctgcgggaagatggcggctcagccgctgcggcatcgctcacgttgtgcaacgccgccccggggggacttttgtggtggcactgagagggcgattgaccaagcttcttttacgacctccatggagtgggatacgcaggtggtgaaggggtcctcgccgctcggccccgcagggctgggggctgaggagccagccgccggcccgcagctgccgtcttggctgcagcctgagaggtgcgctgtgttccagtgcgcacagtgtcacgcagtgctcgccgactcggtgcacctcgcctgggacctgtcgcggtccctcggggccgtggtcttctccagagttacaaataacgtcgttttggaagcgcccttcctagttggcattgaaggttcactcaaaggcagtacttacaaccttttattctgtggttcttgtgggattcccgttggtttccatctgtattctacccatgctgccctggctgccttgagaggtcacttctgcctttccagtgacaaaatggtgtgctatctcttaaaaacaaaagccatagtaaatgcatcagagatggatattcaaaatgttcctctatcagaaaagattgcagagctgaaagagaagatagtgctaacgcacaatcgcttaaaatcactaatgaagattctgagtgaagtgactcctgaccagtccaagccagaaaactgatcctgtaccaaagcttgagtgtcaggttcaggctttattgctgtcttcaacaacaggtgctgcttagtcatttcttgaaaaagattggcttcaagaatggaggggaaatgcagtttctatttacctttaggctgattttccaaattatttgtgaagctgtttttagaagatgagagactaaggattcttctcttttatagctatttgccttaagaacttactttagattcttattgaattcataatacttatctctgaaaatgtctttgactgtaaatttaggaattaagatgcagagtcccatgtgtcctctgatctaaagttgcatggttggtctgaaaatagagttgggcttaatgttgacttctattactcctgcatggagcagttgttatgaatactaatacatcactttttaacttctgtaaaatacagatcataatattctataggtaatgtttaataaattgcctgaataatatacaa

SEQ ID NO: 1540 - DNA, 1449 bp, Homo sapiens
ttttccccggcgtggtctcactcgcgatttaaggcataggtgtcgccgagccgggaggctgggagtcgccaggcgtgcgggggagaggcctgggccgcgccgcggcggggggtggaggaagagggcaggcgaggcgggaaggtgggctctggccgccgggagccggggacggagccgccgccgttgcccctagcggggagcagccgggaggagggggccgcagtcgggagaggggaccccaccatgcccaaagtcttcctggtgaagaggaggagcctgggggtctcggtccgcagctgggatgagctcccggatgagaaaagggcagacacctacatcccagtgggcctaggccgcctgctccacgacccccccgaggactgccgcagcgacggcggcagcagcagcggcagcggcagcagcagcgcgggggagcctggaggagcagagagcagctcgtccccgcacgcccccgagagcgaaacccccgagcccggcgacgccgagggccccgatggacacctggcgaccaagcagcgcccggtcgccagatcgaaaatcaagttcaccacaggcacgtgcagcgactcggtggttcacagctgtgacctgtgtggcaagggcttccgtctgcagcgcatgctgaaccgtcacctcaagtgccacaaccaggtgaaaagacacctgtgcaccttctgcggcaagggcttcaacgacaccttcgacctgaagaggcacgtccgcacacacacaggcattcgtccctacaaatgcaacgtctgcaataaagccttcacccagcgctgctctctggagtcccacctgaagaaaatccatggggtgcagcagcagtatgcctataagcagcggcgggacaagctctacgtctgcgaggattgcggctacacgggccccacccaggaggacctgtacctgcacgtgaacagtgcccatccgggcagctcgtttctcaaaaagacatctaaaaaactggcagcccttctgcagggcaagctgacatccgcacaccaggagaataccagcctgagtgaggaggaggagaggaagtgaggagaaggaaggggaggacagacgttcacactgccacgtatgtctacgtggatttttggttttcagcttcccccaccccactggctcttcttaattagaagtgaccagttcacctctgtgtccttttgaaacatcagcagtagggtccattccaagattgtcagttgccgttagtgacgtcaggccctgtaacctgtgtcctgtctggcgcagttgctcacattcaccaaagtttgttttcatgatcctgatggccaagaacaccgtgtgggatttttttttcccccaaggattttcacacacggaaggagaggtatttcttagagagatcatcattttatggtgccttgaaataaaaatacttctacttgaaatgct

SEQ ID NO: 1541 - DNA, 1631 bp, Homo sapiens
gttttgctggaggatgatgacagaggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaa

SEQ ID NO: 1542 - DNA, 2591 bp, Homo sapiens
cgcccgcccgccggccctcgggctttgtgccgcactgggctccggcgcagaagagtcagccggcactcgagcgccgaggggggcaccgcgcccgccaccagcccgagtggagtcagtcggcaaggcagccgcacgctggaggtagagggaagagcgagctagcgcgagccgggaaggaagccaccaggccaaggcggtggaacgcgcgctccgagggagctcagagccgagcgggaggactgtcagcttccacccagcccccgggctcttgcccccaactccactggagcgctgagctcggaacttgaaaactctctgctccccaggcttcccccgactctcatctcccttgccttgcggaggctggggctcttccctgttctccggccccctgcgcttgggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcagacccatgcagatgcaaaagtccaagtgctggacaatcaaaacgtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatataga

SEQ ID NO: 1543 - DNA, 2157 bp, Homo sapiens
ctacttccagcgaaagcccgcgtcggagggcgactgccggcgagcgggagcggcgcagggctcggggcgggcggccagctcagccccagcgccagcgccagcgccagcgcgggctgagctcgcgggaagaagggagactccaggcgcgacagcagccgcggctcctagccccagcgtcgcccaatgctcccgacccgcgggaaaagacgaagaggctctgtggtgcccaaggccctggaacggccgcagagagcaaccgctgccggctgctttgtccagcccgaggcccagcgaacgcgcagagagcgggcgctccgaggactcgccgagggagcgccgagggaacctgctcgccgcgtctccgcccgcccgccggccctcgggctttgtgccgcactgggctccggcgcagaagagtcagccggcactcgagcgccgaggggggcaccgcgcccgccaccagcccgagtggagtcagtcggcaaggcagccgcacgctggaggtagagggaagagcgagctagcgcgagccgggaaggaagccaccaggccaaggcggtggaacgcgcgctccgagggagctcagagccgagcgggaggactgtcagcttccacccagcccccgggctcttgcccccaactccactggagcgctgagctcggaacttgaaaactctctgctccccaggcttcccccgactctcatctcccttgccttgcggaggctggggctcttccctgttctccggccccctgcgcttgggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagt

SEQ ID NO: 1544 - DNA, 1627 bp, Homo sapiens
ttttattgtcaatctctgtctccttcccaggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaa

SEQ ID NO: 1545 - DNA, 1763 bp, Homo sapiens
ggtgcatttgcatgttgcggagtgattagtgggtttgaaaagggaaccgtggctcggcctcatttcccgctctggttcaggcgcaggaggaagtgttttgctggaggatgatgacagaggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcagacccatgcagatgcaaaagtccaagtgctggacaatcaaaacgtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaa

SEQ ID NO: 1546 - DNA, 2160 bp, Homo sapiens
tgcaccctccgaggactgggagtcccgagtccagcttagggggagtgggggcgcgacccccaacccagaaaccttcacttgaccgctcaagttcgcggcagcagggcgggccgcgccgaatctcggcgtgcgcggagcggggagatgcaggcgagcgccagagcccgggctcgggggccctgcgccggggagaggagccgggacccaccggcggagccgaaaacaagtgtattcatattcaaacaaacggaccaattgcaccaggcggggagagggagcatccaatcggctggcgcgaggccccggcgctgctttgcataaagcaatattttgtgtgagagcgagcggtgcatttgcatgttgcggagtgattagtgggtttgaaaagggaaccgtggctcggcctcatttcccgctctggttcaggcgcaggaggaagtgttttgctggaggatgatgacagaggtcaggcttcgctaatgggccagtgaggagcggtggaggcgaggccgggcgccggcacacacacattaacacacttgagccatcaccaatcagcataggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaa

SEQ ID NO: 1547 - DNA, 2614 bp, Homo sapiens
accctcttttcttatcattgacatttaaactctggggcaggtcctcgcgtagaacgcggctgtcagatctgccacttcccctgccgagcggcggtgagaagtgtgggaaccggcgctgccaggctcacctgcctccccgccctccgctcccagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcagacccatgcagatgcaaaagtccaagtgctggacaatcaaaacgtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagttttaaacttaagtgttttgaagttgttcacaactacatatcaaaattaaccattgttgattgtaaaaaaccatgccaaagcctttgtatttcctttattatacagttttctttttaacct

SEQ ID NO: 1548 - DNA, 3597 bp, Homo sapiens
accctcttttcttatcattgacatttaaactctggggcaggtcctcgcgtagaacgcggctgtcagatctgccacttcccctgccgagcggcggtgagaagtgtgggaaccggcgctgccaggctcacctgcctccccgccctccgctcccagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagttttaaacttaagtgttttgaagttgttcacaactacatatcaaaattaaccattgttgattgtaaaaaaccatgccaaagcctttgtatttcctttattatacagttttctttttaaccttatagtgtggtgttacaaattttatttccatgttagatcaacattctaaaccaatggttactttcacacacactctgttttacatcctgatgatccttaaaaaataatccttatagataccataaatcaaaaacgtgttagaaaaaaattccacttacagcagggtgtagatctgtgcccatttatacccacaacatatatacaaaatggtaacatttcccagttagccatttaattctaaagctcaaagtctagaaataatttaaaaatgcaacaagcgattagctaggaattgttttttgaattaggactggcattttcaatctgggcagatttccattgtcagcctatttcaacaatgatttcactgaagtatattcaaaagtagatttcttaaaggagactttctgaaagctgttgcctttttcaaataggccctctcccttttctgtctccctcccctttgcacaagaggcatcatttcccattgaaccactacagctgttcccatttgaatcttgctttctgtgcggttgtggatggttggagggtggaggggggatgttgcatgtcaaggaataatgagcacagacacatcaacagacaacaacaaagcagactgtgactggccggtgggaattaaaggccttcagtcattggcagcttaagccaaacattcccaaatctatgaagcagggcccattgttggtcagttgttatttgcaatgaagcacagttctgatcatgtttaaagtggaggcacgcagggcaggagtgcttgagcccaagcaaaggatggaaaaaaataagcctttgttgggtaaaaaaggactgtctgagactttcatttgttctgtgcaacatataagtcaatacagataagtcttcctctgcaaacttcactaaaaagcctgggggttctggcagtctagattaaaatgcttgcacatgcagaaacctctggggacaaagacacacttccactgaattatactctgctttaaaaaaatccccaaaagcaaatg

SEQ ID NO: 1549 - DNA, 6922 bp, Homo sapiens
accctcttttcttatcattgacatttaaactctggggcaggtcctcgcgtagaacgcggctgtcagatctgccacttcccctgccgagcggcggtgagaagtgtgggaaccggcgctgccaggctcacctgcctccccgccctccgctcccaggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcagacccatgcagatgcaaaagtccaagtgctggacaatcaaaacgtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagttttaaacttaagtgttttgaagttgttcacaactacatatcaaaattaaccattgttgattgtaaaaaaccatgccaaagcctttgtatttcctttattatacagttttctttttaaccttatagtgtggtgttacaaattttatttccatgttagatcaacattctaaaccaatggttactttcacacacactctgttttacatcctgatgatccttaaaaaataatccttatagataccataaatcaaaaacgtgttagaaaaaaattccacttacagcagggtgtagatctgtgcccatttatacccacaacatatatacaaaatggtaacatttcccagttagccatttaattctaaagctcaaagtctagaaataatttaaaaatgcaacaagcgattagctaggaattgttttttgaattaggactggcattttcaatctgggcagatttccattgtcagcctatttcaacaatgatttcactgaagtatattcaaaagtagatttcttaaaggagactttctgaaagctgttgcctttttcaaataggccctctcccttttctgtctccctcccctttgcacaagaggcatcatttcccattgaaccactacagctgttcccatttgaatcttgctttctgtgcggttgtggatggttggagggtggaggggggatgttgcatgtcaaggaataatgagcacagacacatcaacagacaacaacaaagcagactgtgactggccggtgggaattaaaggccttcagtcattggcagcttaagccaaacattcccaaatctatgaagcagggcccattgttggtcagttgttatttgcaatgaagcacagttctgatcatgtttaaagtggaggcacgcagggcaggagtgcttgagcccaagcaaaggatggaaaaaaataagcctttgttgggtaaaaaaggactgtctgagactttcatttgttctgtgcaacatataagtcaatacagataagtcttcctctgcaaacttcactaaaaagcctgggggttctggcagtctagattaaaatgcttgcacatgcagaaacctctggggacaaagacacacttccactgaattatactctgctttaaaaaaatccccaaaagcaaatgatcagaaatgtagaaattaatggaaggatttaaacatgaccttctcgttcaatatctactgttttttagttaaggaattacttgtgaacagataattgagattcattgctccggcatgaaatatactaataattttattccaccagagttgctgcacatttggagacaccttcctaagttgcagtttttgtatgtgtgcatgtagttttgttcagtgtcagcctgcactgcacagcagcacatttctgcaggggagtgagcacacatacgcactgttggtacaattgccggtgcagacatttctacctcctgacattttgcagcctacattccctgagggctgtgtgctgagggaactgtcagagaagggctatgtgggagtgcatgccacagctgctggctggcttacttcttccttctcgctggctgtaatttccaccacggtcaggcagccagttccggcccacggttctgttgtgtagacagcagagactttggagacccggatgtcgcacgccaggtgcaagaggtgggaatgggagaaaaggagtgacgtgggagcggagggtctgtatgtgtgcacttgggcacgtatatgtgtgctctgaaggtcaggattgccagggcaaagtagcacagtctggtatagtctgaagaagcggctgctcagctgcagaagccctctggtccggcaggatgggaacggctgccttgccttctgcccacaccctagggacatgagctgtccttccaaacagagctccaggcactctcttggggacagcatggcaggctctgtgtggtagcagtgcctgggagttggccttttactcattgttgaaataatttttgtttattatttatttaacgatacatatatttatatatttatcaatggggtatctgcagggatgttttgacaccatcttccaggatggagattatttgtgaagacttcagtagaatcccaggactaaacgtctaaattttttctccaaacttgactgacttgggaaaaccaggtgaatagaataagagctgaatgttttaagtaataaacgttcaaactgctctaagtaaaaaaatgcattttactgcaatgaatttctagaatatttttcccccaaagctatgcctcctaacccttaaatggtgaacaactggtttcttgctacagctcactgccatttcttcttactatcatcactaggtttcctaagattcactcatacagtattatttgaagattcagctttgttctgtgaatgtcatcttaggattgtgtctatattcttttgcttatttctttttactctgggcctctcatactagtaagattttaaaaagccttttcttctctgtatgtttggctcaccaaggcgaaatatatattcttctctttttcatttctcaagaataaacctcatctgcttttttgtttttctgtgttttggcttggtactgaatgactcaactgctcggttttaaagttcaaagtgtaagtacttagggttagtactgcttatttcaataatgttgacggtgactatctttggaaagcagtaacatgctgtcttagaaatgacattaataatgggcttaaacaaatgaataggggggtccccccactctccttttgtatgcctatgtgtgtctgatttgttaaaagatggacagggaattgattgcagagtgtcgcttccttctaaagtagttttattttgtctactgttagtatttaaagatcctggaggtggacataaggaataaatggaagagaaaagtagatattgtatggtggctactaaaaggaaattcaaaaagtcttagaacccgagcacctgagcaaactgcagtagtcaaaatatttatctcatgttaaagaaaggcaaatctagtgtaagaaatgagtaccatatagggttttgaagttcatatactagaaacacttaaaagatatcatttcagatattacgtttggcattgttcttaagtatttatatctttgagtcaagctgataattaaaaaaaatctgttaatggagtgtatatttcataatgtatcaaaatggtgtctatacctaaggtagcattattgaagagagatatgtttatgtagtaagttattaacataatgagtaacaaataatgtttccagaagaaaggaaaacacattttcagagtgcgtttttatcagaggaagacaaaaatacacacccctctccagtagcttatttttacaaagccggcccagtgaattagaaaaacaaagcacttggatatgatttttggaaagcccaggtacacttattattcaaaatgcacttttactgagtttgaaaagtttcttttatatttaaaataagggttcaaatatgcatattcaatttttatagtagttatctatttgcaaagcatatattaactagtaattggctgttaattttatagacatggtagccagggaagtatatcaatgacctattaagtattttgacaagcaatttacatatctgatgacctcgtatctctttttcagcaagtcaaatgctatgtaattgttccattgtgtgttgtataaaatgaatcaacacggtaagaaaaaggttagagttattaaaataataaactgactaaaatactcatttgaatttattcagaatgttcataatgctttcaaaggacatagcagagcttttgtggagtatccgcacaacattatttattatctatggactaaatcaattttttgaagttgctttaaaatttaaaagcacctttgcttaatataaagccctttaattttaactgacagatcaattctgaaactttattttgaaaagaaaatggggaagaatctgtgtctttagaattaaaagaaatgaaaaaaataaacccgacattctaaaaaaatagaataagaaacctgatttttagtactaatgaaatagcgggtgacaaaatagttgtctttttgattttgatcacaaaaaataaactggtagtgacaggatatgatggagagatttgacatcctggcaaatcactgtcattgattcaattattctaattctgaataaaagctgtatacagta

SEQ ID NO: 1550 - DNA, 651 bp, Homo sapiens
attgacatttaaactctggggcaggtcctcgcgtagaacgcggctgtcagatctgccacttcccctgccgagcggcggtgagaagtgtgggaaccggcgctgccaggctcacctgcctccccgccctccgctcccaggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcagacccatgcagatgcaaaagtccaagtgctggacaatcaaaacgtgtccaacggatgt

SEQ ID NO: 1551 - DNA, 455 bp, Homo sapiens
tgagccatcaccaatcagcataggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggcc

SEQ ID NO: 1552 - DNA, 497 bp, Homo sapiens
aagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcagacccatgcagatgcaaaagtccaagtgctggacaatcaaaacgtgtccaacggatgtgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgcc

SEQ ID NO: 1553 - DNA, 574 bp, Homo sapiens
agtcaacaaatggcacgtgggagaagttggtgagtgtttggtgaggactcttcagggcttttcacaagaaccctctgtacacaaagaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctggg

SEQ ID NO: 1554 - DNA, 677 bp, Homo sapiens
gcagcgtcctcactgtcccggctgccaggggctgcggcgacgcggccagtcagcagcgagttcaggtcgcgcagattttattgatgagctctgactttcagcactttccctaagtcaagaagagtctagcgtacccttcggctgcttcatttcagcctccctgcctcagctcttcagccctattccccctcgccctgtcctggggtgtgtacagcagcccaggccttccttctccttcccggctccgtggcccgaagccgccgagagagctcgggacagcgcaggaccaggcagccgctcgctctcctgtcaccttaactgcaggctccgaggggcgcctttggagtgtactgaggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcag

SEQ ID NO: 1555 - DNA, 6173 bp, Homo sapiens
gattagtgggtttgaaaagggaaccgtggctcggcctcatttcccgctctggttcaggcgcaggaggaagtgttttgctggaggatgatgacagaggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtaagtgcctctggtctttctgggacttcgggctcggggtgcgcggacccgagggtcaggggaggacacagggactcgcgacgcccgcgctggcccggccgccgaccgactgaggcccggggacctgcggcggctgctccccgctccgcgcccggcagcccgggaggggagggcgtttgcttggctcttctcgatactggagaagcaggggctgggcccttaagaacagcccgcccgagttttcgaagctgcggtagagaaaccccatcccccccaaatcctgtaactcacaccccctctcgcccctgcccgggctctgaccccggagagaggggctgggctgatcagggcggggcgaagtcttctcctagttgagcgagaaggaggcccctttgggcttagccaagactgaaagtctccaccaacccggcggggttgggggcttctctccccaagtcactctcagggcagctcctcccctcctcaccccactacgggcctagaagggatggggagaggagcccccaggcctgcagcagggtaggggtggtaaactcgctgttacagggcgcgggagagagcacggtttactgggtctggtaaggaggtgcccaggaattggaaaatccctgccctggcaactgcaattgcttgggtcctgatagtcccaggcccagagcgcttttgatacttatggcccttgtacctccctgctttcctctgcccagaccccgtggggtcccacccaccttcctgttcgtggtgggtgctggtacgcggcagggctagtctagagctccgacctgggagcctggaggcccagcgaaaccaggcccggtttgaggttacggttgaggcacacggcgtcggggctcaactgaactcaaagtgtggaaaggcccgggtcttccagcagcctgccctggccgaaccacacaggcttaaggagggtccccagcaccttatccatctgttttggaaacgccggtcgccccctggtgcttccggggctggtaagcgcgtagctgaggaaagggcacaaaggtggcgagctttgcgggagtagttgtgcagaacctgccggaccccagggcttggccggtaggctcgccttcggcggctgggctctccccttggagctcagactccccagccgcaggctgtctctcgggcgggccccagccagggcgcgcagccctgagcgtttgtcgctgcggcccggctggcaggccccgaggggcgcggggtcgcgggccggccggcagggctttgtgccgctcgttcccgggtgtgcgcgaggcgcggagcatccaaattgacaccatatgttttcctattagttgcttcgcggtcgagttctaggcgcataatcatcgccagtgggcgagagcgccagcagtccctagggaagggacacaatgattgaggcttaacctctgaaggggaatttggagctgcgctttctctctgccatttcgatgctgggagtggcgctctggccctggcgtctcctgggcaagcaccagccggcggtatctgcggaggtggctggcacgttgttattttttgaaatgagtgaggagggaggtctagatttaggcggccttacgcgcccgccttggcattagcagactgggaattgccgtggctatgcccgaagtttggaaagtctctctcggtctctttctgggacagcctttctttttccgggaagcttcctgtgcctagaggtggggctctgtagctggaggggtagatggaacttgcgaagcaaaggaaggcaataaaaggaagttaggagaaaccggaaacgtgggccaggccttgctctgttggagaagcggtgtccccgcaaagtccctgcttgcgctggtcccggccggagcccagatcccccaaacgcctgtcacttctcatcgagttgaggctccggcccccacccgcgccttggtgagggccccccctcagccccaagccttcggctaccctgaaaacgcggctcccctcgaaggggaaacaagtgcagttcaatctcgtctgagtgatctacaaataaggacggaaagggtcgttttatcacggtcccgtttgtcgtgacgatgcaatttcccggagcggagcactgtcacaaagtgacaaggctgccacaagcgccccgactgatcttttcaattagccttccatgcatgatccggagcgacttccgcctatttccagaaattaagctcaaacttgacgtgcagctagttttattttaaagacaaatgtcagagaggctcatcatattttcccccctcttctatatttggagcttatttattgctaagaagctcaggctcctggcgtcaatttatcagtaggctccaaggagaagagaggagaggagaggagagctgaacagggagccacgtcttttcctgggagggctgctatctaagtcggggctgcaggttggagatttttaaggaagtggaaattggcaattggctttgtgtgtctgtggtttttggggagggggactacaaagaggggctaactccctctccctattctctaaggttggaccacagggatgaggttgtgagatacaaagataaaggagggatggggaacactatgatgtggtatttttcttttctgttttttctttttgataatatctatccttggctaaggggagggcggagttcagcggcggaaataaagcgagcagtggctggtgcgaaccgactcccggctctaagccttacttgcggtggccggacttgtctgtggctgaagccgagcccgggctctgactctcacgtctgcactggaggtgcggaaacctggactggggttcaccagccacatactggctgctctggttgttctctcctcttccttcttctattctaaccaaacaaaacccaactcgatgcttgtgccaggccttggccagtttggacggtgatggaaacatttctggattttagcgtctaagggagcactcaagggctgtaaggtttgctatcactgtcccaacactgcagagaccttgaaggttcagtgtgggatctgtagaacccatggtttgcggtgacactcagaggggatctttgggagatttatagagccggttcttagcgctttgtgggttcagaggctggctgcagtgtttatgaagaggggcagtgggctggggacactgctggggttatggctgtagtgaggtccatgtgtacttgttccttggcatgtgtctgactctgtgttgctgctgcagtacagtgggcaggggcacggttgcttggactgggctgcccgatgtctggcatggctggtggtcctgttgtcctttatttgatcgatagcagggaactgaccgccgaggttggcacaggttggcagggggatgaggatgcattgtggttgtctcctcctcctctccttcttcctcttccccttcctcctctcctttctgttcttgttctccctcatcttcctcttccttcttctccctcttcttcctcttcactctgctctcttctcttcttttcccctttcctctcctctccctttcctcaggtcacagcggagtgaatcagctcggtggtgtctttgtcaacgggcggccactgccggactccacccggcagaagattgtagagctagctcacagcggggcccggccgtgcgacatttcccgaattctgcaggtgatcctcccggcgccgccccactcgccgcccccgcggccctccactctcaacgccctctcttcatttcttactgtaaacgatgctaattatggacccccccaccctcacccaccccagtccccagtccccccacccactcccctgccttcccactttcccctctccttccaccatccttccctatctctttcaacctgggtcagttacataagataactcatctgcttcagaaaaatattgtgtgcggatttttttaaaaaaatctttctctttttatttggtaaagacattcattgtgggaacagtttatgaaccgtaataagctgagttatataaaccggcataatttcattctgctctccccagcccatgcttacctcagcttttgaggtatttgtttattcttcatgtttatgaataatatatattgattttaaaaggcaaatgctatttactcctccctaactcacatttactcaattgagtattttttaaagaagaagaagtaaaaaaatcagtttattttttacctttgttctttaaaacataacgccactttaagcaaggtcagcacaaaaataaatttatctacttcgttttgatgcatcttcaggcagtgtttaagaaaagttttttttttaaaaaaagcttttaaattcgttttttagttcaaattgtttgaaagtatcatcatatttgtagtttttagggctacaaatgtaattttaagaaaaaaagctctctacagtaagttctcataccattgaaggtatatttttgtgttatagacccatgcagatgcaaaagtccaagtgctggacaatcaaaacgtaagcttgtcattgtttaatgcatacttaaacaattttatttttgtcttgaaattattaataatgtggttttctgtccacttcccctatgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagt

SEQ ID NO: 1556 - DNA, 3861 bp, Homo sapiens
gcggccgctctcagcggagggggcggccccggggcccaggcgccgcggcccggcaccccgtggaagagccgcgcgtacagcccgggcatccagggactacatgaggaaataattgacttttataacttcatgtccccttgtcctgaagaagcagctatgagaagagaggtggtgaaacggatcgaaactgtggtgaaagacctttggccgacggctgatgtacagatatttggcagctttagtacaggtctttatcttccaactagcgacatagacctggtggtcttcgggaaatgggagcgtcctcctttacagctgctggagcaagccctgcggaagcacaacgtggctgagccgtgttccatcaaagtccttgacaaggctacggtaccaataataaagctcacagatcaggagactgaagtgaaagttgacatcagctttaacatggagacgggcgtccgggcagcggagttcatcaagaattacatgaagaaatattcattgctgccttacttgattttagtattgaaacagttccttctgcagagggacctgaatgaagtttttacaggtggaattagctcatacagcctaattttaatggccattagctttctacagttgcatccaagaattgatgcccggagagctgatgaaaaccttggaatgcttcttgtagaattttttgaactctatgggagaaattttaattacttgaaaaccggtattagaatcaaagaaggaggtgcctatatcgccaaagaggagatcatgaaagccatgaccagcgggtacagaccgtcgatgctgtgcattgaggaccccctgctgccagggaatgacgttggccggagctcctatggcgccatgcaggtgaagcaggtcttcgattatgcctacatagtgctcagccatgctgtgtcaccgctggccaggtcctatccaaacagagacgccgaaagtactttaggaagaatcatcaaagtaactcaggaggtgattgactaccggaggtggatcaaagagaagtggggcagcaaagcccacccgtcgccaggcatggacagcaggatcaagatcaaagagcgaatagccacatgcaatggggagcagacgcagaaccgagagcccgagtctccctatggccagcgcttgactttgtcgctgtccagcccccagctcctgtcttcaggctcctcggcctcttctgtgtcttcactttctgggagtgacgttgattcagacacaccgccctgcacaacgcccagtgtttaccagttcagtctgcaagcgccagctcctctcatggccggcttacccaccgccttgccaatgcccagtggcaaacctcagcccaccacttccagaacactgatcatgacaaccaacaatcagaccaggtttactatacctccaccgaccctaggggttgctcctgttccttgcagacaagctggtgtagaaggaactgcgtctttgaaagccgtccaccacatgtcttccccggccattccctcagcgtcccccaacccgctctcgagccctcatctgtatcataagcagcacaacggcatgaaactgtccatgaagggctctcacggccacacccaaggcggcggctacagctctgtgggtagcggaggtgtgcggccccctgtgggcaacaggggacaccaccagtataaccgcaccggctggaggaggaaaaaacacacacacacacgggacagtctgcccgtgagcctcagcagataatggctcctggctgcgtcagcctcccccacccctctgcagactgccccgcggcctcggccaccggcaggggaaccgagaccagcaccccgcacgtcagccgggctcgcggcacgcccgccgctgatcactctgcatgtttcttcgtgtggtggtcgcgtccatcttcaagaacagctcgttgtgctcatctgtgaagccttattaaacgtggacgttgttttctgccttcccaggattcttccttcagtgctgaggcaggtcgggctcaggaactgcagggacgtgaacatgcgcttgcggtttgaggtagccgtgtctgttccttcgcggtttgctattttcatttcctgttcgtcaaagcagcagaggagatcaaaccccgttcgtgtgtctttcctccacggataagcttgggaggtcattgttttactgccctcacattttgtttgaaatttcagaactgtttttctatgtaaatattgaaaacttatgatttgtgcaataactcagatattttttatttaatttcctattttcacataagttatatttaagggaggagggaattttttttaaacaagcttaggtcctttcccgagctgcattttctaagttgggtcatcgtgtcggctggttgtctgacgagcatcgttacaaacaccatgatgaggggtttggggttttattttgatgtcttttcttttggtcggaagtgagtgaaggagccaggtcgccctgaaggttttccaaagggcttggctccagagccacctggcagactgcccgtggccctgctgtcgggccccaggccgttgtcctgctctgaccacagagttttaatgttttggttttcacttcttttaaactggacaacaaatccagcatttcaagtgccagaagtataactttctaaggagagaagggttgtcacattataaaatctttaggaaaatgtgaactggaaaacgcttcggtcagttttagtgacatagcctgtgatgatgggtctggtgactattattgcggaccgtggtacccagttttaggaatgtggagaaaggaattctgttgattccgttgaggaatctgtagcgtatgcattcgttctgttaagagcaaatctaggagaagtgcttcagctgcccagtgcgccgtggggagtgttttaacggatcgtgtcgcaggagagcacagcccagcgttggggccgggaccgctggcgcccgacgtcggaagcatacaggtatactatgcaagtgtattctgccacaacaaccactgtctttgttacctttttttgaacaagaatatatccatcctgcctaaccctgagtttttggagcaccacagttgtcctgggagttggttgcatcttgtaggccatctgacttcctgtttttaaaacgggggtctggtcttgctaaacactacaggtaggttggtctttgaagtccactagtggagaatgtcaagacaagatacttattaccatgacatctgatgcatgtgcagcagtggggagttctagattgatctctgaatgtgatcgacgcccagcaaggacaagctttaaaatgtctgcggtctgcccttttgaagcaggactggctcactctgtcattgggagctgtcagctgcgactgcaggttctctaggaggcattccagaatagagtagcacactgtgtctgcagttctcgatgaccgaaagttatcaaaaatatttaaaatatttaaattgtgaacctattgataaagaatatttataaaaactgatctgtaggcctgtactaatctctacgcattagcaatattgactgtaaacccacattaaggaaaccactacgggtctggcagtgcgtgtcccgtggggtgtgcattttaaaactcgattcatagacacaggtaccatgttccatttccgtcatggtgaagcaaatgaattggcctggctaccactgtggtcgcgtgctacaggtttgacaaaaagatatcatgtttcgatttttttgtgtgtggacaacaatatggaagctaaaattgacatatttttatgtaaagtttttctattctttgatttttaataaactttggaaaccagttt

SEQ ID NO: 1557 - DNA, 603 bp, Homo sapiens
cccggggcccaggcgccgcggcccggcaccccgtggaagagccgcgcgtacagcccgggcatccaggggtgagtgcgcggggaggccgcgggggcgggggcggggcccatggtcctggccggcgcccgcggtgcagacacccgtcccaggcgcccgggcttttggaggatggatgttgaaggctaaggccaaggcccgactctgcactgaaagttttttttttaaacatcagactcatttatcgtggagtgacttgcccagatcctacaagtaacagtccaagaaaaggggctgctgggtaggacctgcaggtatttgtcttttttactcttgagattggaacgggaaatcgactctctacccctccaccccgcctccgggcaagtgaggaaccccttgtcaaagtggggcgtagataagtgtggagtttcacgtaagttaagttgcagaataatttagcattgccaggaactcgaatcacgtcgaagactacatgaggaaataattgacttttataacttcatgtccccttgtcctgaagaagcagctatgagaagagaggtggtgaaacggatcgaaactgtggtgaaagacctttggccg

SEQ ID NO: 1558 - DNA, 4950 bp, Homo sapiens
gctcggggaagcggcaaagttggatctgggagggcgtccgctgcggctgcgggagccgaaaggctgccagttcccggcagcgctgggaggagggaggcgcgggcggggcgcggcgccggggaggggagcggtgctcaggggagggctggaggggagggaaggagagagagaggggagggcggcaccgcccctagccccgcgctccggaagtgaagcggccagaccaccagctaatggatgcggagcggagggcccgctgaccgctctccgcgcctggagcagcttggcttggctggagctaagagccagacacaccactgtgtggaggtgggtgatgtcttcctgtgctaaaaggtgaataaataagctcctcacctctcgcggaacactcgggaacacatcaacaggggtccaagccgccctgctgggaggcttctcttcaagagttctgggtcccagagtggaaggcattttcccatcaactggagagagacgaaacatcagagaccaggaggctgtggagaaagcagctgtcccaggtgcctcaactatcagagaagggtcagcgtcacgtggctgccagcatctttgagaaaatcactggcaatcggacttcagagctgcgggcacaggtgtggttagaactgagatacgacctgcccacctgggtcaggcctaaagacaagaagtcctgagttcttgccactgagtaggccagggtcatttgtccagaaaactttgtgactgtctttgagtgacctagtctgggacccattcattggtgggttctaaggttagaagctcatccaggatattttcaatattaagtcagtgcatagctgcaccactaacaaattggtgcctgtagagtcagagtgggtcaattcttaggacaatggcgctggcactgttagaggactggtgcaggataatgagtgtggatgagcagaagtcactgatggttacggggataccggcggactttgaggaggctgagattcaggaggtccttcaggagactttaaagtctctgggcaggtatagactgcttggcaagatattccggaagcaggagaatgccaatgctgtcttactagagcttctggaagatactgatgtctcggccattcccagtgaggtccagggaaaggggggtgtctggaaggtgatctttaagacccctaatcaggacactgagtttcttgaaagattgaacctgtttctagaaaaagaggggcagacggtctcgggtatgtttcgagccctggggcaggagggcgtgtctccagccacagtgccctgcatctcaccagaattactggcccatttgttgggacaggcaatggcacatgcgcctcagcccctgctacccatgagataccggaaactgcgagtattctcagggagtgctgtcccagccccagaggaagagtcctttgaggtctggttggaacaggccacggagatagtcaaagagtggccagtaacagaggcagaaaagaaaaggtggctggcggaaagcctgcggggccctgccctggacctcatgcacatagtgcaggcagacaacccgtccatcagtgtagaagagtgtttggaggcctttaagcaagtgtttgggagcctagagagccgcaggacagcccaggtgaggtatctgaagacctatcaggaggaaggagagaaggtctcagcctatgtgttacggctagaaaccctgctccggagagcggtggagaaacgcgccatccctcggcgtattgcggaccaggtccgcctggagcaggtcatggctggggccactcttaaccagatgctgtggtgccggcttagggagctgaaggatcagggcccgccccccagcttccttgagctaatgaaggtaatacgggaagaagaggaggaagaggcctcctttgagaatgagagtatcgaagagccagaggaacgagatggctatggccgctggaatcatgagggagacgactgaaaaccacctgggggcaggacccacagccagtgggctaagacctttaaaaaatttttttctttaatgtatgggactgaaatcaaaccatgaaagccaattattgaccttccttccttccttccttccctcccttcctccttctctccttctctcctcctctctcctctcctctcctctctttccttccttccttccttttttctttttctctttcttctttatttcttgggtctcactctcatcacccaggctagagtgcagtggcacaaaaatctcggctcactgcagccttgacttcccaggctcaggctcaggtgatcctcacaccttagcctcccaagtacctgggactacaggcacgcaccaccatgcctagctattcttttgtatttttggtagagacagggttttgctgtgttgctcaggctggtctggaacccctaggctcaaatgatgtgcccaactcggcctcccaaagtgctgggattacaggcatgaaccgccatgcctggcccttgatttttctttttaagaaaaaaatatctaggagtttcttagaccctatgtagattattaatgaacaaaagattaaactccaaatattaaatagtaagcctgaaggaatctgaaacacttgtacttccaattttctttaaataatcccaaatagaccagaattggcccataccatagaagaaagaattggcagtcaaaaaaaaaaataccttttgtaatgtttgaaaaataaagctgtttgacttgtcaggtgttttcctttctcaaatcagcaaattctctctgagtgcctggctttgtgagacactgtacaaggagttacaagactacagctataacctgcagttgagcagttataaacctacaaaatgggccctgccctcagagaggttccagtctagatgaggagctgatctagacaggtaaaaggctaactaaccctttgtgtaaataagttcatcaccccagtaaaagtgtcatcacccagtgaataggaccacctctgcctgcagatttttgttgttgttgttgtcattgttgttgttgttttaacctgggaagtgttcttcctgcctttctgctaggtgtcagatagatggtcccagagctaggtgctgtgtcaggccctgaagacacagatgactcaacctaagctttactttccagaggtccacagcctgagaggtgtccccaaagaaagggggacatgaggggactgcatgcttgagagcagggttgtttagggcaggtttggatttagtgagcaggctggtttgcttagagaaggcttttagtggcaacaaaggatgaagaggagagaaaaggaactcacatttattgagggcctactgtgtgcaaagtgtttcatgtatatctcattgaatgtatacagccaccctgttgtggtataattttgctctttataaagagaaagaccgaagctcagatgagttaagtggtctcctcaacaccaaaatgccaagaagtgatggagcctagacagaagcccagaactttctgactcacactagtccatcctctaccatcacgatgactttcaaattgtgctctgcagttctgcagattttctagcagtgccatctccaaaatgtgttttaaactctttatttttttaattattattagtattattttgagactgagtcttgctctatcacccaggctggagtgcagtggtgcaatctcagctcactgcaacctccgcctcccaggttcaagcgatttcgtgcctcagcctcccgagtagctgggattacaggcacccaccaccacgcccagctaatttttgtatttttagtagaaatggggtttcaccatgttggccaggctggtctcgaactcctgacctcaagtgatccactcacctcggcctcccaaagtgctgggattacaggtgtgagccaccatgcctgggctaaactctttaagtctctagtaaatgcagctagattcaaatgggctgataaccaaattttaacacatcagcattcaccaccaggtttacttttattttcagattggctcattttgtgcagaccttagagcaaagtttcctttatggtatctgtgtacgtatccaaacttcttttaattgttcacagattttaaaagcggtagcaccacatggttgtgtagatcagacctgtgtatttagatcagacctgtgtatcacgtaagtgtgtgagtgcagtgcagatgagcaccatttagttatatgtgctaggcaaatctccaacacagttgatgtgtagtcttgtggtagatttgtgcatactgtaagcaaattgcttagcttctctagacatcagtttccacatctgaaaaataagaagatgagagtacacggttgttatgaacaaatgacttaatgctttttaagcacgttgcatgacatctggaacacagaaagccctcaatacattgaagctcttaggattttcacgatgttcctgtctgctcaatgcatgctttctttattgttctgacagttgtgtggtaacaagctaatatgcttccagttgacttccagtctaccctggtgttagaaaccgtttcatctcttattgtaaatttgagtgcttgttgttttttatatttgtgatgactcttccagcagttgttgacaattgttagaggtttgacttttaaataattacttattttttctgattgtggttcagtttaactgaagaatatcctgagattgtaagaaaagcattttttaaaaggtatcacttgtgatcatttatctttctaaattctatttttaatactgttccaccaaagtgatgcagtggttaccatgacaccctaatttcatgtgtttttgtatttatgaaaatagtttcattgtcatttattggcggtatacaaagtaaaatgttataaatgtgaagttataaaataaatatatgctaataaaa

SEQ ID NO: 1559 - DNA, 2246 bp, Homo sapiens
attagtatccgcagagattcgaggacatgccgttgaccttgttacaggactggtgtcggggggaacacctgaacacccggaggtgcatgctcatcctggggatccccgaggactgtggcgaggatgagtttgaggagacactccaggaggcttgcaggcacctgggcagatacagggtgattggcaggatgtttaggagggaggagaacgcccaggcgattctactggagctggcacaagatatcgactatgctttgctcccaagggaaataccaggaaagggggggccctgggaagtgattgtaaaaccccgtaactcagatggggaatttctcaacagactgaaccgcttcttagaggaggagaggcggaccgtgtcagatatgaaccgagtcctcgggtcggacaccaattgttcggctccaagagtgactatatcaccagagttctggacctgggcccagactctgggggcagcagtgcagcctctgctagaacaaatgttgtaccgagaactaagagtgttttctgggaacaccatatccatcccaggtgcactggcctttgatgcctggcttgagcacaccactgagatgctacagatgtggcaggtgcccgagggggaaaagaggcggaggctgatggaatgcttacggggccctgctctccaggtggtcagtgggctccgggccagcaatgcttccataactgtggaggagtgcctggctgccttgcagcaggtgttcggacctgtggagagccataaaattgcccaggtgaagttgtgtaaagcctatcaggaggcaggagagaaagtatctagctttgtgttacgtttggaacccctgctccaaagagctgtagaaaacaatgtggtatcacgtagaaacgtgaatcagactcgcctgaaacgagtcttaagtggggccacccttcctgacaaactccgagataagcttaagctgatgaaacagcgaaggaagcctcctggtttcctggccctggtgaagctcctgcgtgaggaggaggaatgggaggccactttaggtccagatagggagagtctggaggggctggaagtagccccaaggccacctgccaggatcactggggttggggcagtacctctccctgcctctggcaacagttttgatgtgaggccttcccagggctaccggcgccggaggggcagaggccaacaccgaaggggtggtgtggcaagggctggctctcgaggctcaagaaaacggaaacgccacacattctgctatagctgtggggaagacggccacatcagggtacagtgcatcaacccctccaacctgctcttggtaaagcagaagaaacaggctgcagttgagtcgggaaacgggaactgggcttgggacaagagccatcccaagtccaaggccaagtaggctcgggagaacagggcaacatttcctaccacaggccaaggagacaaaagagatattggaaggaggggaaagagaagcccagacaaacagcagatgagttgagtggggcagagggacagggcagccagaccaaggccaagccttctcacccttggccagctggaagggacttcagcaaccaagaccacctggcaacaggctcagtgggggtcaggtccaggtccccgaagaggtgctggagaggaaagcagggagccactgcatccagcacatggggtgcctgggcctcagatggggaccccaaagaagcagaagctgaagaaggtacggctgggggttctgtcctgctcatccaaccacccctaaatacccaccctgtggactttgagctgaacatgcccactggcccccaggccacatgggacctggaggagcctacctggggcctgcccctgccagcaggtgccagggctggtgaggaagagctggggggcagaggtaaagccctgcaggggaggccacagggtccatcccgtcttcaggatcatctacactgcactaggggagccccaggaaggcagcaccctggaggccctgtgccagtgaggacaggagaccctaaggccccgggagcccagtgccagccagaggttgtgcaggcaaggagaccaaagattgatgagaagacccccagcaggggtactgggtacccggcaggccagtgccctcacagttgacttggaccagggtggctgtgaagggaagtctttgttgcaaaggaggaggaggaaaagggaggacttggtagggttttgtttcttctgcttg

SEQ ID NO: 1560 - DNA, 3158 bp, Homo sapiens
gtgctgcgcgagcgagggagagccacagtctgagcgaacgtccgcgctgggagccaggggtgcccgacccccgtccgccgccgccgccgccgccgcgcatagcccccggagagccctctggggaccccgaccagaagggaccttgccctgggagaaggctgtggagacctgggccttctgcgatcaccctaggagttgatccagatatgtgcctcacgccctgatcactccccccaaattagtatccgcagagattcgaggacatgccgttgaccttgttacaggactggtgtcggggggaacacctgaacacccggaggtgcatgctcatcctggggatccccgaggactgtggcgaggatgagtttgaggagacactccaggaggcttgcaggcacctgggcagatacagggtgattggcaggatgtttaggagggaggagaacgcccaggcgattctactggagctggcacaagatatcgactatgctttgctcccaagggaaataccaggaaagggggggccctgggaagtgattgtaaaaccccgtaactcagatggggaatttctcaacagactgaaccgcttcttagaggaggagaggcggaccgtgtcagatatgaaccgagtcctcgggtcggacaccaattgttcggctccaagagtgactatatcaccagagttctggacctgggcccagactctgggggcagcagtgcagcctctgctagaacaaatgttgtaccgagaactaagagtgttttctgggaacaccatatccatcccaggtgcactggcctttgatgcctggcttgagcacaccactgagatgctacagatgtggcaggtgcccgagggggaaaagaggcggaggctgatggaatgcttacggggccctgctctccaggtggtcagtgggctccgggccagcaatgcttccataactgtggaggagtgcctggctgccttgcagcaggtgttcggacctgtggagagccataaaattgcccaggtgaagttgtgtaaagcctatcaggaggcaggagagaaagtatctagctttgtgttacgtttggaacccctgctccaaagagctgtagaaaacaatgtggtatcacgtagaaacgtgaatcagactcgcctgaaacgagtcttaagtggggccacccttcctgacaaactccgagataagcttaagctgatgaaacagcgaaggaagcctcctggtttcctggccctggtgaagctcctgcgtgaggaggaggaatgggaggccactttaggtccagatagggagagtctggaggggctggaagtagccccaaggccacctgccaggatcactggggttggggcagtacctctccctgcctctggcaacagttttgatgtgaggccttcccagggctaccggcgccggaggggcagaggccaacaccgaaggggtggtgtggcaagggctggctctcgaggctcaagaaaacggaaacgccacacattctgctatagctgtggggaagacggccacatcagggtacagtgcatcaacccctccaacctgctcttggtaaagcagaagaaacaggctgcagttgagtcgggaaacgggaactgggcttgggacaagagccatcccaagtccaaggccaagtaggctcgggagaacagggcaacatttcctaccacaggccaaggagacaaaagagatattggaaggaggggaaagagaagcccagacaaacagcagatgagttgagtggggcagagggacagggcagccagaccaaggccaagccttctcacccttggccagctggaagggacttcagcaaccaagaccacctggcaacaggctcagtgggggtcaggtccaggtccccgaagaggtgctggagaggaaagcagggagccactgcatccagcacatggggtgcctgggcctcagatggggaccccaaagaagcagaagctgaagaagggccaccagactcctggagagatcaagcaaggagaacctggggctgccatggccaaagcaactcaacagatgccaatgccaattccaaggccagccacaaccctgccaccttggggaatccagcctggaggcatcccctaagcagccagccatggcctgggtggaggcacctgaagacgtctgtcccaaactcccccagccctgagctgggagatgacagggggaaagaggccctctcaagggtgccagatgcctgggtctcccaagaggggtcccccaactcaccgttcccgggacaggctgccccctgttccaggaagctcatcctcacctgtgtaggcccctgtagtgacccacgcgtccagcagacgcccacccaccgctagccgttgttcctgtgcaaagtagtgtgctatgcacccacccaggtggccgcctctgggcccaaggcacatgctgtgagcttcctgtgagcccaggctctgctcactgctgtcccgcgtcatgagcaccacctctgctttccctgtgtagatctaggccagtggctgcttgttcttgtggagctgtgtgtgttcttctctgagcagctcctccccggagtcccccagcacagtcccaggagatgacaggaaggaagcaccagggcaaggcggacgctcaccctgtgaccacgatggtgaccgtgactgtgggaggaagaactggacccaggacggagcggggctgccctgcctgaggctcccgaggagctttgtgctttggtgttccacccctgttgttactcatgactcagtttccttgacctggtagggtgttccctgctgtgttttccagtgtcctgtgactgtcctgtgcgggccatagggcagggccctgtcccagcagatgggcttgggagggggctccctaaagccagtggacactgccagagtctaccttcctggcaagaggcagaccccggggccctcaggaaggagggagttggcagcgggggctgcagcaggagtaggagcagatgaggcgtcttgccaggaacctcaggaggagggggcccgggacctgtgtgggacctgtgtcctgtggtggccgtttgcagtttctctctgtgttgtgattcccttctcttcaacgttttcagtacgtgtttctcttcaataaacttcattcagtgttcca

SEQ ID NO: 1561 - DNA, 3751 bp, Homo sapiens
ccgccgccgcgcccccgccccgtgtccgcactgcagagagccgcggcgagcaggcgccggcgcactggcccacgtgctgcgcgagcgagggagagccacagtctgagcgaacgtccgcgctgggagccaggggtgcccgacccccgtccgccgccgccgccgccgccgcgcatagcccccggagagccctctggggaccccgaccagaagggaccttgccctgggagaaggctgtggagacctgggccttctgcgatcaccctaggagttgatccagatatgtgcctcacgccctgatcactccccccaaattagtatccgcagagattcgaggacatgccgttgaccttgttacaggactggtgtcggggggaacacctgaacacccggaggtgcatgctcatcctggggatccccgaggactgtggcgaggatgagtttgaggagacactccaggaggcttgcaggcacctgggcagatacagggtgattggcaggatgtttaggagggaggagaacgcccaggcgattctactggagctggcacaagatatcgactatgctttgctcccaagggaaataccaggaaagggggggccctgggaagtgattgtaaaaccccgtaactcagatggggaatttctcaacagactgaaccgcttcttagaggaggagaggcggaccgtgtcagatatgaaccgagtcctcgggtcggacaccaattgttcggctccaagagtgactatatcaccagagttctggacctgggcccagactctgggggcagcagtgcagcctctgctagaacaaatgttgtaccgagaactaagagtgttttctgggaacaccatatccatcccaggtgcactggcctttgatgcctggcttgagcacaccactgagatgctacagatgtggcaggtgcccgagggggaaaagaggcggaggctgatggaatgcttacggggccctgctctccaggtggtcagtgggctccgggccagcaatgcttccataactgtggaggagtgcctggctgccttgcagcaggtgttcggacctgtggagagccataaaattgcccaggtgaagttgtgtaaagcctatcaggaggcaggagagaaagtatctagctttgtgttacgtttggaacccctgctccaaagagctgtagaaaacaatgtggtatcacgtagaaacgtgaatcagactcgcctgaaacgagtcttaagtggggccacccttcctgacaaactccgagataagcttaagctgatgaaacagcgaaggaagcctcctggtttcctggccctggtgaagctcctgcgtgaggaggaggaatgggaggccactttaggtccagatagggagagtctggaggggctggaagtagccccaaggccacctgccaggatcactggggttggggcagtacctctccctgcctctggcaacagttttgatgtgaggccttcccagggctaccggcgccggaggggcagaggccaacaccgaaggggtggtgtggcaagggctggctctcgaggctcaagaaaacggaaacgccacacattctgctatagctgtggggaagacggccacatcagggtacagtgcatcaacccctccaacctgctcttggtaaagcagaagaaacaggctgcagttgagtcgggaaacgggaactgggcttgggacaagagccatcccaagtccaaggccaagtaggctcgggagaacagggcaacatttcctaccacaggccaaggagacaaaagagatattggaaggaggggaaagagaagcccagacaaacagcagatgagttgagtggggcagagggacagggcagccagaccaaggccaagccttctcacccttggccagctggaagggacttcagcaaccaagaccacctggcaacaggctcagtgggggtcaggtccaggtccccgaagaggtgctggagaggaaagcagggagccactgcatccagcacatggggtgcctgggcctcagatggggaccccaaagaagcagaagctgaagaaggtacggctgggggttctgtcctgctcatccaaccacccctaaatacccaccctgtggactttgagctgaacatgcccactggcccccaggccacatgggacctggaggagcctacctggggcctgcccctgccagcaggtgccagggctggtgaggaagagctggggggcagaggtaaagccctgcaggggaggccacagggtccatcccgtcttcaggatcatctacactgcactaggggagccccaggaaggcagcaccctggaggccctgtgccagtgaggacaggagaccctaaggccccgggagcccagtgccagccagaggttgtgcaggcaaggagaccaaagattgatgagaagacccccagcaggggtactgggtacccggcaggccagtgccctcacagttgacttggaccagggtggctgtgaagggaagtctttgttgcaaaggaggaggaggaaaagggaggacttggtagggttttgtttcttctgcttgtttctgtacagggccaccagactcctggagagatcaagcaaggagaacctggggctgccatggccaaagcaactcaacagatgccaatgccaattccaaggccagccacaaccctgccaccttggggaatccagcctggaggcatcccctaagcagccagccatggcctgggtggaggcacctgaagacgtctgtcccaaactcccccagccctgagctgggagatgacagggggaaagaggccctctcaagggtgccagatgcctgggtctcccaagaggggtcccccaactcaccgttcccgggacaggctgccccctgttccaggaagctcatcctcacctgtgtaggcccctgtagtgacccacgcgtccagcagacgcccacccaccgctagccgttgttcctgtgcaaagtagtgtgctatgcacccacccaggtggccgcctctgggcccaaggcacatgctgtgagcttcctgtgagcccaggctctgctcactgctgtcccgcgtcatgagcaccacctctgctttccctgtgtagatctaggccagtggctgcttgttcttgtggagctgtgtgtgttcttctctgagcagctcctccccggagtcccccagcacagtcccaggagatgacaggaaggaagcaccagggcaaggcggacgctcaccctgtgaccacgatggtgaccgtgactgtgggaggaagaactggacccaggacggagcggggctgccctgcctgaggctcccgaggagctttgtgctttggtgttccacccctgttgttactcatgactcagtttccttgacctggtagggtgttccctgctgtgttttccagtgtcctgtgactgtcctgtgcgggccatagggcagggccctgtcccagcagatgggcttgggagggggctccctaaagccagtggacactgccagagtctaccttcctggcaagaggcagaccccggggccctcaggaaggagggagttggcagcgggggctgcagcaggagtaggagcagatgaggcgtcttgccaggaacctcaggaggagggggcccgggacctgtgtgggacctgtgtcctgtggtggccgtttgcagtttctctctgtgttgtgattcccttctcttcaacgttttcagtacgtgtttctcttcaataaacttcattcagtgttccagccgg

SEQ ID NO: 1562 - DNA, 2286 bp, Homo sapiens
gcggagctgcaggggtggttggctgaggctggcttctgcgtggtgcagctgcgcacgtgtttcagccggcagcgctttaagatttccggggatggaatccgaaatggaaacgcagagcgccagggcagaggagggctttacccaggtcacccgcaagggtggccgacgggcgaagaaacgacaggctgaacagctgtccgcagcaggagagggcggggatgcgggccgcatggacacagaggaggccaggccggcgaagaggcccgtcttcccacccctctgtggggacgggctcctgagtgggaaagaagaaacaaggaaaattccagtcccagctaacagatacacaccattgaaagaaaactggatgaagatatttactcctattgtggaacatttgggacttcagatacgctttaacttgaaatcaaggaatgtagaaatcaggacttgtaaagaaaccaaggatgttagtgctctgacaaaagcagctgattttgtgaaagcttttattctcggctttcaggtggaggatgcacttgccctcatcaggttggatgacctcttcctagagtcttttgaaattacagatgttaaacccctaaagggagaccatctatccagggcaataggaagaatcgctggcaaaggaggaaaaaccaaattcaccatagagaatgtgacacggacaaggatagttttggctgatgtgaaagttcacatccttggctccttccaaaatatcaagatggcaagaactgccatttgcaacctaatcttgggaaatcctccttccaaggtttatggcaatattcgagctgtggctagcagatcagcagatcgattctgatttcaagtcagagactttttatcttgcctttggactctggtgaaaaatactttacagtggtcggtcacaagaaaccagctgaacaatttcagtcatttgaagcctccgtcccttcttccattctcagccagaagcataaacagaaaagaaagatttaagaggattcacactcaacaggttttaggataatttaaatatcaaaaattgattgttatacttaacacattaggtataatttatcatttatctgaaatcacatgtagcagattgcatagtctgtaatcctctcagagggaaacttcttgtttaaacagctctatatggatttatacttttatatttataaatttataacttcatacaaatttataaacatttctttataaattgtaatttaatagattatctcagaaaaacctctctgaatgatgacccttccttaatactgggtgatgtgtgaatatttgtttgttggcagacagggtctcactttgtcacccaggctagagtgcagtggtgcaatctcagctcactgcagcctctgcctcctgagttcaagtgatcctcctgcttcagcctccctagtagctgggactacaggtatgcaccaccatgcctggctaattttttgtattttttgtagagatggggtttcgccatgttgaccaggctggtcttgaactcctggcctcaagggatccgtccgcctcagcctcccaaagtgctgggattacaggcataagccactgcgcctggccttgatgtgtgaatatttgagaggtcataagcagtggttttggccataccgtattataccatatacatcagtaagagctcatcttggaacctgttttgcagtttcttgcagtttcaaaaattaaagacctacatcacagggttaatgtgaagaaagctttatttttcaaatgagtatttaatgaaagtatacataaccaatgttgggtatacagatgcttctcaacttatgatgggtttaggtccagataagcccactgtgagttgaaaataccaaaagtcaaacatcatagcttagcctaccttaaaagggctccgaacactacattagcctacagttgggcaaaatcgtctaatacaaagcctattttataataaagtatgttgaatatctcatgtaatttttgaagattacattgaaagtgaaaaacagaatggttgggtacttgaaatacagcttctactgaatgaataattctaaagttgaaaaataatagtaagaaccatcataagtctgtttcttctagtaaaggtgaaatgatgaaagaatgcttttttcccacccaaaaaactatgctctataaatgcagattagctagtttctgcctgtttaaatggtattattttatacattacaaaatggaaggaacttactttattaaacttaactttgatacttc

SEQ ID NO: 1563 - DNA, 3163 bp, Homo sapiens
acgctgcctccatgcctgcctcccctctctgccacgcccccaccacgcgctttgcactctggggcccacgcacttccctgaagagtctagaagctgctcctcatttccagactttccgggcgcccaccaggctcccgggctctcaccggagaccacagggaggagcttcaaggtaccccaagtccctgcggcctccagcagtgaagagttccacaagggagtcttcctacgtcactgaataatgaatgaagatgagaggggaaaagagaagagacaaagtcaatccaaaaagctctcaaaggaaattaaactggattccatcatttcctacctatgattacttcaaccaagtgacgctacagttattagatggctttatgattacactgagcacagatggagtgatcatttgtgtggctgaaaacatctcttctcttcttggacatttaccagctgagattgtgggcaaaaaattattaagccttctgcctgatgaagagaaagatgaagtctaccaaaagattattctcaaatttcctttactaaactcagaaacacatattgaattttgctgtcatttaaaaagaggaaatgtcgaacatggtgatagttctgcttacgaaaacgtgaaatttattgtgaatgtaagagatatttgtaatgagtttcctgtggtctttagtggcttgttttccagccacctctgtgctgactttgctgcatgtgttcctcaggaggatcggctttatcttgtgggaaatgtttgcattctcaggactcagctcctgcagcaactttacacttcaaaggcagtcagtgatgaagctgtacttacacaagattcagatgaggaaccttttgtgggagagctcagtagctctcaaggtcaaagaggacacactagcatgaaagccgtgtacgttgaacccgctgctgctgctgctgctgctgctatctcagacgaccaaattgatattgcagaggttgagcagtatggaccacaagaaaacgttcacatgtttgtagattctgattcaacttattgctccagtacagttttcctggatactatgcctgaatctccagccttatccttgcaagactttcgaggtgagcctgaggtgaatccattgtacagggcagacccagtggacctggagttctcggtggatcaggtggactcagtggaccaggagggcccaatggaccagcaggacccagagaacccagttgccccgttggaccaggcaggcctgatggatccagtggatccagaggactcagtggacctgggggctgctggcgcaagtgctcagccattacagccatcatcaccagttgcatatgacatcattagccaggaactggaactgatgaagaagttgaaggagcagctagaagagaggacttggttgctgcatgatgccatccaaaaccagcagaatgcattggaattgatgatggatcaccttcagaagcagccaaacacattacgccacgttgtcattcctgatctccaatcttcggaggcagtgcccaagaaacaacagaaacaacacgctgggcaagtgaagcggcctctcccacatcccaaggacgtcaagtgtttctgtggtttatctttatccaactctctcaaaaacactggggagcttcaggagccttgtgttgccttcaaccagcagcaactggtgcagcaagaacaacacctgaaggagcagcagcggcagctgcgggagcagctgcaacagctgagagagcaaaggaaggtgcagaagcagaagaagatgcaggagaagaagaagctgcaggagcagaaaatgcaggagaagaagaagctgcaggagcagaggcggcaaaagaagaagaagctacaggagcggaagaagtggcaggggcagatgctacagaaagagccagaggaggagcagcagaagcagcagctgcaagagcagccactgaagcataatgtcatcgtggggaatgagagggtgcagatatgcctgcaaaacccacgtgacgtatctgtgcccctctgcaatcaccctgttagatttttacaggcccaacccattgttcctgtccagagagcagctgaacaacagccctctggcttctatcaagatgaaaactgtgggcaacaggaagatgagagtcaaagtttttatcctgaggcgtatcaagggccccccgtgaaccagctgccattgatagatacctcaaactctgaggcaatttcttcttccagcattcctcagtttcccataacttcagactcaaccataagcaccctggagaccccacaggattacatccggctttggcaagagttgtctgattcactcggtcctgttgtccaagtgaacacttggtcttgcgatgagcagggcaccctgcacggccaacccacctaccatcaggtgcaagtttctgaggtaggagtcgagggacctcctgatccacaggctttccaaggccctgctgcataccagccagaccagatgagatctgcggagcagaccagattgatgcctgcagagcaacgtgactcaaataagccgtgctaacagtactttcatgaccagtgatgaggggaaatggggggagggggcaggccaatgaggtctgcatggccaggggaccttcaaggtgcgtaaagtcccttggggtagggtttagtgggtagagacttatttgtttcctgataggttatgtttgtaattgtttgttaagcacagcctgtttcttggaagttatgctgtagaggcagcctgtgatccgtagtatgctagggtgtgacagcagccagccacagctggatctgatgtcttgtctgccccgcccagctttgcatatccatgttctaccacaggaaggtggcctgccaagagtctgctcaaagttttcaacataaagaataaagaaaaaaaaatgccaaagtgcttttcaatctagtaaatctagagggttgttttgtcttagccacaagaattccgaggtcttgaccctgatgatcaacctgcctcccctccatagtcttgttggagaagcccagagagaatgggactccaactaagggaacctgaaatcaactcaatggaggcacttcagagctaaaataattatggcttccttgcttaataaacattttcgttcactgcaa

SEQ ID NO: 1564 - DNA, 3423 bp, Homo sapiens
aaagttcctgaggagatgttcagggaggtcaagtattacgcggtgggcgacatcgacccgcaggttattcagcttctcaaggctggaaaagcgaaggaagtttcctacaatgcactagcctcacacataatctcagaggatggggacaatccagaggtgggagaagctcgggaagtctttgacttacctgttgtaaaggtgtcatctgaagacagaagtgccctgtgggctttggttacgttctatgggggagattgccagctaaccctcaataagaaatgcacgcatttgattgttccagagccaaagggggagaaatacgaatgtgctttaaagcgagcaagtattaaaattgtgactcctgactgggttctggattgcgtatcagagaaaaccaaaaaggacgaagcattttatcatcctcgtctgattatttatgaagaggaagaagaggaagaggaagaggaggaggaagtagaaaatgaggaacaagattctcagaatgagggtagtacagatgagaagtcaagccctgccagctctcaagaagggtctccttcaggtgaccagcagttttcacctaaatccaacactgaaaaatctaaaggggaattaatgtttgatgattcttcagattcatcaccggaaaaacaggagagaaatttaaactggaccccggccgaagtcccacagttagctgcagcaaaacgcaggctgcctcagggaaaggagcctgggttgattaacttgtgtgccaatgtcccacccgtcccaggtaacattttgccccctgaggtccggggtaatttaatggctgctggacaaaacctccaaagttctgaaagatcagaaatgatagctacctggagtccagctgtacggacactgaggaatattactaataatgctgacattcagcagatgaaccggccatcaaatgtagcacatatcttacagactctttcagcacctacgaaaaatttagaacagcaggtgaatcacagccagcagggacatacaaatgccaatgcagtgctgtttagccaagtgaaagtgactccagagacacacatgctacagcagcagcagcaggcccagcagcagcagcagcagcacccggttttacaccttcagccccagcagataatgcagctccagcagcagcagcagcagcagatctctcagcaaccttacccccagcagccgccgcatccattttcacagcaacagcagcagcagcagcaagcccatccgcatcagttttcacagcaacagctacagtttccacagcaacagttgcatcctccacagcagctgcatcgccctcagcagcagctccagccctttcagcagcagcatgccctgcagcagcagttccatcagctgcagcagcaccagctccagcagcagcagcttgcccagctccagcagcagcacagcctgctccagcagcagcagcaacagcagattcagcagcagcagctccagcgcatgcaccagcagcagcagcagcagcagatgcaaagtcagacagcgccacacttgagtcagacgtcacaggcgctgcagcatcaggttccacctcagcagcccccgcagcagcagcagcaacagcagccaccaccatcgcctcagcagcatcagctttttggacatgatccagcagtggagattccagaagaaggcttcttattgggatgtgtgtttgcaattgcggattatccagagcagatgtctgataagcaactgctggccacctggaaaaggataatccaggcacatggcggcactgttgaccccaccttcacgagtcgatgcacgcaccttctctgtgagagtcaagtcagcagcgcgtatgcacaggcaataagagaaagaaagagatgtgttactgcacactggttaaacacagtcttaaagaagaagaaaatggtaccgccgcaccgagcccttcacttcccagtggccttcccaccaggaggaaagccatgttcacagcatattatttctgtgactggatttgttgatagtgacagagatgacctaaaattaatggcttatttggcaggtgccaaatatacgggttatctatgccgcagcaacacagtcctcatctgtaaagaaccaactggtttaaagtatgaaaaagccaaagagtggaggataccctgtgtcaacgcccagtggcttggcgacattcttctgggaaactttgaggcactgaggcagattcagtatagtcgctacacggcattcagtctgcaggatccatttgcccctacccagcatttagttttaaatcttttagatgcttggagagttcccttaaaagtgtctgcagagttgttgatgagtataagactacctcccaaactgaaacagaatgaagtagctaatgtccagccttcttccaaaagagccagaattgaagacgtaccacctcccactaaaaagctaactccagaattgaccccttttgtgcttttcactggattcgagcctgtccaggttcaacagtatattaagaagctctacattcttggtggagaggttgcggagtctgcacagaagtgcacacacctcattgccagcaaagtgactcgcaccgtgaagttcctgacggcgatttctgtcgtgaagcacatagtgacgccagagtggctggaagaatgcttcaggtgtcagaagttcattgatgagcagaactacattctccgagatgctgaggcagaagtacttttctctttcagcttggaagaatccttaaaacgggcacacgtttctccactctttaaggcaaaatatttttacatcacacctggaatctgcccaagtctttccactatgaaggcaatcgtagagtgtgcaggaggaaaggtgttatccaagcagccatctttccggaagctcatggagcacaagcagaactcgagtttgtcggaaataattttaatatcctgtgaaaatgaccttcatttatgccgagaatattttgccagaggcatagatgttcacaatgcagagttcgttctgactggagtgctcactcaaacgctggactatgaatcatataagtttaactgatggcgtctaggctgccgtgcatgtcgactcctgcggtgcggggctggctgtctggctggcgaggagctgctgcgcttccttcacatgctcttgttttccagctgctttcctgggggatcagactgtgaagcaggaagacagatataataaatatactgcatctttttaagatgtgcaattttattctgaggaaacataaattatgttttgtattatatgactttaagagcccacattaggttttatgattcatttgccaggtttttaaatgttttcacaaaactgttacgggacttcaactagaaataaaatggtgtaaataaagaccttgctatctct

SEQ ID NO: 1565 - DNA, 3140 bp, Homo sapiens
gtcagggtgttgatacaagctggagctctttgttggagtcttccagagctctcccagggagaggtagggaagggagcttgtccagcagaagttgggaagcacagagatcatctgccttcttctgacccggtattgatgcaggctgaggcctctgttgtaatgtgctgggtgtcatctgaagacagaagtgccctgtgggctttggttacgttctatgggggagattgccagctaaccctcaataagaaatgcacgcatttgattgttccagagccaaagggggagaaatacgaatgtgctttaaagcgagcaagtattaaaattgtgactcctgactgggttctggattgcgtatcagagaaaaccaaaaaggacgaagcattttatcatcctcgtctgattatttatgaagaggaagaagaggaagaggaagaggaggaggaagtagaaaatgaggaacaagattctcagaatgagggtagtacagatgagaagtcaagccctgccagctctcaagaagggtctccttcaggtgaccagcagttttcacctaaatccaacactgaaaaatctaaaggggaattaatgtttgatgattcttcagattcatcaccggaaaaacaggagagaaatttaaactggaccccggccgaagtcccacagttagctgcagcaaaacgcaggctgcctcagggaaaggagcctgggttgattaacttgtgtgccaatgtcccacccgtcccaggtaacattttgccccctgaggtccggggtaatttaatggctgctggacaaaacctccaaagttctgaaagatcagaaatgatagctacctggagtccagctgtacggacactgaggaatattactaataatgctgacattcagcagatgaaccggccatcaaatgtagcacatatcttacagactctttcagcacctacgaaaaatttagaacagcaggtgaatcacagccagcagggacatacaaatgccaatgcagtgctgtttagccaagtgaaagtgactccagagacacacatgctacagcagcagcagcaggcccagcagcagcagcagcagcacccggttttacaccttcagccccagcagataatgcagctccagcagcagcagcagcagcagatctctcagcaaccttacccccagcagccgccgcatccattttcacagcaacagcagcagcaacagcagccaccaccatcgcctcagcagcatcagctttttggacatgatccagcagtggagattccagaagaaggcttcttattgggatgtgtgtttgcaattgcggattatccagagcagatgtctgataagcaactgctggccacctggaaaaggataatccaggcacatggcggcactgttgaccccaccttcacgagtcgatgcacgcaccttctctgtgagagtcaagtcagcagcgcgtatgcacaggcaataagagaaagaaagagatgtgttactgcacactggttaaacacagtcttaaagaagaagaaaatggtaccgccgcaccgagcccttcacttcccagtggccttcccaccaggaggaaagccatgttcacagcatattatttctgtgactggatttgttgatagtgacagagatgacctaaaattaatggcttatttggcaggtgccaaatatacgggttatctatgccgcagcaacacagtcctcatctgtaaagaaccaactggtttaaagtatgaaaaagccaaagagtggaggataccctgtgtcaacgcccagtggcttggcgacattcttctgggaaactttgaggcactgaggcagattcagtatagtcgctacacggcattcagtctgcaggatccatttgcccctacccagcatttagttttaaatcttttagatgcttggagagttcccttaaaagtgtctgcagagttgttgatgagtataagactacctcccaaactgaaacagaatgaagtagctaatgtccagccttcttccaaaagagccagaattgaagacgtaccacctcccactaaaaagctaactccagaattgaccccttttgtgcttttcactggattcgagcctgtccaggttcaacagtatattaagaagctctacattcttggtggagaggttgcggagtctgcacagaagtgcacacacctcattgccagcaaagtgactcgcaccgtgaagttcctgacggcgatttctgtcgtgaagcacatagtgacgccagagtggctggaagaatgcttcaggtgtcagaagttcattgatgagcagaactacattctccgagatgctgaggcagaagtacttttctctttcagcttggaagaatccttaaaacgggcacacgtttctccactctttaaggcaaaatatttttacatcacacctggaatctgcccaagtctttccactatgaaggcaatcgtagagtgtgcaggaggaaaggtgttatccaagcagccatctttccggaagctcatggagcacaagcagaactcgagtttgtcggaaataattttaatatcctgtgaaaatgaccttcatttatgccgagaatattttgccagaggcatagatgttcacaatgcagagttcgttctgactggagtgctcactcaaacgctggactatgaatcatataagtttaactgatggcgtctaggctgccgtgcatgtcgactcctgcggtgcggggctggctgtctggctggcgaggagctgctgcgcttccttcacatgctcttgttttccagctgctttcctgggggatcagactgtgaagcaggaagacagatataataaatatactgcatctttttaagatgtgcaattttattctgaggaaacataaattatgttttgtattatatgactttaagagcccacattaggttttatgattcatttgccaggtttttaaatgttttcacaaaactgttacgggacttcaactagaaataaaatggtgtaaataaagaccttgctatctctaaattatggatgttaaagatttgaaatgttttgtactttgattatttttatttcttatactctgttttcttttatattgatatcttgcccacattttaaataaatgtacttttgaactt

SEQ ID NO: 1566 - DNA, 3711 bp, Homo sapiens
cggggccgggcgccgccgcggagcctcccgggccgccgcgatcatgtcggaccaggcgcccaaagttcctgaggagatgttcagggaggtcaagtattacgcggtgggcgacatcgacccgcaggttattcagcttctcaaggctggaaaagcgaaggaagtttcctacaatgcactagcctcacacataatctcagaggatggggacaatccagaggtgggagaagctcgggaagtctttgacttacctgttgtaaagccttcttgggtgattctgtccgttcagtgtggaactcttctgccagtaaatggtttttctccagaatcatgtcagattttttttggaatcactgcctgcctttctcaggtgtcatctgaagacagaagtgccctgtgggctttggttacgttctatgggggagattgccagctaaccctcaataagaaatgcacgcatttgattgttccagagccaaagggggagaaatacgaatgtgctttaaagcgagcaagtattaaaattgtgactcctgactgggttctggattgcgtatcagagaaaaccaaaaaggacgaagcattttatcatcctcgtctgattatttatgaagaggaagaagaggaagaggaagaggaggaggaagtagaaaatgaggaacaagattctcagaatgagggtagtacagatgagaagtcaagccctgccagctctcaagaagggtctccttcaggtgaccagcagttttcacctaaatccaacactgaaaaatctaaaggggaattaatgtttgatgattcttcagattcatcaccggaaaaacaggagagaaatttaaactggaccccggccgaagtcccacagttagctgcagcaaaacgcaggctgcctcagggaaaggagcctgggttgattaacttgtgtgccaatgtcccacccgtcccaggtaacattttgccccctgaggtccggggtaatttaatggctgctggacaaaacctccaaagttctgaaagatcagaaatgatagctacctggagtccagctgtacggacactgaggaatattactaataatgctgacattcagcagatgaaccggccatcaaatgtagcacatatcttacagactctttcagcacctacgaaaaatttagaacagcaggtgaatcacagccagcagggacatacaaatgccaatgcagtgctgtttagccaagtgaaagtgactccagagacacacatgctacagcagcagcagcaggcccagcagcagcagcagcagcacccggttttacaccttcagccccagcagataatgcagctccagcagcagcagcagcagcagatctctcagcaaccttacccccagcagccgccgcatccattttcacagcaacagcagcagcagcagcaagcccatccgcatcagttttcacagcaacagctacagtttccacagcaacagttgcatcctccacagcagctgcatcgccctcagcagcagctccagccctttcagcagcagcatgccctgcagcagcagttccatcagctgcagcagcaccagctccagcagcagcagcttgcccagctccagcagcagcacagcctgctccagcagcagcagcaacagcagattcagcagcagcagctccagcgcatgcaccagcagcagcagcagcagcagatgcaaagtcagacagcgccacacttgagtcagacgtcacaggcgctgcagcatcaggttccacctcagcagcccccgcagcagcagcagcaacagcagccaccaccatcgcctcagcagcatcagctttttggacatgatccagcagtggagattccagaagaaggcttcttattgggatgtgtgtttgcaattgcggattatccagagcagatgtctgataagcaactgctggccacctggaaaaggataatccaggcacatggcggcactgttgaccccaccttcacgagtcgatgcacgcaccttctctgtgagagtcaagtcagcagcgcgtatgcacaggcaataagagaaagaaagagatgtgttactgcacactggttaaacacagtcttaaagaagaagaaaatggtaccgccgcaccgagcccttcacttcccagtggccttcccaccaggaggaaagccatgttcacagcatattatttctgtgactggatttgttgatagtgacagagatgacctaaaattaatggcttatttggcaggtgccaaatatacgggttatctatgccgcagcaacacagtcctcatctgtaaagaaccaactggtttaaagtatgaaaaagccaaagagtggaggataccctgtgtcaacgcccagtggcttggcgacattcttctgggaaactttgaggcactgaggcagattcagtatagtcgctacacggcattcagtctgcaggatccatttgcccctacccagcatttagttttaaatcttttagatgcttggagagttcccttaaaagtgtctgcagagttgttgatgagtataagactacctcccaaactgaaacagaatgaagtagctaatgtccagccttcttccaaaagagccagaattgaagacgtaccacctcccactaaaaagctaactccagaattgaccccttttgtgcttttcactggattcgagcctgtccaggttcaacagtatattaagaagctctacattcttggtggagaggttgcggagtctgcacagaagtgcacacacctcattgccagcaaagtgactcgcaccgtgaagttcctgacggcgatttctgtcgtgaagcacatagtgacgccagagtggctggaagaatgcttcaggtgtcagaagttcattgatgagcagaactacattctccgagatgctgaggcagaagtacttttctctttcagcttggaagaatccttaaaacgggcacacgtttctccactctttaaggcaaaatatttttacatcacacctggaatctgcccaagtctttccactatgaaggcaatcgtagagtgtgcaggaggaaaggtgttatccaagcagccatctttccggaagctcatggagcacaagcagaactcgagtttgtcggaaataattttaatatcctgtgaaaatgaccttcatttatgccgagaatattttgccagaggcatagatgttcacaatgcagagttcgttctgactggagtgctcactcaaacgctggactatgaatcatataagtttaactgatggcgtctaggctgccgtgcatgtcgactcctgcggtgcggggctggctgtctggctggcgaggagctgctgcgcttccttcacatgctcttgttttccagctgctttcctgggggatcagactgtgaagcaggaagacagatataataaatatactgcatctttttaagatgtgcaattttattctgaggaaacataaattatgttttgtattatatgactttaagagcccacattaggttttatgattcatttgccaggtttttaaatgttttcacaaaactgttacgggacttcaactagaaataaaatggtgtaaataaagaccttgctatctctaaattatggatgttaaagatttgaaatgttttgtactttgattatttttatttcttatactctgttttcttttatattgatatcttgcccacattttaaataaatgtacttttgaactt

SEQ ID NO: 1567 - DNA, 3827 bp, Homo sapiens
ggcgggggagcggaccccgattcgcaggaccgggcccgggctgcgcgggcagggccgttggcggggcgagtgggggcgccgggcgccgcgggggccgggggcggggggtgggcggggccgggcgccgccgcggagcctcccgggccgccgcgatcatgtcggaccaggcgcccaaagttcctgaggagatgttcagggaggtcaagtattacgcggtgggcgacatcgacccgcaggttattcagcttctcaaggctggaaaagcgaaggaagtttcctacaatgcactagcctcacacataatctcagaggatggggacaatccagaggtgggagaagctcgggaagtctttgacttacctgttgtaaagccttcttgggtgattctgtccgttcagtgtggaactcttctgccagtaaatggtttttctccagaatcatgtcagattttttttggaatcactgcctgcctttctcaggtgtcatctgaagacagaagtgccctgtgggctttggttacgttctatgggggagattgccagctaaccctcaataagaaatgcacgcatttgattgttccagagccaaagggggagaaatacgaatgtgctttaaagcgagcaagtattaaaattgtgactcctgactgggttctggattgcgtatcagagaaaaccaaaaaggacgaagcattttatcatcctcgtctgattatttatgaagaggaagaagaggaagaggaagaggaggaggaagtagaaaatgaggaacaagattctcagaatgagggtagtacagatgagaagtcaagccctgccagctctcaagaagggtctccttcaggtgaccagcagttttcacctaaatccaacactgaaaaatctaaaggggaattaatgtttgatgattcttcagattcatcaccggaaaaacaggagagaaatttaaactggaccccggccgaagtcccacagttagctgcagcaaaacgcaggctgcctcagggaaaggagcctgggttgattaacttgtgtgccaatgtcccacccgtcccaggtaacattttgccccctgaggtccggggtaatttaatggctgctggacaaaacctccaaagttctgaaagatcagaaatgatagctacctggagtccagctgtacggacactgaggaatattactaataatgctgacattcagcagatgaaccggccatcaaatgtagcacatatcttacagactctttcagcacctacgaaaaatttagaacagcaggtgaatcacagccagcagggacatacaaatgccaatgcagtgctgtttagccaagtgaaagtgactccagagacacacatgctacagcagcagcagcaggcccagcagcagcagcagcagcacccggttttacaccttcagccccagcagataatgcagctccagcagcagcagcagcagcagatctctcagcaaccttacccccagcagccgccgcatccattttcacagcaacagcagcagcagcagcaagcccatccgcatcagttttcacagcaacagctacagtttccacagcaacagttgcatcctccacagcagctgcatcgccctcagcagcagctccagccctttcagcagcagcatgccctgcagcagcagttccatcagctgcagcagcaccagctccagcagcagcagcttgcccagctccagcagcagcacagcctgctccagcagcagcagcaacagcagattcagcagcagcagctccagcgcatgcaccagcagcagcagcagcagcagatgcaaagtcagacagcgccacacttgagtcagacgtcacaggcgctgcagcatcaggttccacctcagcagcccccgcagcagcagcagcaacagcagccaccaccatcgcctcagcagcatcagctttttggacatgatccagcagtggagattccagaagaaggcttcttattgggatgtgtgtttgcaattgcggattatccagagcagatgtctgataagcaactgctggccacctggaaaaggataatccaggcacatggcggcactgttgaccccaccttcacgagtcgatgcacgcaccttctctgtgagagtcaagtcagcagcgcgtatgcacaggcaataagagaaagaaagagatgtgttactgcacactggttaaacacagtcttaaagaagaagaaaatggtaccgccgcaccgagcccttcacttcccagtggccttcccaccaggaggaaagccatgttcacagcatattatttctgtgactggatttgttgatagtgacagagatgacctaaaattaatggcttatttggcaggtgccaaatatacgggttatctatgccgcagcaacacagtcctcatctgtaaagaaccaactggtttaaagtatgaaaaagccaaagagtggaggataccctgtgtcaacgcccagtggcttggcgacattcttctgggaaactttgaggcactgaggcagattcagtatagtcgctacacggcattcagtctgcaggatccatttgcccctacccagcatttagttttaaatcttttagatgcttggagagttcccttaaaagtgtctgcagagttgttgatgagtataagactacctcccaaactgaaacagaatgaagtagctaatgtccagccttcttccaaaagagccagaattgaagacgtaccacctcccactaaaaagctaactccagaattgaccccttttgtgcttttcactggattcgagcctgtccaggttcaacagtatattaagaagctctacattcttggtggagaggttgcggagtctgcacagaagtgcacacacctcattgccagcaaagtgactcgcaccgtgaagttcctgacggcgatttctgtcgtgaagcacatagtgacgccagagtggctggaagaatgcttcaggtgtcagaagttcattgatgagcagaactacattctccgagatgctgaggcagaagtacttttctctttcagcttggaagaatccttaaaacgggcacacgtttctccactctttaaggcaaaatatttttacatcacacctggaatctgcccaagtctttccactatgaaggcaatcgtagagtgtgcaggaggaaaggtgttatccaagcagccatctttccggaagctcatggagcacaagcagaactcgagtttgtcggaaataattttaatatcctgtgaaaatgaccttcatttatgccgagaatattttgccagaggcatagatgttcacaatgcagagttcgttctgactggagtgctcactcaaacgctggactatgaatcatataagtttaactgatggcgtctaggctgccgtgcatgtcgactcctgcggtgcggggctggctgtctggctggcgaggagctgctgcgcttccttcacatgctcttgttttccagctgctttcctgggggatcagactgtgaagcaggaagacagatataataaatatactgcatctttttaagatgtgcaattttattctgaggaaacataaattatgttttgtattatatgactttaagagcccacattaggttttatgattcatttgccaggtttttaaatgttttcacaaaactgttacgggacttcaactagaaataaaatggtgtaaataaagaccttgctatctctaaattatggatgttaaagatttgaaatgttttgtactttgattatttttatttcttatactctgttttcttttatattgatatcttgcccacattttaaataaatgtacttttgaacttagaa

SEQ ID NO: 1568 - DNA, 7677 bp, Homo sapiens
ggccggagaagaaggcggtgccagggcgtcctgcggaagggccgggggcggggctcgtgacgttgccgggacagccaatcacgcctggttttatcagtggccccgcccttttaccgcacatttcccctcccctagttcatttcgcacgacgcagcggttgggaacacagacattttcggagctggagccgccactgccgccgccattttgtgtctgtggagaaagaagcttctgtggcggctggaagtggacggagatcacccgcgagacggcggcgtttcatacccgaggttccccctgtgtcgtcccccatcccccctccgcggtcagcatgtggtgaagccggagccgcgagagagccggggagaggaagaggagtcggaagggaggcggggtatccagagcggcttcagcttcagctgcagcggacctcggaggggggccgcggcgcaatgtcagagcagacgccggccgaggccggtgctgcgggggcccgggaggacgcctgtcgggattatcagtcatcgctcgaagacctgaccttcaatagcaagccgcacatcaatatgctgaccattctagccgaggagaacctgcccttcgccaaggagatcgtctctctcatcgaggcccaaaccgccaaggctccttcctcagagaagcttcctgttatgtaccttatggattctattgtgaaaaacgttggaagagagtatctcactgcctttactaaaaatctagttgcaacatttatttgtgtgtttgaaaaggtggatgaaaatactaggaaaagtttatttaagttacgttctacatgggatgaaatattccctttgaagaaactttatgccctggatgtcagagtcaattcattagatcctgcttggcctattaaacctctaccccccaatgtgaatacgtctagcatccatgtgaatcctaaatttttaaataaatcgcccgaggagccttcaacacctggtacagtggtcagttcccctagcatctccactcctccaattgttcctgatatacaaaagaatcttacacaagaacaactaataaggcagcagttactggcaaagcaaaaacagttgttagaacttcagcagaaaaagctggagcttgagctagagcaagctaaggcacagttggcagtttctcttagtgttcagcaggaaacatccaatttaggtcctggatctgcaccatccaaattacatgtttcacagattccccctatggcagttaaagctcctcatcaggttcctgtgcaatctgagaaaagccgtccaggaccatccttacaaattcaggatttaaaaggaactaaccgggatcctcgtctgaacaggataagccaacattctcatggaaaagatcagagtcacaggaaagaatttctaatgaacacattaaaccagtctgatactaagacaagtaaaactataccctctgaaaaactaaattcatccaagcaagaaaaaagtaaatcaggtgaaaaaataaccaagaaagaacttgaccaattagattctaaatcgaaatcgaaatcgaaatcaccctcacctttgaaaaacaaattatctcacacaaaagacttgaaaaatcaagaatcggaaagtatgaggttgtctgatatgaacaagagagatccaagattaaaaaaacatcttcaggataagaccgatggcaaagatgatgatgtgaaagagaagagaaaaactgcagaaaaaaaggataaagatgagcacatgaagtcatccgaacacagactggctggaagtagaaataaaatcataaatggcattgtacaaaaacaggatacaataacagaagagtcagaaaaacaggggacaaaaccagggagatcgagtactagaaagcgatcaagatctcgatcacccaagtctaggtcaccaattatacattccccaaagagaagagataggcggtcacccaaacgaaggcaaagaagtatgtctccaacatcgacacctaaagctggaaagattcgccaatctggagctaagcagtcacatatggaagagtttacaccaccttctagggaagacagaaatgctaagagaagtactaaacaggatattcgggatccaaggcgaatgaaaaagactgaagaggagcgaccacaagaaactacaaatcagcattctacaaagtcaggcactgaaccaaaggagaatgtagaaaactggcaaagttccaagtctgccaaaagatggaaatctggttgggaagaaaataaaagcttacaacaggttgatgaacatagtaaacctcctcatctgaggcatagggagagctggtcaagcactaaaggaattttatcacctcgagccccaaagcagcaacagcatcgattaagtgtagatgccaatcttcagattcctaaagagttaactcttgcaagcaaaagagaattacttcaaaagacgagtgaacgtttagcatctggtgaaattacacaggatgacttccttgttgttgtgcatcaaattcgacagctatttcagtatcaagaaggtgtgcgagaagagcagagatctccattcaatgatcgttttccacttaagcgacctcgatatgaagattcagataaaccatttgtagatagtccagcatcaagattcgccggcctggatacaaatcagcgacttacagctttagctgaagacagaccgttatttgatggacctagtaggccatcagtagcaagagatggcccaacgaagatgatttttgaaggacccaataaattaagccctcgaattgatggacctcccacaccagcttctcttcggtttgatgggtcaccaggacaaatggggggaggaggccctttgagatttgaggggccacaaggtcagctaggaggtgggtgtcctttgagatttgaaggtcctccaggaccagtggggacacctctgcggtttgagggcccaattggtcaagcaggaggaggtggttttcggtttgaaggttcccctggtctgaggtttgagggatctccaggtggtttgagatttgagggaccaggaggccagcctgtgggtggtctgaggtttgagggacatcgtggtcaacctgtgggtggtctaaggtttgagggacctcatggtcagcctgtgggtggacttagatttgataatccccgaggtcagcctgtaggtggacttagatttgaggggggtcatggtccatcaggggctgcgattaggtttgatggacctcatggtcagccaggaggtggaatcagatttgagggccctttgctacagcaaggggttggaatgaggtttgagggcccccatggtcagtcagtagctggtctgagatttgagggacaacataatcaacttggtgggaaccttaggtttgagggtccacatggtcagccaggggttggtatcaggtttgaaggccctttagtccaacaaggaggtggaatgaggtttgagggtccttctgtaccaggaggtggcctgagaattgaagggcctctgggtcaaggtggtccaagatttgaaggttgtcatgctttaaggtttgatgggcagccaggtcagccgtcactcttgccaagatttgatggattacatggtcagccaggtcctagatttgaaaggactcctggtcagccaggccctcagaggtttgatggaccacctggacagcaggttcaacccagatttgacggtgtacctcaaagatttgatggtccacaacatcagcaagcatcaaggtttgatattcctcttggtcttcaaggcacaagatttgacaatcatccttcacaaaggcttgaatcagtatctttcaatcagactggtccatataatgatccacctggcaatgcttttaatgccccatcccaaggactacagttccaaagacatgaacaaatatttgattcacctcaaggaccaaattttaatggaccacatggccctggaaaccagagtttctctaatccacttaacagagcttctggacactattttgatgaaaaaaatcttcagagttctcaatttggaaactttggcaatatacctgctccaatgacagtaggaaatattcaggcatctcaacaggttctgagtggtgttgctcagccagtagcttttggtcaaggacaacagtttttaccagttcatccacaaaatcctggatttgttcagaatccttcaggagccctccctaaggcatatcctgataatcatctcagtcaggtggatgtaaatgaattgttttcaaaattgctaaaaacaggaattctcaaattgtcccaaactgattcagctacaacacaagtaagtgaagtaactgctcagcctccccctgaagaggaggaagatcaaaatgaagatcaagatgttccagatcttactaattttacagttgaagaattgaaacaacgttatgacagtgttataaatcgactgtacactggtattcagtgttactcttgtggaatgaggtttacaacatcacagacagatgtttatgcagatcatttggactggcattatcggcaaaatagaactgaaaaggatgttagccgaaaagtcactcatagacgttggtactacagtttaacagactggatagaatttgaggagatagctgatctggaagaacgggcaaagagccagttttttgaaaaggtgcatgaagaagttgtgctcaaaactcaagaggctgctaaagaaaaagagttccaaagtgtacctgctggaccagctggagcagttgagagttgtgaaatctgtcaagaacaatttgaacaatactgggatgaagaagaggaggaatggcatttgaaaaatgctattagagtagatggaaagatttatcatccatcatgttatgaagattatcaaaatacatcttcatttgattgtacaccatctcccagcaagacaccagttgaaaaccccttgaatattatgttgaacattgtcaaaaacgaattgcaggaaccctgtgacagtcccaaagttaaggaagaacgaattgatacaccaccagcttgtacagaggaaagcatagcaacaccctctgaaattaaaacagaaaatgacacagtcgagtcagtttaaataaaatgagaaaggtatgtttttcttttttaaaaaagctgctgttggatctagaaggtgaagaatttttttatgtatatatagacatatctatataaattgtctggctgaggcagggccttcagctatcatttggttaataaatacattttagtatttgcatttcctactgcctgcagagtttcaggtgcttgttgtgtgaaagttctgtagatgtgtgcaaatttaacgaaatgaaattgtatgtgtaaaaatgtacgatttttcactgtgcaactgtaaattataaataaaaaatatttttgctattcatggagtgtaatatttatgcacaccatcaaatagtttctgtactttttattgggtaaaaatggaattgaacagcaacctcaacataagattttttttctagtagcctcccactgattaaagaagcaagtttgaggtttcatccttcaaaagggggttccgagagagcaccgtagggcttttctcaaatagaaaagccagattttgaaaaaattttaaagataaaataggacatattttgcagatatatatatatatatacacaaacacatctccaggtatagagaaccatccagatgttcacttttgaaaatatctaatgatgcaaagttttattcttgaacttggacactgatgccatcaaacaattaacaaatatatttaagtactaaaggtgattttttttttaaagactttttcaaattgtcaaatgatttaatgcagatgaacatatttctattttaagtaacgggaatctgtaagaatgtttgcttgagatatggttaacttttttcttttgttggttttgacttagatggacaccatgagatgttaatattcatacatgtaataaatagaatgatgaagaaactttgtttgtacttctttatttcttgaaaagctttagaatgtgactttcttgttgtctttcatctgttttttgaaacatgaacatggtacttgctatgagccaggcactctgagacaggttagtcttttctgccatttattggagataggcatataaaacactgagttttattgagcacatagtatgtggcaggcactagcactttctacatgtattttctctggtattcacatctaataactacatggtagatggtgtccccactttacagatgaaattaagccactcactttaaaatttttataagaatttgaacgtggctttgtttcctctaattccatacaatttctgcaattttaaaagatacccccaaattgattgttaggatagaaataagcacaccaaactactggaaggtggctaaggaagattctacaaaagtggtgacatttgagtcttggaggataaccaggagtggagtccatactgatgggaagggtatctttggaaaatgaacagcaaatgtaaaggcttaaaatacttttgtgttttcaaaaattgacttcttatggttaaaactcagtagttttgaatagattatgatgagccattaatttttttagtagaaatggagtctcactacgtagtccaggctggtttcgaattcctgggctcaagtgatcctactgccttggcctcccagagtgctgggattacaggcatgagccacgtgcccagcctttatttttaagtagtgaagagccttcttggtcatgctaaggaatttttattaaactgatgaccagagcagccactagaaattttaaacagggtgacatcctatctgcatttaagcttttttatttttttaagaatcaagtgaatacaattttagagattgctaaatccagagaggtccagtgggaaaactggtagccattggatttgagttgtaaacacgtaacagctgaacttacgtatatgaacactgccataggaactgaggtctgtgaatccaaaaatgtaggcaaaacttcctgttgaacatttttctggggaaaccaccatagcttttatcaaatgcttaaaggtatggaacattctaaaaggaaggtgatattcaaacctaaaagtgtatcaacggtatccacatggagaagagggtcaaggatgggggaacaaagactggtaggtgggaaggtcaaaaagaaaatgggaaaaccagcaatgggaaaatttttttttttctttttttgagacagtcttgctatgttgctcaggctggatcagtgcagtagcacaatctcggctcagtgcagtggcacaatctcggctcactgcaacctctgcctcctgggttcaagtgattctcctgtctcagcctcccaagtagctgggattacaggtgcccgccaccacgcctggctaatttttatattttgagtagaggcggggtttcaccacgttggccaggctggtctcgaactcctgaccttaagtgatctgcccgtcttggcctcccagagtgctgggattacaggtgtgcgcaggaagaaaatttcaatggacgaggtagtcaacaaaatgaagtcaagaaaatatgtaagactcagaaatactctaactgttgacctaagaacagctgagtatgggtgc

SEQ ID NO: 1569 - DNA, 2649 bp, Homo sapiens
ggttgggaacacagacattttcggagctggagccgccactgccgccgccattttgtgtctgtggagaaagaagcttctgtggcggctggaagtggacggagatcacccgcgagacggcggcgtttcatacccgaggttccccctgtgtcgtcccccatcccccctccgcggtcagcatgtggtgaagccggagccgcgagagagccggggagaggaagaggagtcggaagggaggcggggtatccagagcggcttcagcttcagctgcagcggacctcggaggggggccgcggcgcaatgtcagagcagacgccggccgaggccggtgctgcgggggcccgggaggacgcctgtcgggattatcagtcatcgctcgaagacctgaccttcaatagcaagccgcacatcaatatgctgaccattctagccgaggagaacctgcccttcgccaaggagatcgtctctctcatcgaggcccaaaccgccaaggctccttcctcagagaagcttcctgttatgtaccttatggattctattgtgaaaaacgttggaagagagtatctcactgcctttactaaaaatctagttgcaacatttatttgtgtgtttgaaaaggtggatgaaaatactaggaaaagtttatttaagttacgttctacatgggatgaaatattccctttgaagaaactttatgccctggatgtcagagtcaattcattagatcctgcttggcctattaaacctctaccccccaatgtgaatacgtctagcatccatgtgaatcctaaatttttaaataaatcgcccgaggagccttcaacacctggtacagtggtcagttcccctagcatctccactcctccaattgttcctgatatacaaaagaatcttacacaagaacaactaataaggcagcagttactggcaaagcaaaaacagttgttagaacttcagcagaaaaagctggagcttgagctagagcaagctaaggcacagttggcagtttctcttagtgttcagcaggaaacatccaatttaggtcctggatctgcaccatccaaattacatgtttcacagattccccctatggcagttaaagctcctcatcaggttcctgtgcaatctgagaaaagccgtccaggaccatccttacaaattcaggatttaaaaggaactaaccgggatcctcgtctgaacaggataagccaacattctcatggaaaagatcagagtcacaggaaagaatttctaatgaacacattaaaccagtctgatactaagacaagtaaaactataccctctgaaaaactaaattcatccaagcaagaaaaaagtaaatcaggtgaaaaaataaccaagaaagaacttgaccaattagattctaaatcgaaatcgaaatcgaaatcaccctcacctttgaaaaacaaattatctcacacaaaagacttgaaaaatcaagaatcggaaagtatgaggttgtctgatatgaacaagagagatccaagattaaaaaaacatcttcaggataagaccgatggcaaagatgatgatgtgaaagagaagagaaaaactgcagaaaaaaaggataaagatgagcacatgaagtcatccgaacacagactggctggaagtagaaataaaatcataaatggcattgtacaaaaacaggatacaataacagaagagtcagaaaaacaggggacaaaaccagggagatcgagtactagaaagcgatcaagatctcgatcacccaagtctaggtcaccaattatacattccccaaagagaagagataggcggtcacccaaacgaaggcaaagaagtatgtctccaacatcgacacctaaagctggaaagattcgccaatctggagctaagcagtcacatatggaagagtttacaccaccttctagggaagacagaaatgctaagagaagtactaaacaggatattcgggatccaaggcgaatgaaaaagactgaagaggagcgaccacaagaaactacaaatcagcattctacaaagtcaggcactgaaccaaaggagaatgtagaaaactggcaaagttccaagtctgccaaaagatggaaatctggttgggaagaaaataaaagcttacaacaggttgatgaacatagtaaacctcctcatctgaggcatagggagagctggtcaagcactaaaggaattttatcacctcgagccccaaagcagcaacagcatcgattaagtgtagatgccaatcttcagattcctaaagagttaactcttgcaagcaaaagagaattacttcaaaagacgagtgaacgtttagcatctggtgaaattacacaggatgacttccttgttgttgtgcatcaaattcgacagctatttcagtatcaagaaggtgtgcgagaagagcagagatctccattcaatgatcgttttccacttaagcgacctcgatatgaagattcagataaaccatttgtagatagtccagcatcaagattcgccggcctggatacaaatcagcgacttacagctttagctgaagacagaccgttatttgatggacctagtaggccatcagtagcaagagatggcccaacgaagatgatttttgaaggacccaataaattaagccctcgaattgatggacctccc

SEQ ID NO: 1570 - DNA, 7497 bp, Homo sapiens
gagcagccgccgaagagcgcttggcgccattttgaagcggagaggaggaggaacggcagggctggctgcggaaggggagggggggggagaaggcgattggatgcggcggcggcggcggatcccggagagccccggagtgagcggagtagcgagtcggcaacccggaggggtagaaatatttctgtcatggctcattcaaagactaggaccaatgatggaaaaattacatatccgcctggggtcaaggaaatatcagataaaatatctaaagaggagatggtgagacgattaaagatggttgtgaaaacttttatggatatggaccaggactctgaagaagaaaaggagctttatttaaacctagctttacatcttgcttcagatttttttctcaagcatcctgataaagatgttcgcttactggtagcctgctgccttgctgatattttcaggatttatgctcctgaagctccttacacatcccctgataaactaaaggatatatttatgtttataacaagacagttgaaggggctagaggatacaaagagcccacaattcaataggtatttttatttacttgagaacattgcttgggtcaagtcatataacatatgctttgagttagaagatagcaatgaaattttcacccagctatacagaaccttattttcagttataaacaatggccacaatcagaaagtccatatgcacatggtagaccttatgagctctattatttgtgaaggtgatacagtgtctcaggagcttttggatacggttttagtaaatctggtacctgctcataagaatttaaacaagcaagcatatgatttggcaaaggctttactgaagaggacagctcaagctattgagccatatattaccaatttttttaatcaggttctgatgcttgggaaaacatctatcagcgatttgtcagagcatgtctttgacttaattttggagctctacaatattgatagtcatttgctgctctctgttttaccccagcttgaatttaaattaaagagcaatgataatgaggagcgcctacaagttgttaaactactggcaaaaatgtttggggcaaaggattcagaattggcttctcaaaacaagccactttggcagtgctacttgggcaggtttaatgatatccatgtaccaatccgcctggaatgtgtgaaatttgctagccattgtctcatgaaccatcctgatttagcaaaagacttaacagagtatcttaaagtgaggtcacatgaccctgaggaagctattagacatgatgttattgtgtcaatagttacagctgctaaaaaggatattcttctggtcaatgatcacttacttaattttgtgagagagagaacattagacaaacgatggagagtacgcaaagaagccatgatgggacttgcccaaatttataagaaatatgctttacagtcagcagctggaaaagatgctgcaaaacagatagcatggatcaaagacaaattgctacatatatattatcaaaatagtattgatgatcgactacttgttgaacggatctttgctcaatacatggttcctcacaatttagaaactacagaacggatgaaatgcttatattacttgtatgccacactggatttaaatgctgtgaaagcattgaatgaaatgtggaaatgtcaaaatctgctccgacatcaagtaaaggatttgcttgacttgattaagcaacccaaaacagatgccagtgtcaaggccatattttcaaaagtgatggttattacaagaaatttacctgatcctggtaaggctcaggatttcatgaagaaattcacacaggtgttagaagatgatgagaaaataagaaagcagttagaagtacttgttagtccaacatgctcctgcaagcaggctgaaggttgtgtgcgtgaaataactaagaagttgggcaaccccaaacagcctacaaatcctttcctggaaatgatcaagtttctcttggagaggatagcacctgtgcacatagataccgaatctatcagtgctcttattaaacaagtgaacaaatcaatagatggaacagcagatgatgaagatgagggtgttccaactgatcaagccatcagagcaggtcttgaactgcttaaggtactctcatttacacatcccatctcatttcattctgctgaaacatttgaatcattactggcttgtctgaaaatggatgatgaaaaagtagcagaagctgcactacaaattttcaaaaacacaggaagcaaaattgaagaggattttccacacatcagatcagccttgcttcctgttttacatcacaaatctaaaaaaggacccccccgtcaagccaaatatgccattcattgtatccatgcgatattttctagtaaagagacccagtttgcacagatatttgagcctctgcataagagcctagatccaagcaacctggaacatctcataacaccattggttactattggtcatattgctctccttgcacctgatcaatttgctgctcctttgaaatctttggtagctactttcattgtgaaagatcttctcatgaatgatcggcttccagggaaaaagacaactaaactttgggttccagatgaagaagtatctcctgagacaatggtcaaaattcaggctattaaaatgatggttcgatggctacttggaatgaaaaataatcacagtaaatcaggaacttctaccttaagattgctaacaacaatattgcatagtgatggagacttgacagaacaggggaaaattagtaaaccagatatgtcacgtctgagacttgctgctgggagtgctattgtgaagctggcacaagaaccctgttaccatgaaatcatcacattagaacaatatcagctatgtgcattagctatcaacgatgaatgctatcaagtaagacaagtgtttgcccagaaacttcacaaaggcctttcccgtttacggcttccacttgagtatatggcaatctgtgccctttgtgcaaaagatcctgtaaaggagagaagagctcatgctaggcaatgtttggtgaaaaatataaatgtaaggcgggagtatctgaagcagcatgcagctgttagtgaaaaattattgtctcttctaccagagtatgttgttccatatacaattcaccttttggcacatgacccagattatgtcaaagtacaggatattgaacaacttaaagatgttaaagaatgtctttggtttgttctggaaatattaatggctaaaaatgaaaataacagtcacgcttttatcagaaagatggtagaaaatattaaacaaacaaaagatgcccaaggaccagatgatgcaaaaatgaatgaaaaactgtacactgtgtgtgatgttgccatgaatatcatcatgtcaaagagtactacatacagtttggaatctcctaaagacccggtactaccagctcgtttcttcactcaacctgacaagaatttcagtaacaccaaaaattatctgcctcctgaaatgaaatcatttttcactcctggaaaacctaaaacaaccaatgttctaggagctgttaacaagccactttcatcagcaggcaagcaatctcagaccaaatcatcacgaatggaaactgtaagcaatgcaagcagcagctcaaatccaagctctcctggaagaataaaggggaggcttgatagttctgaaatggatcacagtgaaaatgaagattacacaatgtcttcacctttgccggggaaaaaaagtgacaagagagacgactctgatcttgtaaggtctgaattggagaagcctagaggcaggaaaaaaacgcccgtcacagaacaggaggagaaattaggtatggatgacttgactaagttggtacaggaacagaaacctaaaggcagtcagcgaagtcggaaaagaggccatacggcttcagaatctgatgaacagcagtggcctgaggaaaagaggctcaaagaagatatattagaaaatgaagatgaacagaatagtccgccaaaaaagggtaaaagaggccgaccaccaaaacctcttggtggaggtacaccaaaagaagagccaacaatgaaaacttctaaaaaaggaagcaaaaaaaaatctggacctccagcaccagaggaggaggaagaagaagaaagacaaagtggaaatacggaacagaagtccaaaagcaaacagcaccgagtgtcaaggagagcacagcagagagcagaatctcctgaatctagtgcaattgaatccacacagtccacaccacagaaaggacgaggaagaccatcaaaaacgccatcaccatcacaaccaaaaaaaaatgtccgtgtaggacgctccaaacaagcagctactaaggaaaatgattcaagtgaagaagtagatgtgtttcagggtagctctcctgtcgatgatattccacaggaagaaacagaggaggaggaagtttctacagtaaatgtacggcggcgaagtgctaaaagggaacggcgatgaacaaatgtaattaataactttctctgtgaaagctttggaaaaatctttttttttttttttggtcaagcttgaggctgaataaagcctttgatgcacaaaatgggactgctgaagagtggacagttggaccttactttggtgaccccatacatttgtggtcacatgctttagccatacacatggtaacattgactatggagtcttgtgaaagtgtaatgtgcgatggctatgtagacataaagaagaaacttgtaaatatcttttttcttttttttaatgtttctgatttctgaagtgcttgtatagcttttatctgcggctttaaactgacagtacccgactgtttattggatctattgatttgaaaagaatttgttaggatagatcttaagcagtaatctgtcagtgtttgtatttgtattctctgcaattttactgtgaaaaaaaatttgttttcaacaattggtgtcattttcttgatgtcactatttgttggagagttaaatggtctcttccctttgtgtatcttacctagtgtttactcctgggcacccttaatcttcagaggtgctaaattgtctgccattacaccagaaggatgcctctgataggaggacaaccatgcaaattgtgaaatagtcctgaagttcttggattactttacacctcagtattgatttgtcccagaattttctggcctttcatggcaatgaaaattttaagaagaaagatttaaagtattttaattttaaagagtgtgttataaaataatgtactgaattctttatcccattttatcatcctttcagtttttattaatctactgtatcaataaaattctgtaatttgaatgagtttttaatagtctagaatgttattgtgtatagatatttcctcttgaacgttatgttcagaaaatgcaaattacactataatataaaacctgatatatacacattagaaatattccagttctccgtaacagtgtaaagttaatcagaaagaaaaaattttattgatgcagtgtgtctttataaagctgttcttgaaagccaagtgttttgtattttatagtgagttgcatgtttttgaaaaaaagtgctgaaaatgggatgtgctgttttctgtaaattcatatttagccatagtatatgatagattgccccataacatagtttttcatcaagagtttattattgtactttattttggagccaaaaaattgattctggggggtgggggcagcgtagaagtggtatatccaagtatatcagctactgtagttgtcacagtcttgtgaactttgaatgaaattccactttgtccagattgggagaagtggaaatttatttggatttagagcaggtctttttttttcttcattgtaatctgcaaaatgtagaaataaattacttaaggcagtatcctttatacagttgtataaactgtattttgaaccaaaacatataggttactacttaatgcttacctaatttcattttagtattttaggtgctgttatgttttttcatggttaacaccagaggggaaaaaatcatattctaacttattaaatttatcacattgaatagtggaacattttcatatgatacaccattatgtttaagatatatttccaagattggttataatagatggggcatataataaagaagctactattttggaaaatgacattttactatttgccaatgtatattgcaattgatgtgattatttttcttttaaagatttgtttgtgtttatgaaacagccatttattttttaaaaagtgttttgaattgtgtcttaatctctccatattcaactattcttcatttacaacaatagtgacaccagtaattatgagaggctgtcatatatcaaagcagctcaggtgggatcaacatacattggttttgaaatgtttccttagctcggttctcccaaacacataatttctgtttcagcagtacaaaggcatgttttaaaatctataacataaagaataaggaatagctttgtatttttgtcattgattaaattgcaccagaaatgtttatggaaatattaagaacattttataaaacatacgaaaaagtgattgtgaaggatttttatttgcatgattatagttaagcaaatttcatttcacatttttgtaatgctgtacagcagttcacaaaaaaatgttcattgtagattttgttatgttcaatgccaatgagtctgtaattttacgacctgtctgttctttttttgggtggattacgatgtaaatttttcttttctttctttctttttttttttttttgtgtagaaaaataggtgcaataatgatcaaagttttgatgtcttgagtctccatcttaggggattatcttacgtttaagcttaacatttcatgtagtaagatttggagagccacatactttacagtaaaattaagtgtgtataaaacattaattgctaacaattgttagcaaactatttcagtgataatgttcattttgaaaatatgtactgtataacattaagaaaatatttaactccctgtaacaagttccattatgaaaatcttattcctcagtgaggttatcttgctgcactctgtagcaaatttgtttaatctacattataataaaatttcttgctgcagtgcaacaggaggctttttcagtgatcttcactgtatatgtaaattacaaatgtggctgtaaaacttattccaggtattaaaggttaaattgctttctatatcttcttataacttgtaagtctgatttttaagatttccttttgtccacttgtaagaatgtcaggaatttaagaatttgtttaaattaggcatatctctgccatcacatagtattatgtcaccataatgaacaattgctatttaaatagataaccaattttcagacacatttttggatttctgtgaagttgaataaacataaaagctaa

SEQ ID NO: 1571 - DNA, 4067 bp, Homo sapiens
attttgaagcggagaggaggaggaacggcagggctggctgcggaaggggagggggggggagaaggcgattggatgcggcggcggcggcggatcccggagagccccggagtgagcggagtagcgagtcggcaacccggaggggtagaaatatttctgtcatggctcattcaaagactaggaccaatgatggaaaaattacatatccgcctggggtcaaggaaatatcagataaaatatctaaagaggagatggtgagacgattaaagatggttgtgaaaacttttatggatatggaccaggactctgaagaagaaaaggagctttatttaaacctagctttacatcttgcttcagatttttttctcaagcatcctgataaagatgttcgcttactggtagcctgctgccttgctgatattttcaggatttatgctcctgaagctccttacacatcccctgataaactaaaggatatatttatgtttataacaagacagttgaaggggctagaggatacaaagagcccacaattcaataggtatttttatttacttgagaacattgcttgggtcaagtcatataacatatgctttgagttagaagatagcaatgaaattttcacccagctatacagaaccttattttcagttataaacaatggccacaatcagaaagtccatatgcacatggtagaccttatgagctctattatttgtgaaggtgatacagtgtctcaggagcttttggatacggttttagtaaatctggtacctgctcataagaatttaaacaagcaagcatatgatttggcaaaggctttactgaagaggacagctcaagctattgagccatatattaccaatttttttaatcaggttctgatgcttgggaaaacatctatcagcgatttgtcagagcatgtctttgacttaattttggagctctacaatattgatagtcatttgctgctctctgttttaccccagcttgaatttaaattaaagagcaatgataatgaggagcgcctacaagttgttaaactactggcaaaaatgtttggggcaaaggattcagaattggcttctcaaaacaagccactttggcagtgctacttgggcaggtttaatgatatccatgtaccaatccgcctggaatgtgtgaaatttgctagccattgtctcatgaaccatcctgatttagcaaaagacttaacagagtatcttaaagtgaggtcacatgaccctgaggaagctattagacatgatgttattgtgtcaatagttacagctgctaaaaaggatattcttctggtcaatgatcacttacttaattttgtgagagagagaacattagacaaacgatggagagtacgcaaagaagccatgatgggacttgcccaaatttataagaaatatgctttacagtcagcagctggaaaagatgctgcaaaacagatagcatggatcaaagacaaattgctacatatatattatcaaaatagtattgatgatcgactacttgttgaacggatctttgctcaatacatggttcctcacaatttagaaactacagaacggatgaaatgcttatattacttgtatgccacactggatttaaatgctgtgaaagcattgaatgaaatgtggaaatgtcaaaatctgctccgacatcaagtaaaggatttgcttgacttgattaagcaacccaaaacagatgccagtgtcaaggccatattttcaaaagtgatggttattacaagaaatttacctgatcctggtaaggctcaggatttcatgaagaaattcacacaggtgttagaagatgatgagaaaataagaaagcagttagaagtacttgttagtccaacatgctcctgcaagcaggctgaaggttgtgtgcgtgaaataactaagaagttgggcaaccccaaacagcctacaaatcctttcctggaaatgatcaagtttctcttggagaggatagcacctgtgcacatagataccgaatctatcagtgctcttattaaacaagtgaacaaatcaatagatggaacagcagatgatgaagatgagggtgttccaactgatcaagccatcagagcaggtcttgaactgcttaaggtactctcatttacacatcccatctcatttcattctgctgaaacatttgaatcattactggcttgtctgaaaatggatgatgaaaaagtagcagaagctgcactacaaattttcaaaaacacaggaagcaaaattgaagaggattttccacacatcagatcagccttgcttcctgttttacatcacaaatctaaaaaaggacccccccgtcaagccaaatatgccattcattgtatccatgcgatattttctagtaaagagacccagtttgcacagatatttgagcctctgcataagagcctagatccaagcaacctggaacatctcataacaccattggttactattggtcatattgctctccttgcacctgatcaatttgctgctcctttgaaatctttggtagctactttcattgtgaaagatcttctcatgaatgatcggcttccagggaaaaagacaactaaactttgggttccagatgaagaagtatctcctgagacaatggtcaaaattcaggctattaaaatgatggttcgatggctacttggaatgaaaaataatcacagtaaatcaggaacttctaccttaagattgctaacaacaatattgcatagtgatggagacttgacagaacaggggaaaattagtaaaccagatatgtcacgtctgagacttgctgctgggagtgctattgtgaagctggcacaagaaccctgttaccatgaaatcatcacattagaacaatatcagctatgtgcattagctatcaacgatgaatgctatcaagtaagacaagtgtttgcccagaaacttcacaaaggcctttcccgtttacggcttccacttgagtatatggcaatctgtgccctttgtgcaaaagatcctgtaaaggagagaagagctcatgctaggcaatgtttggtgaaaaatataaatgtaaggcgggagtatctgaagcagcatgcagctgttagtgaaaaattattgtctcttctaccagagtatgttgttccatatacaattcaccttttggcacatgacccagattatgtcaaagtacaggatattgaacaacttaaagatgttaaagaatgtctttggtttgttctggaaatattaatggctaaaaatgaaaataacagtcacgcttttatcagaaagatggtagaaaatattaaacaaacaaaagatgcccaaggaccagatgatgcaaaaatgaatgaaaaactgtacactgtgtgtgatgttgccatgaatatcatcatgtcaaagagtactacatacagtttggaatctcctaaagacccggtactaccagctcgtttcttcactcaacctgacaagaatttcagtaacaccaaaaattatctgcctcctgaaatgaaatcatttttcactcctggaaaacctaaaacaaccaatgttctaggagctgttaacaagccactttcatcagcaggcaagcaatctcagaccaaatcatcacgaatggaaactgtaagcaatgcaagcagcagctcaaatccaagctctcctggaagaataaaggggaggcttgatagttctgaaatggatcacagtgaaaatgaagattacacaatgtcttcacctttgccggggaaaaaaagtgacaagagagacgactctgatcttgtaaggtctgaattggagaagcctagaggcaggaaaaaaacgcccgtcacagaacaggaggagaaattaggtatggatgacttgactaagttggtacaggaacagaaacctaaaggcagtcagcgaagtcggaaaagaggccatacggcttcagaatctgatgaacagcagtggcctgaggaaaagaggctcaaagaagatatattagaaaatgaagatgaacagaatagtctgccattacaccagaaggatgcctctgataggaggacaaccatgcaaattgtgaaatag

SEQ ID NO: 1572 - DNA, 2747 bp, Homo sapiens
atggcggcgcggccgcggcgaggtccctcagaggcggtaccagcgcatgcgcagcgcggagtcccggcccgggacacaagatggcggcagcggcgctggggagggcgaggcggaggcggcaaaacgggcggtcgagcagaacgtgtagccgcgtcccctccagtccgctccgggcagctgctgatgcaaggaatcccctgggctcccgtccactccactgctgaccagcccattcgcctgtgctgagtcttcctgcaggcctttccttgcctctgtgggaccctgtgggggtccatccggctggagaagaaaagcctctcatgctaacgttgcagaccccagagggtcctgtgtgggtgtggagatggccaatgagaatcacggcagcccccgggaggaagcgtccctgctgagtcactccccaggtacctccaatcagagccagccctgttctccaaagccaatccgcctggttcaggacctcccagaggagctggtgcatgcaggctgggagaagtgctggagccggagggagaatcgtccctactacttcaaccgattcaccaaccagtccctgtgggagatgcccgtgctggggcagcacgatgtgatttcggaccctttggggctgaatgcgaccccactgccccaagactcaagcttggtggaaactcccccggctgagaacaagcccagaaagcggcagctctcggaagagcagccaagcggcaatggtgtgaagaagcccaagattgaaatcccagtgacacccacaggccagtcggtgcccagctcccccagtatcccaggaaccccaacgctgaagatgtggggtacgtcccctgaagataaacagcaggcagctctcctacgacccactgaggtctactgggacctggacatccagaccaatgctgtcatcaagcaccgggggccttcagaggtgctgcccccgcatcccgaagtggaactgctccgctctcagctcatcctgaagcttcggcagcactatcgggagctgtgccagcagcgagagggcattgagcctccacgggagtctttcaaccgctggatgctggagcgcaaggtggtagacaaaggatctgaccccctgttgcccagcaactgtgaaccagtcgtgtcaccttccatgtttcgtgaaatcatgaacgacattcctatcaggttatcccgaatcaagttccgggaggaagccaagcgcctgctctttaaatatgcggaggccgccaggcggctcatcgagtccaggagtgcatcccctgacagtaggaaggtggtcaaatggaatgtggaagacacctttagctggcttcggaaggaccactcagcctccaaggaggactacatggatcgcctggagcatctgcggaggcagtgtggcccccacgtctcggccgcagccaaggactccgtggaaggcatctgcagtaagatctaccacatctccctggagtacgtcaaacggatccgagagaagcaccttgccatcctcaaggaaaacaacatctcagaggaggtggaggcccctgaggtggagccccgcctagtgtactgctacccagtccggctggctgtgtctgcaccgcccatgcccagcgtggagatgcacatggagaacaacgtggtctgcatccggtataagggagagatggtcaaggtcagccgcaactacttcagcaagctgtggctcctttaccgctacagctgcattgatgactctgcctttgagaggttcctgccccgggtctggtgtcttctccgacggtaccagatgatgttcggcgtgggcctctacgaggggactggcctgcagggatcgctgcctgtgcatgtctttgaggccctccaccgactctttggcgtcagcttcgagtgcttcgcctcacccctcaactgctacttccgccagtactgttctgccttccccgacacagacggctactttggctcccgcgggccctgcctagactttgctccactgagtggttcatttgaggccaaccctcccttctgcgaggagctcatggatgccatggtctctcactttgagagactgcttgagagctcaccggagcccctgtccttcatcgtgttcatccctgagtggcgggaacccccaacaccagcgctcacccgcatggagcagagccgcttcaaacgccaccagttgatcctgcctgcctttgagcatgagtaccgcagtggctcccagcacatctgcaagaaggaggaaatgcactacaaggccgtccacaacacggctgtgctcttcctacagaacgaccctggctttgccaagtgggcgccgacgcctgaacggctgcaggagctgagtgctgcctaccggcagtcaggccgcagccacagctctggttcttcctcatcgtcctcctcggaggccaaggaccgggactcgggccgtgagcagggtcctagccgcgagcctcaccccacttaacatatcctgcggggaggaggagccccaggggtgctagtctggactgctgggactcgggcccctggggcctcagagggaccccggctgccactgacatatgaagattatggttctgccagggctcccctccctgcctgtccccaagtcctcacctcaaactccctccaagtcccatgtatataggtcctgatgccttcccaaccccgcccctcaccctgttgccaccttgtttcatttgtaaaaggaaatacagaaacccccccaagaa

SEQ ID NO: 1573 - DNA, 2454 bp, Homo sapiens
ggcccgggacacaagatggcggcagcggcgctggggagggcgaggcggaggcggcaaaacgggcggtcgagcagaacgtgtagccgcgtcccctccagtccgctccgggcagctgctgatgcaaggaatcccctgggctcccgtccactccactgctgaccagcccattcgcctgtgctgagtcttcctgcaggcctttccttgcctctgtgggaccctgtgggggtccatccggctggagaagaaaagcctctcatgctaacgttgcagaccccagagggtcctgtgtgggtgtggagatggccaatgagaatcacggcagcccccgggaggaagcgtccctgctgagtcactccccaggtacctccaatcagagccagccctgttctccaaagccaatccgcctggttcaggacctcccagaggagctggtgcatgcaggctgggagaagtgctggagccggagggagaatcgtccctactacttcaaccgattcaccaaccagtccctgtgggagatgcccgtgctggggcagcacgatgtgatttcggaccctttggggctgaatgcgaccccactgccccaagactcaagcttggtggaaactcccccggctgagaacaagcccagaaagcggcagctctcggaagagcagccaagcggcaatggtgtgaagaagcccaagattgaaatcccagtgacacccacaggccagtcggtgcccagctcccccagtatcccaggaaccccaacgctgaagatgtggggtacgtcccctgaagataaacagcaggcagctctcctacgacccactgaggtctactgggacctggacatccagaccaatgctgtcatcaagcaccgggggccttcagaggtgctgcccccgcatcccgaagtggaactgctccgctctcagctcatcctgaagcttcggcagcactatcgggagctgtgccagcagcgagagggcattgagcctccacgggagtctttcaaccgctggatgctggagcgcaaggtggtagacaaaggatctgaccccctgttgcccagcaactgtgaaccagtcgtgtcaccttccatgtttcgtgaaatcatgaacgacattcctatcaggttatcccgaatcaagttccgggaggaagccaagcgcctgctctttaaatatgcggaggccgccaggcggctcatcgagtccaggagtgcatcccctgacagtaggaaggtggtcaaatggaatgtggaagacacctttagctggcttcggaaggaccactcagcctccaaggaggactacatggatcgcctggagcatctgcggaggcagtgtggcccccacgtctcggccgcagccaaggactccgtggaaggcatctgcagtaagatctaccacatctccctggagtacgtcaaacggatccgagagaagcaccttgccatcctcaaggaaaacaacatctcagaggaggtggaggcccctgaggtggagccccgcctagtgtactgctacccagtccggctggctgtgtctgcaccgcccatgcccagcgtggagatgcacatggagaacaacgtggtctgcatccggtataagggagagatggtcaaggtcagccgcaactacttcagcaagctgtggctcctttaccgctacagctgcattgatgactctgcctttgagaggttcctgccccgggtctggtgtcttctccgacggtaccagatgatgttcggcgtgggcctctacgaggggactggcctgcagggatcgctgcctgtgcatgtctttgaggccctccaccgactctttggcgtcagcttcgagtgcttcgcctcacccctcaactgctacttccgccagtactgttctgccttccccgacacagacggctactttggctcccgcgggccctgcctagactttgctccactgagtggttcatttgaggccaaccctcccttctgcgaggagctcatggatgccatggtctctcactttgagagactgcttgagagctcaccggagcccctgtccttcatcgtgttcatccctgagtggcgggaacccccaacaccagcgctcacccgcatggagcagagccgcttcaaacgccaccagttgatcctgcctgcctttgagcatgagtaccgcagtggctcccagcacatctgcaagaaggaggaaatgcactacaaggccgtccacaacacggctgtgctcttcctacagaacgaccctggctttgccaagtgggcgccgacgcctgaacggctgcaggagctgagtgctgcctaccggcagtcaggccgcagccacagctctggttcttcctcatcgtcctcctcggaggccaaggaccgggactcgggccgtgagcagggtcctagccgcgagcctcaccctgttgccaccttgtttcatttgtaaaaggaaatacagaaaccccccc

SEQ ID NO: 1574 - DNA, 1370 bp, Homo sapiens
gtaaagcattgcttgaggttgcccaggtagtttcgccttacacttcttgtcccagtgcaattattagtagagctccctttcactgtcaaatttccggttggggataaattgcattgtcgttttggtttgagataggaagatgaggggaggaaggaggtgaggcggtaaggggcgttctctctcttgggtcccgcgcccaacttccgctggcccaaagaaactataattttgaaccaacagacctctgctggcatctgcgattgcatttttcctgttttaacaacggctgtgctagacgaagtggtgaagcccaaagacttatttttgagctcgctgtaagactgagaaatcacgtagtccttcctgaaaccactaagaggaaaaatgtctgtgacactgcatacagatgtaggtgatattaaaattgaagtcttctgtgagaggacacccaaaacatgtgagatggagtctcgctgtgtcccccaggctggagtacaatggcgcgatctcggctcactgcaacctccgcctcctgggttcaagcaagtcttctgcctcagcctcccgagaactggaagaggaggcaacagtatttggggcaagaagtttgaggatgaatacagtgaatatcttaagcacaatgttagaggtgttgtatctatggctaataatggcccgaacaccaatggatctcagttcttcatcacctatggcaaacagccacatttggacatgaaatacaccgtatttggaaaggtaatagatggtctggaaactctagatgagttggagaagttgccagtaaatgagaagacataccgacctcttaatgatgtacacattaaggacataactattcatgccaacccatttgctcagtagctatgatagacctggacaaataacttgacaaattgctggaacacacttattgtggtttacccggttttaattatgtcagagattgcatcatccttctgcttgtttacaactatgatcttctatgaaatggtggtaccaaggggcgcccaacagcttttatccccattcttagagcatattctttattataatgattatccaacatatttctttaattttaatacaaaaaatacatcatttaatttttgttacatatgaacattcatttttaaatgctcagcctcaagtgcaggcatttttgagtggcctgattacatattcctcccacagcaagtccgtatcctggaagtgttattttataataaaatttaaaaagttttaaagaattaaatcgtaggacaaattaattaaaatattgtgtaaaattaccttcaggctatgtgtataaggtatatatgaaacgtaaatgaacttcatgtttaaatttg

SEQ ID NO: 1575 - DNA, 1194 bp, Homo sapiens
gtcgttttggtttgagataggaagatgaggggaggaaggaggtgaggcggtaaggggcgttctctctcttgggtcccgcgcccaacttccgctggcccaaagaaactataattttgaaccaacagacctctgctggcatctgcgattgcatttttcctgttttaacaacggctgtgctagacgaagtggtgaagcccaaagacttatttttgagctcgctgtaagactgagaaatcacgtagtccttcctgaaaccactaagaggaaaaatgtctgtgacactgcatacagatgtaggtgatattaaaattgaagtcttctgtgagaggacacccaaaacatgtgagaatttcttggctctttgtgccagtaattactacaatggctgtatatttcataggaatatcaagggtttcatggttcaaacaggagatccaacaggaactggaagaggaggcaacagtatttggggcaagaagtttgaggatgaatacagtgaatatcttaagcacaatgttagaggtgttgtatctatggctaataatggcccgaacaccaatggatctcagttcttcatcacctatggcaaacagccacatttggacatgaaatacaccgtatttggaaaggtaatagatggtctggaaactctagatgagttggagaagttgccagtaaatgagaagacataccgacctcttaatgatgtacacattaaggacataactattcatgccaacccatttgctcagtagctatgatagacctggacaaataacttgacaaattgctggaacacacttattgtggtttacccggttttaattatgtcagagattgcatcatccttctgcttgtttacaactatgatcttctatgaaatggtggtaccaaggggcgcccaacagcttttatccccattcttagagcatattctttattataatgattatccaacatatttctttaattttaatacaaaaaatacatcatttaatttttgttacatatgaacattcatttttaaatgctcagcctcaagtgcaggcatttttgagtggcctgattacatattcctcccacagcaagtccgtatcctggaagtgttattttataataaaatttaaaaagttttaaagaattaaatcgtaggacaaattaattaaaatattgtgtaaaattaccttcaggcta

SEQ ID NO: 1576 - DNA, 756 bp, Homo sapiens
ggcggaagtggtcctttccgtttggcagccgagtgtaaagcattgcttgaggttgcccagagacttatttttgagctcgctgtaagactgagaaatcacgtagtccttcctgaaaccactaagaggaaaaatgtctgtgacactgcatacagatgtaggtgatattaaaattgaagtcttctgtgagaggacacccaaaacatgtgagatggagtctcgctgtgtcccccaggctggagtacaatggcgcgatctcggctcactgcaacctccgcctcctgggttcaagcaagtcttctgcctcagcctcccgagaactggaagaggaggcaacagtatttggggcaagaagtttgaggatgaatacagtgaatatcttaagcacaatgttagaggtgttgtatctatggctaataatggcccgaacaccaatggatctcagttcttcatcacctatggcaaacagccacatttggacatgaaatacaccgtatttggaaaggtaatagatggtctggaaactctagatgagttggagaagttgccagtaaatgagaagacataccgacctcttaatgatgtacacattaaggacataactattcatgccaacccatttgctcagtagctatgatagacctggacaaataacttgacaaattgctggaacacacttattgtggtttacccggttttaattatgtcagagattgcatcatccttctgcttgtttacaactatgatcttctatgaaat

SEQ ID NO: 1577 - DNA, 596 bp, Homo sapiens
ccgcactgcactccagcctggcgacatagcgagactccgtctcaaaatgaaaaaaaaagagaagttcatagtatattagtgataagtgctgtggtggaaaaaaaaaagttcatagtatattagtataagtgctgtggtgaaaaaaaaaaaaagcgaatttcatagtatattagtgataagtgctgtgggagaaggaaataggaatgtcctagggctgaagggctaaagcagttctgtgtaggattgtcaggtcagttaaacttgacatttaagcagaaatttggagagacttatttttgagctcgctgtaagactgagaaatcacgtagtccttcctgaaaccactaagaggaaaaatgtctgtgacactgcatacagatgtaggtgatattaaaattgaagtcttctgtgagaggacacccaaaacatgtgagaatttcttggctctttgtgccagtaattactacaatggctgtatatttcataggaatatcaagggtttcatggttcaaacaggagatccaacaggaactggaagaggaggcaacagtatttggggcaagaagtttgaggatgaatacagtgaatatcttaag

SEQ ID NO: 1578 - DNA, 2166 bp, Homo sapiens
agaagactgcgccgctgctttgggattggtagctgagttttgtgtcgcgccttttctgacgatgcgaacaacatggcggcggaaagtggtagcgattttcagcagagacgtagaaggcgccgggacccggaggaaccggaaaaaacagaactcagcgaaagagagctggcagtagcagtggcggtgtcccaggagaacgatgaggagaacgaagagcgctgggttggacctttacctgtggaggcaacactggccaagaagaggaaagtcttagagtttgaaagagtctatcttgataatctccccagtgcatccatgtatgagcgcagttacatgcatagagatgttatcacccatgtggtatgcaccaaaacagattttattattactgccagtcatgatggacatgtcaagttctggaaaaaaatagaagagggaattgaatttgttaaacattttcgtagtcacctgggagttattgagagtattgcagttagctctgagggagcattgttctgttctgtgggtgatgataaagcaatgaaggtgtttgatgtagtgaactttgacatgatcaacatgctgaaacttggctattttcctggacagtgtgagtggatctattgcccaggggatgcaatttcttcagttgctgcttccgaaaagagtacaggaaaaattttcatttatgatggccgaggagataaccagccacttcatatttttgacaaactccatacatcacctcttactcagatacggctaaacccagtttacaaagcagtagtgtcttctgacaaatctgggatgattgaatactggactgggcctcctcatgaatataaattccccaaaaatgtgaactgggaatataaaactgacactgatttatatgaatttgccaagtgtaaggcttatccaaccagcgtatgtttttcaccagatgggaagaaaatagctactattggttctgatagaaaagttagaattttcagatttgtaactggaaaactcatgagagtctttgatgaatcactaagcatgtttactgaactgcaacagatgaggcaacagttaccagacatggaatttggccgacgaatggctgtagaacgtgagttggagaaggttgatgctgtaagattaattaatatagtttttgatgaaactggacacttcgtgctgtatggaacaatgctgggcattaaagttataaatgtagagacaaaccggtgtgtgcggattttaggcaaacaagaaaatattagagtgatgcaattggctttgttccaggggatagccaaaaagcatcgtgctgcaactactatagaaatgaaagcttctgaaaatcctgttcttcagaatattcaagctgacccaacaatagtctgtacatcattcaaaaagaatagattttatatgtttaccaaacgagaaccagaagatacgaaaagtgcagattctgatcgagatgtttttaatgagaaaccttctaaagaagaagtcatggcagctactcaagctgaaggacctaaacgagtttcggacagtgccattatccacaccagcatgggagacattcacaccaaactttttcctgttgagtgccctaagacagtggaaaacttctgtgttcacagcagaaatggttattataatgggcatacatttcaccgtataattaagggctttatgattcagactggagatccaacaggtactggtatgggaggagaaagcatatggggaggagaatttgaagatgaatttcattcaacattacgacatgacaggccatacacactcagcatggctaacgcgggatcaaatactaatggatcccagtttttcataacggtagtaccaacgccttggcttgataataagcatacagtatttggacgagtgactaaaggaatggaagttgtacagaggatctccaacgtcaaagtcaatcccaaaacagataagccctatgaggatgtcagcatcataaatattactgtcaagtaaaataagatttgttttaatgtacttgcaaataaaaatacaatattaaacagattattttacattaggaagcttaggacttgctgaatatacagatcatgtttcaaagatacagtatttttgtattttttattaaaggctattttttaaaaatta

SEQ ID NO: 1579 - DNA, 2019 bp, Homo sapiens
gacgatgcgaacaacatggcggcggaaagtggtagcgattttcagcagagacgtagaaggcgccgggacccggaggaaccggaaaaaacagaactcagcgaaagagagctggcagtagcagtggcggtgtcccaggagaacgatgaggagaacgaagagcgctgggttggacctttacctgtggaggcaacactggccaagaagaggaaagcagccacatgaagttggaatttcgaactcttatttagtcttagagtttgaaagagtctatcttgataatctccccagtgcatccatgtatgagcgcagttacatgcatagagatgttatcacccatgtggtatgcaccaaaacagattttattattactgccagtcatgatggacatgtcaagttctggaaaaaaatagaagagggaattgaatttgttaaacattttcgtagtcacctgggagttattgagagtattgcagttagctctgagggagcattgttctgttctgtgggtgatgataaagcaatgaaggtgtttgatgtagtgaactttgacatgatcaacatgctgaaacttggctattttcctggacagtgtgagtggatctattgcccaggggatgcaatttcttcagttgctgcttccgaaaagagtacaggaaaaattttcatttatgatggccgaggagataaccagccacttcatatttttgacaaactccatacatcacctcttactcagatacggctaaacccagtttacaaagcagtagtgtcttctgacaaatctgggatgattgaatactggactgggcctcctcatgaatataaattccccaaaaatgtgaactgggaatataaaactgacactgatttatatgaatttgccaagtgtaaggcttatccaaccagcgtatgtttttcaccagatgggaagaaaatagctactattggttctgatagaaaagttagaattttcagatttgtaactggaaaactcatgagagtctttgatgaatcactaagcatgtttactgaactgcaacagatgaggcaacagttaccagacatggaatttggccgacgaatggctgtagaacgtgagttggagaaggttgatgctgtaagattaattaatatagtttttgatgaaactggacacttcgtgctgtatggaacaatgctgggcattaaagttataaatgtagagacaaaccggtgtgtgcggattttaggcaaacaagaaaatattagagtgatgcaattggctttgttccaggggatagccaaaaagcatcgtgctgcaactactatagaaatgaaagcttctgaaaatcctgttcttcagaatattcaagctgacccaacaatagtctgtacatcattcaaaaagaatagattttatatgtttaccaaacgagaaccagaagatacgaaaagtgcagattctgatcgagatgtttttaatgagaaaccttctaaagaagaagtcatggcagctactcaagctgaaggacctaaacgagtttcggacagtgccattatccacaccagcatgggagacattcacaccaaactttttcctgttgagtgccctaagacagtggaaaacttctgtgttcacagcagaaatggttattataatgggcatacatttcaccgtataattaagggctttatgattcagactggagatccaacaggtactggtatgggaggagaaagcatatggggaggagaatttgaagatgaatttcattcaacattacgacatgacaggccatacacactcagcatggctaacgcgggatcaaatactaatggatcccagtttttcataacggtagtaccaacgccttggcttgataataagcatacagtatttggacgagtgactaaaggaatggaagttgtacagaggatctccaacgtcaaagtcaatcccaaaacagataagccctatgaggatgtcagcatcataaatattactgtcaagtaaaataagatttgttttaatgtacttgc

SEQ ID NO: 1580 - DNA, 1981 bp, Homo sapiens
gatgcgaacaacatggcggcggaaagtggtagcgattttcagcagagacgtagaaggcgccgggacccggaggaaccggaaaaaacagaactcagcgaaagagagctggcagtagcagtggcggtgtcccaggagaacgatgaggagaacgaagagcgctgggttggacctttacctgtggaggcaacactggccaagaagaggaaagaacagattttattattactgccagtcatgatggacatgtcaagttctggaaaaaaatagaagagggaattgaatttgttaaacattttcgtagtcacctgggagttattgagagtattgcagttagctctgagggagcattgttctgttctgtgggtgatgataaagcaatgaaggtgtttgatgtagtgaactttgacatgatcaacatgctgaaacttggctattttcctggacagtgtgagtggatctattgcccaggggatgcaatttcttcagttgctgcttccgaaaagagtacaggaaaaattttcatttatgatggccgaggagataaccagccacttcatatttttgacaaactccatacatcacctcttactcagatacggctaaacccagtttacaaagcagtagtgtcttctgacaaatctgggatgattgaatactggactgggcctcctcatgaatataaattccccaaaaatgtgaactgggaatataaaactgacactgatttatatgaatttgccaagtgtaaggcttatccaaccagcgtatgtttttcaccagatgggaagaaaatagctactattggttctgatagaaaagttagaattttcagatttgtaactggaaaactcatgagagtctttgatgaatcactaagcatgtttactgaactgcaacagatgaggcaacagttaccagacatggaatttggccgacgaatggctgtagaacgtgagttggagaaggttgatgctgtaagattaattaatatagtttttgatgaaactggacacttcgtgctgtatggaacaatgctgggcattaaagttataaatgtagagacaaaccggtgtgtgcggattttaggcaaacaagaaaatattagagtgatgcaattggctttgttccaggggatagccaaaaagcatcgtgctgcaactactatagaaatgaaagcttctgaaaatcctgttcttcagaatattcaagctgacccaacaatagtctgtacatcattcaaaaagaatagattttatatgtttaccaaacgagaaccagaagatacgaaaagtgcagattctgatcgagatgtttttaatgagaaaccttctaaagaagaagtcatggcagctactcaagctgaaggacctaaacgagtttcggacagtgccattatccacaccagcatgggagacattcacaccaaactttttcctgttgagtgccctaagacagtggaaaacttctgtgttcacagcagaaatggttattataatgggcatacatttcaccgtataattaagggctttatgattcagactggagatccaacaggtactggtatgggaggagaaagcatatggggaggagaatttgaagatgaatttcattcaacattacgacatgacaggccatacacactcagcatggctaacgcgggatcaaatactaatggatcccagtttttcataacggtagtaccaacgccttggcttgataataagcatacagtatttggacgagtgactaaaggaatggaagttgtacagaggatctccaacgtcaaagtcaatcccaaaacagataagccctatgaggatgtcagcatcataaatattactgtcaagtaaaataagatttgttttaatgtacttgcaaataaaaatacaatattaaacagattattttacattaggaagcttaggacttgctgaatatacagatcatgtttcaaagatacagtatttttgtattttttatt

SEQ ID NO: 1581 - DNA, 1277 bp, Homo sapiens
ggaaaagcgcgcgagcaagatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggcccagggcagcaaggacgggaagccaaagcagaaggtgatcatcgccgactgtggggagtacgtgtgaggcggcactctctctgcttccccctccgctcttgaccctgcatatccaggaaggaactgccagcctcagaggaggcagcaccgagggtgcctgtttgaagcaagcagcatttgggatatgtgcccttcctcagggtctgcttggagcagctcctctgcaggcacagcctggactattcccaggcacagctgtgggcccaggagccagctcaggtgctcccctccaccatgggcaggctgtgcaaaaagccactggcttttctcagcatttgctgctgggcctctcctgggactaccagtgtggctcttacgtgttttctttgctaaaataaaccctagttcttatattgctc

SEQ ID NO: 1582 - DNA, 1079 bp, Homo sapiens
aaagcgcgcgagcaagatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgagaaacaagaagagtcagcaattaccagccagccgaggtcctggaagctgacgtagagctcgtgccgacggcagacctgccggccgtgggagccgtggacgtcatctgcagggacagaaggggcaaggtcttttctggggttcctactgtgtgcagctactatggggtaccagggtgggggatgccctgatgagcacatttgtcaaataaatgaatgacaggaaacca

SEQ ID NO: 1583 - DNA, 1198 bp, Homo sapiens
atggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaacatgaatgaatctgagctttttggacgtacaattcgtgtcaatttggccaaaccaatgagaattaaggaaggctcttccaggccagtttggtcagatgatgactggttgaagaagttttctgggaagacgcttgaagagaataaagaggaagaagggtcagagcctcccaaagcagagacccaggagggagagcccattgctaaaaaggcccgctcaaatcctcaggtgtacatggacatcaagattgggaacaagccggctggccgcatccagatgctcctgcgttctgatgtcgtgcccatgacagcagagaatttccgctgcctgtgcactcatgaaaagggctttggctttaagggaagcagcttccaccgcatcatcccccagttcatgtgccagggcggtgatttcacaaaccacaatggcactgggggcaagtccatctatgggaagaagttcgatgatgaaaactttatcctcaagcatacgggaccaggtctactatccatggccaactctggcccaaacaccaatggctctcagttcttcctgacatgtgacaagacagactggctggatggcaagcatgtggtgtttggagaggtcaccgaaggcctagatgtcttgcggcaaattgaggttgccccagataccaaggcatcaaaagccaggggatccagaaaaaacaaagatggccaagagagaaactgggggaaaagccaaaaggttgagagccacaccatctagaagcttcctgcctgcggtgcggcacagaaacaagaagagtcagcaattaccagccagccgaggtcctggaagctgacgtagagctcgtgccgacggcagacctgccggccgtgggagccgtggacgtcatctgcagggacagaaggggcaaggtcttttctggggttcctactgtgtgcagctactatggggtaccagggtgggggatgccctgatgagcacatttgtcaaataaatgaatgacaggaaacca

SEQ ID NO: 1584 - DNA, 7827 bp, Homo sapiens
gtttttcgtttttatagaaacacagatctttgtcctaaccacaaggttcccctttggtttatgtggtttcctctggttcctgccaccaccacctccccaggccggggccttcccatccctgcccagtggggagtgggaggaagagcctgggacagtggccatacgtcccgggctgatttctggattgggggttctggggaccagggaggtgcaggtgtctgcagtgtcagaggagccgctgggctcgcccaggtgttgcctgaagccctccgtggcctcttgccccttggactcctgacaggagggacaccagtgtttgctgctcacctctgacagccagacaagggctgtgctcaggggcagctcggctgggcacacagtaggtgctttagcggacagcactgaggcccccagcaagaagcccatgagctcctccccctcccgcagtgccgccgacatctacatccgggagtatttccacagccacgtcagcggcggccaccccgaggccactcctctccgtgtgatgtacacggaccggccgctgagccagacggacccagtcacgctgcagtactgttgcctgaccgacgaccgccaggctttccgcccgcccacacgggcagagctggcgcggcaccgcgtggtggtcaccaccacctcccaggcccgtgagctcagggtgccggtcggcttcttctcccacattctcatcgatgaggcggcccagatgctggagtgcgaggccctcaccccgctggcctatgcctcgcacggcacccgcctcgtgctggcgggcgaccacatgcaggtcacaccccggctgttcagtgtggccagggcccgggcggccgagcacacgctgctgcaccgcctcttcctgtgctaccagcaggagactcacgaggtggcgcggcagagccgcctggtcttccacgagaactaccgctgcacggacgccattgtcagcttcatctcgcggcacttctacgtggccaagggcaaccccatccacgccaggggcaaggttccgccccacccccggcactacccgctcatgttctgccacgtggcgggcagcccagaccgggacatgtccatggcgtcctggctgaatctggctgagattgcgcaggtcgtcgagaaggtgcaggaggcctacaacacctggcccagctgctggggcggccgcgagcagaggtgcatctgtgtcgtttcccacggtgcccaggtcagtgcactgaggcaggagctgaggaggcgggacctaggccaggtgtctgtcggcagttttgagatcctgccagggcggcagttccgggtcgtggtgctcagcactgtgcacacctgccagagcctgctcagccctggggcactggcccctgagttcttcaccgacgcccgcgtgctcaacaccgtcctgacccgcgcccagtcccagctggtggtagtgggggacgccgtggccctctgctccttcggggcctgcggcaagctctgggagagcttcatccgtgagtgcgtggagcggcacagtgtctgccccgagggcctgtccatggagcaggtcgagcagggtgtggcgcagagacggcgctggcctccccgaggcacacaggctggggcagcggggaactgggaggctgccccagagccagtaggggacctggccgaggagcaggcggctgtggtgacggccatggtgaaggcagagccgggagatgaggctctgagcccagcatcccgtgacatcacggcaaccacagcgcagacggaggctgcggcagcaccagcaggagacgcagtgaaggaagacgtggtgcccggggcctgtgcggcaggagcggctgctgcagcgggcgtggagtccacggaggctgaggatgcagaggctgacttctggccgtgggacggggagctcaacgctgacgacgccatcctacgggagcttctggacgagagccagaaggtgatggtgaccgtcggggaggacgggctgctggacactgtcgccaggcccgagtccctgcagcaggcccggctgtacgagaacctgcccccggctgcgctacggaagctgctgcacgcggagcccgagcggtaccgccactgctctttcgtgccagagaccttcgagcgggcgtcagccatcccgctggacgatgcctcctcgggccccatccaggtcaggggccgcctggactgtgggatggccttcgccggggatgaggtgctggtgcagctcctttcgggagacaaggcgcccgaggggcggcttcggggccgcgtgctgggcgtgctgaagaggaagaggcacgagctggcgtttgtgtgccgcatggacacgtgggacccgcgcatcatggtccccatcaatggctccgtgaccaagatcttcgtggccgagctgaaggacccatcgcaggtccccatctacagcctccggaagggccggctgcagcgtgtggggcttgagaggctcaccgccgaggcccggcacagccggctcttctgggtccaaattgtcctgtggcggcaaggcttctactacccgctgggcatcgtccgggaggtgctgcctgaggccagcacctgggagcagggcctccgcatcctcggcctggagtacagcttgagggtgcccccgtcggaccaggccaccatcaccaaggtgctgcagaaataccacacggagcttggccgggttgccggccgccgagaggactgccgcgccttcttgaccttcactgtggacccccagggcgcctgcaacctcgatgatgccctcagtgtccgagacctgggtcccaggtgcgaggtggctgtgcacatcactgatgtggccagcttcgtgcccagggacggggtgctggacgtggaggcgcgaaggcagggcgctgcgttctatgcccccggcagggagccagtgcccatgctgccggccagcctctgccaggacgtcctcagcctcctgcctggccgggaccgcctggccatctccctgttcctcaccatggagaaggccagtggccagctgaagagcctgcgctttgcaccctccgtggtccagtctgaccgccagctgtcctacgaggaggcggaggaggtgatcaggcagcacccgggtgccggccgtgagctgccggcccgcctggactccgtggacgcctgcgtcgtggccgcgtgctacttctctcggctgctgcgccggcaccgcctgcggtccgactgcttctatgagcagccggacgaggacggcaccctgggcttccgcgcggcccacatcatggtgaaggagtacatgattcagtttaataggctcgtggctgagttcctggtgggcagcgagtgcacgcggacggtcacgcctctgcggtggcagccagcaccccgcagccagcagctcaaggccctgtgtgagaagcatggggaccgggtgcccctgtcactgcacctcggccaccacctgcacggcggcgggggcagtccccccgacacgcggctgcacctcctggcctccctctggaagcaggtccagtttgctgcccgcacccaggactacgaacagatggtggacttggtcaccacggacgacatgcacccattcctggctcctgcaggccgcgacctccgcaaggccctggagcgctcggcgttcggccgctgcgcccggggccaccagcagcagggcggccactactcgctgcaggtggactggtacacgtgggccacctcgcccatccgcaggtacctggacgtggtgttgcagcggcagatcctgctggcgctgggccatgggggctctgcctactctgccagggacatcgatgggctctgccaggccttcagcctccagcacgcacttgcccagagctatcagcggcgggcgcgcagcctgcacctggccgtgcagctcaaggcccagcctctggacaagctgggcttcgtggtggacgtggaggcgggctcccgctgcttccggctgctcttccccagcaaccgggagacgctgcctgacccctgccccgtcccctacggctccctgcagctggccgagcacccccacgccctggcaggccggccgggcctgcggctcctgtggcggcgccgtgtctactcagcgcagggatccagcccgcccctgccactgcctggcactgtgccggacccacacaccctggccgtggagacggccctgtggaagcagctgctggagctggtggagctgcagcgctggccggaggcggctgctctcatccaggagaagggcgaggcgtcccagcggcgggagctggtgcaggtgcagcggagccactgtggccatttcctggaggtggcccgggagctgggcagtggggacaccctgcaggtgcagctcggcaccagcctgcagcacggcttcctggtaccgagccctcagctctggacggtggcaccgggcttcagcctctgcctggagcacgtggagcggcccggagactgcttctcaggccgtgtgtaccgggccccgagggaccggtaccgcgacgtggatgagtacgcctgcgtgtgggaaccattctgcgccctggagtcggccaccggcgcggttgccgagaatgactccgtcacacttcagcacctgagtgtctcctgggaggcgtcacggacgccgcaggggcagctgcagggcgccttccgcctggaggccgccttcctcgaggagaactgtgccgacatcaacttcagctgctgctacctctgcatccggctcgaggggctgccggctcccacggccagcccacgccctgggcccagcagcctcggccctggcctgaatgttgaccccggcacgtatacctgggtggcccacgggcagacgcaggactgggaccaggagcgccgggcagaccggcaggaggctcccagacgggtgcacctcttcgtccaccacatgggcatggagaaggttccggaagaggtgctgaggccgggcaccctgttcaccgttgagctgctgcccaagcagcttcctgatctccgcaaggaggaagccgtgcgtggactagaggaggcgtccccgctggtcaccagcatcgcactgggccggcctgtcccgcagcccctctgcagagtgatccccagcaggttcctggagcggcagacctacaacatccccggaggccgccacaagctgaaccccagccagaacgtggcggtcagggaggctctggagaagcctttcacggtcattcagggcccaccaggtacagggaagacgatcgtgggcctccacatcgtattctggtttcataaatcaaaccaggagcaggtgcagcccggaggccccccccgtggggagaagcggctggggggtccctgcatcttgtactgcggcccctccaacaagtcggtggatgtcctggcaggactgctcctgagaaggatggagctgaagcccctccgtgtgtacagtgagcaggctgaggccagcgagttcccagtgccgcgtgtgggcagcaggaagctgctcaggaagagcccccgggaggggaggccgaaccagagcctcaggagcatcaccctgcaccaccggatccggcaggcccccaacccttactcgtcggaaatcaaggcctttgacacccggctgcagagaggggagctcttctccagggaggacctggtctggtacaagaaggtcttgtgggaggctcggaagttcgagctggaccggcatgaggtcatcctctgcacctgctcctgtgcagcctctgccagcctcaaaatcctggacgtgaggcagatccttgttgacgaggcaggcatggccacggaacctgaaaccctcatccccctggtgcagttcccacaggccgagaaggtggttcttctcggagaccacaagcagctgcggcctgtggtcaagaatgagcggctgcaaaacctgggtctggaccggtctctgttcgagcggtaccacgaggacgcacatatgctggacactcagtaccgcatgcatgagggcatctgtgccttcccctctgtggcgttctacaagagcaagctgaagacgtggcagggcctgaggaggccgcccagtgtcctgggccacgctggcaaggagagctgccctgtcatctttggccacgtgcagggccacgagcggagcctgctggtgtccacggacgaagggaatgagaactccaaggccaacctggaggaggtggctgaggtggtccgtatcaccaagcagctgaccctggggaggaccgtagagccccaggacatcgccgtcctcacgccctacaacgcgcaggcctctgagatcagcaaggcccttcggcgagagggcatcgccggggtggccgtgtcctccatcaccaagagccaggggagcgagtggcgctatgtgctggtgagcaccgtccgcacctgtgccaagagcgacctggaccagcggcccaccaagagctggctcaagaagtttctgggcttcgttgtggaccccaaccaagtgaatgtggctgtcacgcgggcccaggaggggctctgcctgatcggagaccacctccttctgcgctgctgccccctctggcgtagcctcctggacttctgcgaggctcagcagaccctcgtgcctgccggccaggtgcgcgtctgcaggaggccaactatgccttcctgaagagccctctccacctgcaaggtgccaggactgggagggaaagtccagggcccccccaccctccccaccaccctccgccatcagcctgcctgggccagcctgcctcctggcctcaggatctccctggggcaggaagtgggtggacttggaggaggaacggcaagggccggtccccacactcttgctcctcctgggcatctggggacaggaacacctctcagggtggccaagaggggcttccttgggaccagtgcaaggaagttctgctgtccctgggaagtctcagaaccaggaaggaaaccctgtggaggctgccctttgacctttggacgccacctgtaatcactctggatggtgtctgtggagttcaggtttattttctatttaaatgaactaaaagccagcatcctgccgggcgtggtggctcacgcccataatccagcactttgggaagccgaggcgggcagatcacctgaggtcaggagttcgagaccatcctggccaacatggtgaaaccccgtctccactaaaaatacaaaattagctgggcgtggtggcgggcgcctgtaatcccagctacttgggaggctgaggcaggagaatcgcttgactccaggaggcgcaggctgcagtgagctctgatggtaccactgcactccagcctgggtgacagagcgagaccctgtcttaaaaaaaaaaacaaaacaaaaccagcatctgttactggaacagagacctcagcccaagctcaggacaaggaggcctccctgggagagggggcctttctcccaccatcaccgcctgtgtccttcaggggctgctggagggcagcccaaagccaggggcccaccccgccccaccccaccccaccccaccctctgaaatgtgaaaagcctgcactcttcctgtgggctgcgcagtgggctcgggggttggggggtgccggggcgatgcttccaccctggactgagtgttcggggcagcctgctcggctgtatgtttctcgcacgctcacccgcttcagtgcggctctgtccctgctgccgcctccagtcctgagggaggggcttgccccaccttctacattccaatttttatatctttgaattatgtgattagatattaatttaatgataaaaccactctgaaagctcttctca

SEQ ID NO: 1585 - DNA, 8064 bp, Homo sapiens
gtttgtggggcgtgggcagccgtgctggcgtggggagtcccgctgccagtttgcacacagcgccgtggagatggctgtgtgggaggccgagcagctgggtggcctccagcggggggacctgctcacaccccctgcccctgatggcgacgggcgcacggccccccttggccagccccctggggcccagctgtactgcccggcctgcttggtcacctgccactctcaggaggccttcgagaaccactgcgcatcctcggagcacgcacagatggtggccttcgaccaggccctgccctgggagcaccgttccccacccccgggactctccaagttcgagctctgcccaaagcctgacctctgtgagtatggggacgcctgcaccaaggcacactcagcacaggagctgcaggagtgggtccggcgcacgcaggctgtggagctgcgggggcaggcggcctggcaggacgggctggtgccctaccaggagcggctgctggccgagtaccagcgcagcagcagtgaggtccttgtgctggcagagacccttgatggagtgcgtgtcacctgcaaccagcccctgatgtaccaggcccaggagaggaagacccagtacagctggacgtttgccgtccactctgaggagcccctgctacacgtggccctgctgaagcaggagccaggagccgacttctctctggtggctcccggcctcccgccaggccggctctacgcacggggtgagcgcttccgtgtgcccagctccactgccgacttccaggtgggagtgcgtgtgcaggctgcctcgttcggcacctttgagcaatgggtggtcttcgactttggccgccggccggtgctgctacaaaagctggggctgcagctgggccaggggcgtcgcccaggaccctgcaggaatctggcgctcggccaccctgaggagatggagcgctggcacactggcaaccgccacgtggtgcctggcgtggagcggacggccgagcagacggccctgatggccaagtacaagggccctgccctggccctggagttcaaccgcagcagcgtggcctcgggccccatctcaccaaccaactatcggcagaggatgcaccagtttctctatgaggaggaggcggctcagcagcagctggtggccaagctgaccctgcggggccaggtgttcctgaagacggcattgcagacgccagcgctgaacatgctcttcgcgcctccgggagcactgtacgcagaggtccccgtcccctcctccctgatgccagacacagaccagggcttcctgctgggccgggcggtcagcacagccctggtggcccctgtacctgcacccgacaatacggtgttcgaggtgcggctggagaggcgggccagctcagagcaggcgctgtggctgctgcttccggcccgctgctgcttggccctggggctgcagcctgaggcccgcctggtcctggaggtgcagttccagattgacccgatgaccttccgcctctggcaccaggcagtggacacactgcctgaggagcagctggtggtgcccgacttgcccacctgcgccctgcccagaccttggtctgtcccacccttgcggcgtggcaaccgcaagcaggagctggccgtggcgctcatcgcgggctggggccctggggatgggaggcgtgtccccccgctactcatctatggcccctttggcaccggcaagacctacacgctggccatggcctccctggaggtcatccggaggcctgaaaccaaggtgctcatctgcacacacaccaacagtgccgccgacatctacatccgggagtatttccacagccacgtcagcggcggccaccccgaggccactcctctccgtgtgatgtacacggaccggccgctgagccagacggacccagtcacgctgcagtactgttgcctgaccgacgaccgccaggctttccgcccgcccacacgggcagagctggcgcggcaccgcgtggtggtcaccaccacctcccaggcccgtgagctcagggtgccggtcggcttcttctcccacattctcatcgatgaggcggcccagatgctggagtgcgaggccctcaccccgctggcctatgcctcgcacggcacccgcctcgtgctggcgggcgaccacatgcaggtcacaccccggctgttcagtgtggccagggcccgggcggccgagcacacgctgctgcaccgcctcttcctgtgctaccagcaggagactcacgaggtggcgcggcagagccgcctggtcttccacgagaactaccgctgcacggacgccattgtcagcttcatctcgcggcacttctacgtggccaagggcaaccccatccacgccaggggcaaggttccgccccacccccggcactacccgctcatgttctgccacgtggcgggcagcccagaccgggacatgtccatggcgtcctggctgaatctggctgagattgcgcaggtcgtcgagaaggtgcaggaggcctacaacacctggcccagctgctggggcggccgcgagcagaggtgcatctgtgtcgtttcccacggtgcccaggtcagtgcactgaggcaggagctgaggaggcgggacctaggccaggtgtctgtcggcagttttgagatcctgccagggcggcagttccgggtcgtggtgctcagcactgtgcacacctgccagagcctgctcagccctggggcactggcccctgagttcttcaccgacgcccgcgtgctcaacaccgtcctgacccgcgcccagtcccagctggtggtagtgggggacgccgtggccctctgctccttcggggcctgcggcaagctctgggagagcttcatccgtgagtgcgtggagcggcacagtgtctgccccgagggcctgtccatggagcaggtcgagcagggtgtggcgcagagacggcgctggcctccccgaggcacacaggctggggcagcggggaactgggaggctgccccagagccagtaggggacctggccgaggagcaggcggctgtggtgacggccatggtgaaggcagagccgggagatgaggctctgagcccagcatcccgtgacatcacggcaaccacagcgcagacggaggctgcggcagcaccagcaggagacgcagtgaaggaagacgtggtgcccggggcctgtgcggcaggagcggctgctgcagcgggcgtggagtccacggaggctgaggatgcagaggctgacttctggccgtgggacggggagctcaacgctgacgacgccatcctacgggagcttctggacgagagccagaaggtgatggtgaccgtcggggaggacgggctgctggacactgtcgccaggcccgagtccctgcagcaggcccggctgtacgagaacctgcccccggctgcgctacggaagctgctgcacgcggagcccgagcggtaccgccactgctctttcgtgccagagaccttcgagcgggcgtcagccatcccgctggacgatgcctcctcgggccccatccaggtcaggggccgcctggactgtgggatggccttcgccggggatgaggtgctggtgcagctcctttcgggagacaaggcgcccgaggggcggcttcggggccgcgtgctgggcgtgctgaagaggaagaggcacgagctggcgtttgtgtgccgcatggacacgtgggacccgcgcatcatggtccccatcaatggctccgtgaccaagatcttcgtggccgagctgaaggacccatcgcaggtccccatctacagcctccggaagggccggctgcagcgtgtggggcttgagaggctcaccgccgaggcccggcacagccggctcttctgggtccaaattgtcctgtggcggcaaggcttctactacccgctgggcatcgtccgggaggtgctgcctgaggccagcacctgggagcagggcctccgcatcctcggcctggagtacagcttgagggtgcccccgtcggaccaggccaccatcaccaaggtgctgcagaaataccacacggagcttggccgggttgccggccgccgagaggactgccgcgccttcttgaccttcactgtggacccccagggcgcctgcaacctcgatgatgccctcagtgtccgagacctgggtcccaggtgcgaggtggctgtgcacatcactgatgtggccagcttcgtgcccagggacggggtgctggacgtggaggcgcgaaggcagggcgctgcgttctatgcccccggcagggagccagtgcccatgctgccggccagcctctgccaggacgtcctcagcctcctgcctggccgggaccgcctggccatctccctgttcctcaccatggagaaggccagtggccagctgaagagcctgcgctttgcaccctccgtggtccagtctgaccgccagctgtcctacgaggaggcggaggaggtgatcaggcagcacccgggtgccggccgtgagctgccggcccgcctggactccgtggacgcctgcgtcgtggccgcgtgctacttctctcggctgctgcgccggcaccgcctgcggtccgactgcttctatgagcagccggacgaggacggcaccctgggcttccgcgcggcccacatcatggtgaaggagtacatgattcagtttaataggctcgtggctgagttcctggtgggcagcgagtgcacgcggacggtcacgcctctgcggtggcagccagcaccccgcagccagcagctcaaggccctgtgtgagaagcatggggaccgggtgcccctgtcactgcacctcggccaccacctgcacggcggcgggggcagtccccccgacacgcggctgcacctcctggcctccctctggaagcaggtccagtttgctgcccgcacccaggactacgaacagatggtggacttggtcaccacggacgacatgcacccattcctggctcctgcaggccgcgacctccgcaaggccctggagcgctcggcgttcggccgctgcgcccggggccaccagcagcagggcggccactactcgctgcaggtggactggtacacgtgggccacctcgcccatccgcaggtacctggacgtggtgttgcagcggcagatcctgctggcgctgggccatgggggctctgcctactctgccagggacatcgatgggctctgccaggccttcagcctccagcacgcacttgcccagagctatcagcggcgggcgcgcagcctgcacctggccgtgcagctcaaggcccagcctctggacaagctgggcttcgtggtggacgtggaggcgggctcccgctgcttccggctgctcttccccagcaaccgggagacgctgcctgacccctgccccgtcccctacggctccctgcagctggccgagcacccccacgccctggcaggccggccgggcctgcggctcctgtggcggcgccgtgtctactcagcgcagggatccagcccgcccctgccactgcctggcactgtgccggacccacacaccctggccgtggagacggccctgtggaagcagctgctggagctggtggagctgcagcgctggccggaggcggctgctctcatccaggagaagggcgaggcgtcccagcggcgggagctggtgcaggtgcagcggagccactgtggccatttcctggaggtggcccgggagctgggcagtggggacaccctgcaggtgcagctcggcaccagcctgcagcacggcttcctggtaccgagccctcagctctggacggtggcaccgggcttcagcctctgcctggagcacgtggagcggcccggagactgcttctcaggccgtgtgtaccgggccccgagggaccggtaccgcgacgtggatgagtacgcctgcgtgtgggaaccattctgcgccctggagtcggccaccggcgcggttgccgagaatgactccgtcacacttcagcacctgagtgtctcctgggaggcgtcacggacgccgcaggggcagctgcagggcgccttccgcctggaggccgccttcctcgaggagaactgtgccgacatcaacttcagctgctgctacctctgcatccggctcgaggggctgccggctcccacggccagcccacgccctgggcccagcagcctcggccctggcctgaatgttgaccccggcacgtatacctgggtggcccacgggcagacgcaggactgggaccaggagcgccgggcagaccggcaggaggctcccagacgggtgcacctcttcgtccaccacatgggcatggagaaggttccggaagaggtgctgaggccgggcaccctgttcaccgttgagctgctgcccaagcagcttcctgatctccgcaaggaggaagccgtgcgtggactagaggaggcgtccccgctggtcaccagcatcgcactgggccggcctgtcccgcagcccctctgcagagtgatccccagcaggttcctggagcggcagacctacaacatccccggaggccgccacaagctgaaccccagccagaacgtggcggtcagggaggctctggagaagcctttcacggtcattcagggcccaccaggtacagggaagacgatcgtgggcctccacatcgtattctggtttcataaatcaaaccaggagcaggtgcagcccggaggccccccccgtggggagaagcggctggggggtccctgcatcttgtactgcggcccctccaacaagtcggtggatgtcctggcaggactgctcctgagaaggatggagctgaagcccctccgtgtgtacagtgagcaggctgaggccagcgagttcccagtgccgcgtgtgggcagcaggaagctgctcaggaagagcccccgggaggggaggccgaaccagagcctcaggagcatcaccctgcaccaccggatccggcaggcccccaacccttactcgtcggaaatcaaggcctttgacacccggctgcagagaggggagctcttctccagggaggacctggtctggtacaagaaggtcttgtgggaggctcggaagttcgagctggaccggcatgaggtcatcctctgcacctgctcctgtgcagcctctgccagcctcaaaatcctggacgtgaggcagatccttgttgacgaggcaggcatggccacggaacctgaaaccctcatccccctggtgcagttcccacaggccgagaaggtggttcttctcggagaccacaagcagctgcggcctgtggtcaagaatgagcggctgcaaaacctgggtctggaccggtctctgttcgagcggtaccacgaggacgcacatatgctggacactcagtaccgcatgcatgagggcatctgtgccttcccctctgtggcgttctacaagagcaagctgaagacgtggcagggcctgaggaggccgcccagtgtcctgggccacgctggcaaggagagctgccctgtcatctttggccacgtgcagggccacgagcggagcctgctggtgtccacggacgaagggaatgagaactccaaggccaacctggaggaggtggctgaggtggtccgtatcaccaagcagctgaccctggggaggaccgtagagccccaggacatcgccgtcctcacgccctacaacgcgcaggcctctgagatcagcaaggcccttcggcgagagggcatcgccggggtggccgtgtcctccatcaccaagagccaggggagcgagtggcgctatgtgctggtgagcaccgtccgcacctgtgccaagagcgacctggaccagcggcccaccaagagctggctcaagaagtttctgggcttcgttgtggaccccaaccaagtgaatgtggctgtcacgcgggcccaggaggggctctgcctgatcggagaccacctccttctgcgctgctgccccctctggcgtagcctcctggacttctgcgaggctcagcagaccctcgtgcctgccggccaggtgcgcgtctgcaggaggccaactatgccttcctgaagagccctctccacctgcaaggtgccaggactgggagggaaagt

SEQ ID NO: 1586 - DNA, 5330 bp, Homo sapiens
gccagcgatcagagcagcgctgggtgttcaggggccaagatggcggcgcgccggggacggagagacggagtcgcgccgcccccgagtgggggccccggtccggaccctggcgggggagcccgcggcagtggttggggaagtcgaagccaagcgccgtatgggactttgggcgctgtgagcggcggcgagcaggtgctgctgcatgaggaggcgggtgattctggctttgtcagtctctctcggctgggcccatctctgagggacaaggacctggaaatggaggagctaatgctgcaggatgagacactgctggggaccatgcagagctacatggatgcctcccttatctccctcattgaggattttgggagccttggagagagcaggttatctctggaggaccagaatgaagtgtcgctgctcacggctctgacggagatcttggacaatgcagattctgagaacctttctccatttgacagcattcctgattcggagctgcttgtgtcaccccgggagggctcctctctgcacaagctgcttactctctctcggacacccccagaacgtgacctcatcaccccagttgacccactggggcccagtacaggcagcagtagagggagtggggttgaaatgtctcttccagatccctcttgggacttctccccaccctctttcttagagacctcttcccccaagcttcctagctggagacccccaagatcaagaccacgctggggccaatccccacctccccagcagcgcagtgatggagaagaagaggaggaggtggccagcttcagtggccagattcttgccggggagcttgacaactgtgtgagcagtatcccggacttccccatgcatttggcctgccctgaggaggaagataaagcaacagcagcagagatggcagtgccagcagctggtgatgagagcatctcctccctgagtgagctggtgcgggccatgcacccatactgcctgcccaacctcacccacctggcatcacttgaggatgagcttcaggagcagccagatgatttgacactgcctgagggctgcgtagtgctggagattgtggggcaggcagccacagctggcgatgacctggagatcccagttgtggtgcgacaggtctctcctggaccccggcctgtgctcctggatgactcgctagagactagttctgccttgcagctgcttatgcctacactggagtcagagacagaggctgctgtgcccaaggtaaccctctgctctgagaaagaggggttgtcattgaactcagaggagaagctggactcagcctgcttattgaagcccagggaggtcgtggagccggtggtgcccaaggagcctcagaacccacctgccaatgcagcaccaggttcccagagagctcgaaagggcaggaagaagaagagcaaggagcagccagcagcctgtgtggaaggctatgccaggaggctgaggtcatcttctcgcgggcagtctactgtaggtacagaagtgacctctcaggtagacaacttgcagaaacagcctcaggaagaacttcaaaaagagtctgggcctctccagggtaaggggaagccccgggcttgggctcgggcctgggcagctgccttggagaattctagccctaagaacttggagagaagtgctggacaaagtagtcctgctaaagaaggccctctagacctctacccaaagctggctgacactatccaaaccaatcctataccaacccatctctcattggtcgactctgcccaagccagccccatgccagttgactctgttgaagctgatcccactgcagttggccctgttctagctggccctgtacctgttgaccctgggttggttgaccttgcttcaaccagctcagaactggttgagcctctcccggctgagccagtgctgatcaacccagtcctggctgactcagcagcagttgaccctgcagtggttcccatctcagataacttgccaccagttgatgctgtcccgtctggcccagcaccagttgatctagcactggttgaccctgttcctaatgacctgactccagttgacccagtgctagttaagtccagaccaactgatcccagacgtggtgcagtgtcatcagccctggggggttcagcaccccagctcctcgtggagtcagagtccttggacccaccaaagaccatcatccctgaagtcaaagaggttgtggattctctgaaaattgaaagtggtaccagtgctacaacccatgaagccagacctcggcctctcagcttatctgagtaccggcgacgaaggcagcaacgccaagcagaaacagaagagagaagtccacagcccccaactgggaagtggcctagccttccagagactcccacagggctggcagacatcccttgtcttgtcatcccaccagccccagccaagaagacagctctgcagagaagccctgaaacaccccttgagatttgccttgtgcctgtaggtcccagccctgcttctcctagtcctgagccacctgtaagcaaacctgtggcctcatctcccactgagcaggtgccatcccaggagatgccactgttggcgagaccttcccctcctgtgcagtctgtgtcccctgctgtgcccacacctccctcgatgtctgctgccctgcctttccctgcaggtgggcttggcatgccccccagtctgcccccacctcccttgcagcctcctagtcttccattgtctatggggccagtactacctgatccgtttactcactatgcccccttgccatcctggccttgttatcctcatgtgtccccttctggctatccttgcctgccccccccaccaacggtgcccctagtgtctggtactcctggtgcctatgccgtgcctcccacttgcagtgtgccttgggcaccccctcctgccccagtctcaccttacagttccacatgtacctatgggcccttgggatggggcccagggcctcaacatgctccattctggtctactgttcccccacctcctttgcctccagcctccattgggagagctgttccccaacctaaaatggagtctaggggcactccagctggccctcctgaaaatgtacttcccttgtcgatggctcctcccctcagtcttgggctacctggccatggagctcctcagacagagcctaccaaggtggaggtcaagccagtgcctgcatctccccatccgaaacacaaggtgtctgccctggtgcaaagtccccagatgaaggctctagcatgtgtgtctgctgaaggtgtgactgttgaggagcctgcatcagagaggctaaagcctgagacccaagagaccaggcccagggagaagccccccttgcctgctaccaaggctgttcccacaccaaggcagagcactgtccccaagctgcctgctgtccacccagcccgtctaaggaagctgtccttcctgcctaccccacgtactcagggttctgaagatgtggtacaggctttcatcagtgagattggaattgaggcatcggacctgtccagtctgctggagcagtttgagaaatcagaagccaaaaaggagtgtcctcctccggctcctgctgacagcttggctgtaggaaactcaggcggcgttgacattccccaggagaagaggcccctagaccggttacaagccccagaactggccaacgtggcagggctcacccctccagctacccctccccaccagttatggaagcccctggctgctgtctcactgctggccaaagccaaatctcctaagtccaccgcccaggagggaaccctgaagcctgaaggagttacggaggccaaacatccagctgcagttcgcctccaagaaggggtccatggccctagtcgagtccatgtgggctctggggaccatgactattgtgtccggagcaggacccccccaaaaaagatgcctgccctagtcattccagaggtgggctcccgatggaatgtcaagcgccatcaggacatcaccatcaaacctgtcttgtccttgggcccagctgcccctccgcccccatgcatagctgcctcccgggagccgcttgatcacaggactagcagtgagcaggcagatccctcagcaccctgccttgccccatccagcttgctgtcccctgaggcctcaccctgccggaatgacatgaacactaggactccccctgaaccctcagccaagcagcggtcaatgcgctgttaccgaaaagcctgcaggtcagccagcccctcaagccagggctggcagggccgccgaggccgcaacagccgttctgtcagctctgggtccaaccggactagcgaagcatcttcctcatcctcatcatcgtcttcctcatcccgatctcggtccaggtccctctcccccccacacaagaggtggcgaaggtccagctgtagttcctctggacgttctcgaagatgctcttcctcttcttcgtcatcatcttcctcttcgtcttcctcatcctcatcatccagttctcgaagccgctcacgatccccatccccccgccggagaagtgacaggaggcggcggtacagctcttatcgttcacatgaccattaccaaaggcaaagagtgctacaaaaggagcgtgcaatagaagaaagaagggtggtcttcattggaaagatacctggccgcatgactcgatcagagctgaaacagaggttctccgtttttggagagattgaggagtgcaccatccacttccgtgtccaaggggacaactacggcttcgtcacttatcgctatgctgaggaggcatttgcagccattgagagtggccacaagctgcggcaggcagatgagcagccctttgatctctgctttgggggccgaaggcagttctgcaagaggagctattctgatcttgactccaaccgggaagactttgacccagcacctgtaaagagcaaatttgattctcttgactttgacacattgttgaaacaggcccagaagaacctcaggaggtaaccttgggcccttccctgctatcctttttctcctttggaggtgcccaacctcctccacccccttcccctactctaggggagagagctgctagtgagatgactgttttataaagaaatggaaaaaagtgaaataaaaaatatgttgaatcagattttttaaaaggggtatttgtttttttataacaggtattgaaacaagttaacttgcattcctatgtaagataggaggggctgaggggatccccagtgtttggaacataagtcactatgcagactaataaacatcaactagagaga

SEQ ID NO: 1587 - DNA, 4423 bp, Homo sapiens
agagcagcgctgggtgttcaggggccaagatggcggcgcgccggggacggagagacggagtcgcgccgcccccgagtgggggccccggtccggaccctggcgggggagcccgcggcagtggttggggaagtcgaagccaagcgccgtatgggactttgggcgctgtgagcggcggcgagcaggtgctgctgcatgaggaggcgggtgattctggctttgtcagtctctctcggctgggcccatctctgagggacaaggacctggaaatggaggagctaatgctgcaggatgagacactgctggggaccatgcagagctacatggatgcctcccttatctccctcattgaggattttgggagccttggagagagcaggttatctctggaggaccagaatgaagtgtcgctgctcacggctctgacggagatcttggacaatgcagattctgagaacctttctccatttgacagcattcctgattcggagctgcttgtgtcaccccgggagggctcctctctgcacaagctgcttactctctctcggacacccccagaacgtgacctcatcaccccagttgacccactggggcccagtacaggcagcagtagagggagtggggttgaaatgtctcttccagatccctcttgggacttctccccaccctctttcttagagacctcttcccccaagcttcctagctggagacccccaagatcaagaccacgctggggccaatccccacctccccagcagcgcagtgatggagaagaagaggaggaggtggccagcttcagtggccagattcttgccggggagcttgacaactgtgtgagcagtatcccggacttccccatgcatttggcctgccctgaggaggaagataaagcaacagcagcagagatggcagtgccagcagctggtgatgagagcatctcctccctgagtgagctggtgcgggccatgcacccatactgcctgcccaacctcacccacctggcatcacttgaggatgagcttcaggagcagccagatgatttgacactgcctgagggctgcgtagtgctggagattgtggggcaggcagccacagctggcgatgacctggagatcccagttgtggtgcgacaggtctctcctggaccccggcctgtgctcctggatgactcgctagagactagttctgccttgcagctgcttatgcctacactggagtcagagacagaggctgctgtgcccaaggtaaccctctgctctgagaaagaggggttgtcattgaactcagaggagaagctggactcagcctgcttattgaagcccagggaggtcgtggagccggtggtgcccaaggagcctcagaacccacctgccaatgcagcaccaggttcccagagagctcgaaagggcaggaagaagaagagcaaggagcagccagcagcctgtgtggaaggctatgccaggaggctgaggtcatcttctcgcgggcagtctactgtaggtacagaagtgacctctcaggtagacaacttgcagaaacagcctcaggaagaacttcaaaaagagtctgggcctctccagggtaaggggaagccccgggcttgggctcgggcctgggcagctgccttggagaattctagccctaagaacttggagagaagtgctggacaaagtagtcctgctaaagaaggccctctagacctctacccaaagctggctgacactatccaaaccaatcctataccaacccatctctcattggtcgactctgcccaagccagccccatgccagttgactctgttgaagctgatcccactgcagttggccctgttctagctggccctgtacctgttgaccctgggttggttgaccttgcttcaaccagctcagaactggttgagcctctcccggctgagccagtgctgatcaacccagtcctggctgactcagcagcagttgaccctgcagtggttcccatctcagataacttgccaccagttgatgctgtcccgtctggcccagcaccagttgatctagcactggttgaccctgttcctaatgacctgactccagttgacccagtgctagttaagtccagaccaactgatcccagacgtggtgcagtgtcatcagccctggggggttcagcaccccagctcctcgtggagtcagagtccttggacccaccaaagaccatcatccctgaagtcaaagaggttgtggattctctgaaaattgaaagtggtaccagtgctacaacccatgaagccagacctcggcctctcagcttatctgagtaccggcgacgaaggcagcaacgccaagcagaaacagaagagagaagtccacagcccccaactgggaagtggcctagccttccagagactcccacagggctggcagacatcccttgtcttgtcatcccaccagccccagccaagaagacagctctgcagagaagccctgaaacaccccttgagatttgccttgtgcctgtaggtcccagccctgcttctcctagtcctgagccacctgtaagcaaacctgtggcctcatctcccactgagcaggtgccatcccaggagatgccactgttggcgagaccttcccctcctgtgcagtctgtgtcccctgctgtgcccacacctccctcgatgtctgctgccctgcctttccctgcaggtgggcttggcatgccccccagtctgcccccacctcccttgcagcctcctagtcttccattgtctatggggccagtactacctgatccgtttactcactatgcccccttgccatcctggccttgttatcctcatgtgtccccttctggctatccttgcctgccccccccaccaacggtgcccctagtgtctggtactcctggtgcctatgccgtgcctcccacttgcagtgtgccttgggcaccccctcctgccccagtctcaccttacagttccacatgtacctatgggcccttgggatggggcccagggcctcaacatgctccattctggtctactgttcccccacctcctttgcctccagcctccattgggagagctgttccccaacctaaaatggagtctaggggcactccagctggccctcctgaaaatgtacttcccttgtcgatggctcctcccctcagtcttgggctacctggccatggagctcctcagacagagcctaccaaggtggaggtcaagccagtgcctgcatctccccatccgaaacacaaggtgtctgccctggtgcaaagtccccagatgaaggctctagcatgtgtgtctgctgaaggtgtgactgttgaggagcctgcatcagagaggctaaagcctgagacccaagagaccaggcccagggagaagccccccttgcctgctaccaaggctgttcccacaccaaggcagagcactgtccccaagctgcctgctgtccacccagcccgtctaaggaagctgtccttcctgcctaccccacgtactcagggttctgaagatgtggtacaggctttcatcagtgagattggaattgaggcatcggacctgtccagtctgctggagcagtttgagaaatcagaagccaaaaaggagtgtcctcctccggctcctgctgacagcttggctgtaggaaactcagggtccagctgtagttcctctggacgttctcgaagatgctcttcctcttcttcgtcatcatcttcctcttcgtcttcctcatcctcatcatccagttctcgaagccgctcacgatccccatccccccgccggagaagtgacaggaggcggcggtacagctcttatcgttcacatgaccattaccaaaggcaaagagtgctacaaaaggagcgtgcaatagaagaaagaagggtggtcttcattggaaagatacctggccgcatgactcgatcagagctgaaacagaggttctccgtttttggagagattgaggagtgcaccatccacttccgtgtccaaggggacaactacggcttcgtcacttatcgctatgctgaggaggcatttgcagccattgagagtggccacaagctgcggcaggcagatgagcagccctttgatctctgctttgggggccgaaggcagttctgcaagaggagctattctgatcttgactccaaccgggaagactttgacccagcacctgtaaagagcaaatttgattctcttgactttgacacattgttgaaacaggcccagaagaacctcaggaggtaaccttgggcccttccctgctatcctttttctcctttggaggtgcccaacctcctccacccccttcccctactctaggggagagagctgctagtgagatgactgttttataaagaaatggaaaaaagtgaaataaaaaatatgttgaatcagattttttaaaaggggtatttgtttttttataacaggtattg

SEQ ID NO: 1588 - DNA, 2342 bp, Homo sapiens
ttttcattcctcgggaccgctctaggctgccaccacgccggctggccccaaaaactcgatggttgttgggcggggtcgtgacgtccttggcgtggctgcaggggaggccgcggcggggaaaatggcggacgggaaggcgggagacgagaagcctgaaaagtcgcagcgagctggagccgccggaggacctgaagaagaagcagaaaaacctgtgaaaactaagactgtttcttccagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtaagcctaaagaaactgttccaactcttgctccaaaaactctttcagtagcagcagcttttaatgaagatgaagatagtgaaccagaggaaatgcctccagaagcaaagatgaggatgaagaatattggaagggatacaccaacatcagctggaccaaactccttcaataaaggaaagcatgggttttctgataaccagaagctgtgggagcgaaatataaaatctcatcttggaaatgtccatgaccaagacaattaaatgatgttttgaaattggggtgtggggtgggtgtaaagttaaaaggaacagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtacctttttaagaattgcatatttttttagacacaactattagtacattaagagggaagcaaagttactgtctatttaaaactgcaagcagttaactctcttaactcccttattacctaaacttgtctggctcccaggaacagccttatagagagagggagtattgtattgggaagaaaatgttactgaactattgactgaaagtaaatttagataaaatacagcttttttccttatgggcatttgttttgtttcaagtcatcataaactaggtattgcattgctatccgtggatacagacgcttagctcttaaaagattttttttttatgtaaactgttgaatatttgaaatagtccacttcaccttaatgggtcttgtctatcttcattagtcttcaaagaaaaaccatttgctaccaaagtaaatcagtattttgaatgtgcttctcttgttttttgtttattagctagttcctgtaagcatttccaccagaacttgaggcaaatcgtaaggaagctgtttcttttaaaacacaaaccaccaccaaaaatttaaatgtacatattgcttaagtatttggctgtttttattttttaaaaggtataaacaccaaaaaaaaaattaacattgtatgaagatggaaaataagaagatgcactttctgtaactttgtctaaggatttaaattactaacttatgaactccaatttgaattgaacttaactatcggctttcttactggtaaaattatatggtttattttaaatgcgtacatattgaccaatggcctctgaaaaagcacattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaa

SEQ ID NO: 1589 - DNA, 5523 bp, Homo sapiens
gagcgcacggcggcggcagaggcggcggcggccgggcctaggagcgactctcggtcgtgcagcggcggcgagcgctcgcgagcggctgcgggacgcgaggtttccggagctgagctcaatgtgcagcaatggatgacgacagcctggatgagcttgtggcccggagcccagggccggatggacacccacaggtcggccctgcggacccggcaggtgactttgaagaaagcagcgtgggcagcagtggggactctggggacgacagtgacagcgagcatggagatggcacagacggagaagacgagggggcgtctgaggaggaagacctggaagacagatctggttccgaggattctgaagacgacggggagacattgctggaggtagcgggtactcaggggaaactggaagccgctggctctttcaattctgatgatgatgcagagagctgcccaatctgtctcaacgcattcagagaccaggccgtggggacgccggagaactgtgcccattacttctgcctggactgcattgtcgaatggtccaagaatgccaattcctgtccagttgatcgaactctatttaagtgcatttgtattcgagctcaatttggtggtaaaatcttaagaaagatcccagtggagaacaccaaagcgagcgaggaggaggaggacccgaccttctgtgaggtgtgcggcaggagcgaccgtgaggacaggcttttgctctgcgacggctgcgatgcggggtaccacatggaatgcttggacccccctctccaggaggtgccggtggacgagtggttctgcccggaatgtgctgcgcctggtgttgtccttgccgctgatgcgggtcccgtgagtgaggaggaggtctccctgctcttggctgatgtggtgcccaccaccagcaggcttcggcctcgagcaggtaggacccgggcgatagccaggacacggcagagtgagagagtgagagcaaccgtgaaccggaaccggatctccacggccaggagggtccagcacacaccagggcgcctcgggtcttccctgctggatgaagccatcgaggctgtggcgactggcctgagcactgccgtgtatcagcgccccctgacgccgcgcactcccgcccgacggaagaggaagacaagaagacggaagaaagtgccgggaagaaagaaaaccccgtccggaccatccgcaaaaagtaagagctcagcgacaagatctaagaaacgccaacatcgagtgaagaagagaagagggaagaaggtaaagagtgaagccaccactcgctctcgaatcgcgcggacgctgggcctgcgcaggcctgttcacagcagctgcatcccgtcagtgttgaagccagtggagccctctttggggctgctgagagcggatattggagctgcctctctgtctctgtttggagatccttatgagctggatcccttcgacagcagtgaagagctttctgcaaaccctctttcccctctgagtgccaagagacgggctctgtcccggtcagccctgcagtcccaccagcccgtggccaggcccgtctccgtggggctttccaggaggcgcctccctgccgcggtgccagagccagacttggaggaggagccagtgcctgacctgctgggcagcatcctgtcgggccagagcctcctgatgctgggcagcagtgatgtcatcatccaccgcgacggctccctcagcgccaagagggcggctccagtttcttttcagcgaaactcaggcagtctgtccagaggggaagaaggattcaagggctgcctgcagccccgagcactgccctccgggagcccggcccaaggcccgtcaggaaacaggccacagagcacagggctcagctgtcaaggcaggtcccgcacccccgcccgcaccgcgggggcgcctgtgaggctggacttgccagcagcccctggggcggttcaggctcggaacttgtcaaatgggagtgtgcctggcttcagacagagccacagcccctggttcaacggcaccaacaagcacaccttgccccttgcctctgccgcgtctaagatctcaagcagagattctaagcccccatgtcgcagtgtggtgccggggcctcccctgaagccagcgcccagaagaacagacatctctgagctacccaggataccaaagatcaggagagatgacggtggtggcagacgggatgcggccccggcccacgggcagagcattgagatccccagtgcctgcatcagccgactgactggcagggagggcaccgggcagccagggcgaggcacacgggcagagagcgaggccagcagcagggtgccccgggagcccggggtgcacacgggcagctcccggcccccagcccccagctcccatggcagtttggccccactgggaccatcaagagggaaaggggtcgggtcgacctttgagagcttccggatcaatattcctggaaacatggcacattccagccagctctccagccctggcttctgtaacacgttccggcctgtggacgataaggagcagaggaaggagaacccctcacccctcttctccatcaagaagacgaagcagctgcggagcgaggtctacgacccatccgaccccaccggctccgactccagcgcccctggcagcagccccgagaggtctggccccggcctcctgccctctgagatcacacgaaccatctccatcaacagcccgaaggcccagacggtgcaggctgtgcgctgcgtcacctcctacacggtggagagcatctttggtacagagcccgaaccccctctcggaccgtcctccgccatgtccaagctccggggtgcagtggctgccgagggggcctctgacacggagcgagaggagcccacagagagccagggcctggctgcccggctgcggaggccatcccccccagagccctgggatgaggaggatggggcgtcttgcagcaccttctttggctctgaggagcggacggtgacctgtgtgactgtcgtggagccggaagccccacccagcccggacgtgctgcaggctgccacccacagagtcgtggagctcaggcccccttcccggtcccgctccacatccagctcccgcagcaggaagaaggccaagaggaagagggtgtccagggagcacggacggacgcgctctgggacgcgctctgaatccagggacaggagctcgaggtcagcgtcaccatcagtgggtgaggagcgccccaggaggcagcggtccaaggccaagagccggcggtcctccagtgaccgctccagcagccgagagcgagctaagaggaagaaagccaaggacaagagcagggagcacaggcggggcccctggggccacagccggaggacgtcccggtcgcggtcggggagccctggcagctcttcctatgagcactatgagagtaggaagaagaagaaaaggagatcagcgtccagacctcggggaagggagtgctcccccaccagcagcctggagaggctctgcaggcacaagcatcagcgggaacgcagccacgagcggccagacaggaaggagagtgtggcgtggccccgagaccggaggaagcggaggtcccggtccccaagctcggagcacagggcacgggagcacaggcggcctcggtcccgtgagaagtggccgcagacccggtcccattccccagagaggaagggggctgtgagggaggcttccccagcgccccttgcacagggggagccagggcgggaagacctccccaccaggttgccagccttgggggaagcacatgtctcgccggaggtggctacggccgacaaggcccccctgcaggctccccctgtcctggaggtggcagctgagtgtgagccggacgacctggacctggattatggcgactccgtggaggccggacacgtctttgatgatttctcaagcgacgccgttttcatccagctcgatgacatgagctcgccaccttctcccgaaagcacagactcttccccggagcgagacttcccactgaagcctgcgttgcccccagccagcctggccgtggccgccatccagagggaggtgtcattgatgcacgatgaagacccttcgcagcccccacccctgccagagggcacccaggagccacatttgctcaggccggacgcggctgagaaggctgaggcacccagttccccggatgtggcgcctgcggggaaggaagacagcccctctgcgagtgggagggtacaggaggcagcccggcctgaggaggtggtttcgcagacccccctgctgcggtccagagccctggtgaagcgggtcacctggaacctgcaggagtcggagagcagcgcccccgccgaggacagagccccccgggcaccacttcacaggccacagaagccccgagaaggagcctgggacatggaggatgtggcccccacaggggtcaggcaggtgttctccgagctgccctttcccagtcacgtgcttccggaacccgggttcccagacacagacccctctcaggtttacagccccggcctgccgcctgccccggcccagccctcaagcatcccaccctgcgcactggtcagccagcccacggtccagttcatccttcaggggagcctgccgctagtgggctgtggggcagcacagaccctggccccagtgcccgctgccctgaccccagcctcagagccagccagtcaagccactgcagccagcaactcggaggagaagaccccggcccccaggctagctgcggagaaaaccaagaaggaggagtacatgaagaagctgcacatgcaggagcgtgctgtggaggaggtgaagctggccatcaagcccttctaccagaagagggaggtgaccaaggaggagtacaaggacatcctgcgcaaggccgtgcagaagatctgccacagcaagagtggagagatcaaccccgtgaaggtggccaacctggtgaaggcgtacgtggacaagtacaggcacatgcgcaggcacaagaaaccagaggccggggaggagccgcccacgcagggggccgagggctgaggccaggcaatcacgggctatgcccggggagctgtcgggagtggcgggaatcggggccatgcccggggagctgtcgggagtggcgggaatcggggccatgcccggggagctgtcgggagtggcgggaaatggggggcatcaccatgcctgccgtcgggttcctgcgctgacacctggtctgtgcacctgtgttgctcacagttgaaaactggacacttttgtatgtatattatagagacactgtttccattctaatttatcaaaaatggattatctttagaaacctcttgattgacttactacttggaagataaagcacttggtgatcaagaggggctcctggtggggtggcgcgtccttgataaatctctaggtggcctcccgccaacagctgctgtgtacctttggctctgaattaggaatatctttactttctcttttccaa

SEQ ID NO: 1590 - DNA, 5227 bp, Homo sapiens
gcctaggagcgactctcggtcgtgcagcggcggcgagcgctcgcgagcggctgcgggacgcgaggtttccggagctgagctcaatgtgcagcaatggatgacgacagcctggatgagcttgtggcccggagcccagggccggatggacacccacaggtcggccctgcggacccggcaggtgactttgaagaaagcagcgtgggcagcagtggggactctggggacgacagtgacagcgagcatggagatggcacagacggagaagacgagggggcgtctgaggaggaagacctggaagacagatctggttccgaggattctgaagacgacggggagacattgctggaggtagcgggtactcaggggaaactggaagccgctggctctttcaattctgatgatgatgcagagagctgcccaatctgtctcaacgcattcagagaccaggccgtggggacgccggagaactgtgcccattacttctgcctggactgcattgtcgaatggtccaagaatgccaattcctgtccagttgatcgaactctatttaagtgcatttgtattcgagctcaatttggtggtaaaatcttaagaaagatcccagtggagaacaccaaagcgagcgaggaggaggaggacccgaccttctgtgaggtgtgcggcaggagcgaccgtgaggacaggcttttgctctgcgacggctgcgatgcggggtaccacatggaatgcttggacccccctctccaggaggtgccggtggacgagtggttctgcccggaatgtgctgcgcctggtgttgtccttgccgctgatgcgggtcccgtgagtgaggaggaggtctccctgctcttggctgatgtggtgcccaccaccagcaggcttcggcctcgagcaggtaggacccgggcgatagccaggacacggcagagtgagagagtgagagcaaccgtgaaccggaaccggatctccacggccaggagggtccagcacacaccagggcgcctcgggtcttccctgctggatgaagccatcgaggctgtggcgactggcctgagcactgccgtgtatcagcgccccctgacgccgcgcactcccgcccgacggaagaggaagacaagaagacggaagaaagtgccgggaagaaagaaaaccccgtccggaccatccgcaaaaagtaagagctcagcgacaagatctaagaaacgccaacatcgagtgaagaagagaagagggaagaaggtaaagagtgaagccaccactcgctctcgaatcgcgcggacgctgggcctgcgcaggcctgttcacagcagctgcatcccgtcagtgttgaagccagtggagccctctttggggctgctgagagcggatattggagctgcctctctgtctctgtttggagatccttatgagctggatcccttcgacagtgaagagctttctgcaaaccctctttcccctctgagtgccaagagacgggctctgtcccggtcagccctgcagtcccaccagcccgtggccaggcccgtctccgtggggctttccaggaggcgcctccctgccgcggtgccagagccagacttggaggaggagccagtgcctgacctgctgggcagcatcctgtcgggccagagcctcctgatgctgggcagcagtgatgtcatcatccaccgcgacggctccctcagcgccaagagggcggctccagtttcttttcagcgaaactcaggcagtctgtccagaggggaagaaggattcaagggctgcctgcagccccgagcactgccctccgggagcccggcccaaggcccgtcaggaaacaggccacagagcacagggctcagctgtcaaggcaggtcccgcacccccgcccgcaccgcgggggcgcctgtgaggctggacttgccagcagcccctggggcggttcaggctcggaacttgtcaaatgggagtgtgcctggcttcagacagagccacagcccctggttcaacggcaccaacaagcacaccttgccccttgcctctgccgcgtctaagatctcaagcagagattctaagcccccatgtcgcagtgtggtgccggggcctcccctgaagccagcgcccagaagaacagacatctctgagctacccaggataccaaagatcaggagagatgacggtggtggcagacgggatgcggccccggcccacgggcagagcattgagatccccagtgcctgcatcagccgactgactggcagggagggcaccgggcagccagggcgaggcacacgggcagagagcgaggccagcagcagggtgccccgggagcccggggtgcacacgggcagctcccggcccccagcccccagctcccatggcagtttggccccactgggaccatcaagagggaaaggggtcgggtcgacctttgagagcttccggatcaatattcctggaaacatggcacattccagccagctctccagccctggcttctgtaacacgttccggcctgtggacgataaggagcagaggaaggagaacccctcacccctcttctccatcaagaagacgaagcagctgcggagcgaggtctacgacccatccgaccccaccggctccgactccagcgcccctggcagcagccccgagaggtctggccccggcctcctgccctctgagatcacacgaaccatctccatcaacagcccgaaggcccagacggtgcaggctgtgcgctgcgtcacctcctacacggtggagagcatctttggtacagagcccgaaccccctctcggaccgtcctccgccatgtccaagctccggggtgcagtggctgccgagggggcctctgacacggagcgagaggagcccacagagagccagggcctggctgcccggctgcggaggccatcccccccagagccctgggatgaggaggatggggcgtcttgcagcaccttctttggctctgaggagcggacggtgacctgtgtgactgtcgtggagccggaagccccacccagcccggacgtgctgcaggctgccacccacagagtcgtggagctcaggcccccttcccggtcccgctccacatccagctcccgcagcaggaagaaggccaagaggaagagggtgtccagggagcacggacggacgcgctctgggacgcgctctgaatccagggacaggagctcgaggtcagcgtcaccatcagtgggtgaggagcgccccaggaggcagcggtccaaggccaagagccggcggtcctccagtgaccgctccagcagccgagagcgagctaagaggaagaaagccaaggacaagagcagggagcacaggcggggcccctggggccacagccggaggacgtcccggtcgcggtcggggagccctggcagctcttcctatgagcactatgagagtaggaagaagaagaaaaggagatcagcgtccagacctcggggaagggagtgctcccccaccagcagcctggagaggctctgcaggcacaagcatcagcgggaacgcagccacgagcggccagacaggaaggagagtgtggcgtggccccgagaccggaggaagcggaggtcccggtccccaagctcggagcacagggcacgggagcacaggcggcctcggtcccgtgagaagtggccgcagacccggtcccattccccagagaggaagggggctgtgagggaggcttccccagcgccccttgcacagggggagccagggcgggaagacctccccaccaggttgccagccttgggggaagcacatgtctcgccggaggtggctacggccgacaaggcccccctgcaggctccccctgtcctggaggtggcagctgagtgtgagccggacgacctggacctggattatggcgactccgtggaggccggacacgtctttgatgatttctcaagcgacgccgttttcatccagctcgatgacatgagctcgccaccttctcccgaaagcacagactcttccccggagcgagacttcccactgaagcctgcgttgcccccagccagcctggccgtggccgccatccagagggaggtgtcattgatgcacgatgaagacccttcgcagcccccacccctgccagagggcacccaggagccacatttgctcaggccggacgcggctgagaaggctgaggcacccagttccccggatgtggcgcctgcggggaaggaagacagcccctctgcgagtgggagggtacaggaggcagcccggcctgaggaggtggtttcgcagacccccctgctgcggtccagagccctggtgaagcgggtcacctggaacctgcaggagtcggagagcagcgcccccgccgaggacagagccccccgggcaccacttcacaggccacagaagccccgagaaggagcctgggacatggaggatgtggcccccacaggggtcaggcaggtgttctccgagctgccctttcccagtcacgtgcttccggaacccgggttcccagacacagacccctctcaggtttacagccccggcctgccgcctgccccggcccagccctcaagcatcccaccctgcgcactggtcagccagcccacggtccagttcatccttcaggggagcctgccgctagtgggctgtggggcagcacagaccctggccccagtgcccgctgccctgaccccagcctcagagccagccagtcaagccactgcagccagcaactcggaggagaagaccccggcccccaggctagctgcggagaaaaccaagaaggaggagtacatgaagaagctgcacatgcaggagcgtgctgtggaggaggtgaagctggccatcaagcccttctaccagaagagggaggtgaccaaggaggagtacaaggacatcctgcgcaaggccgtgcagaagatctgccacagcaagagtggagagatcaaccccgtgaaggtggccaacctggtgaaggcgtacgtggacaagtacaggcacatgcgcaggcacaagaaaccagaggccggggaggagccgcccacgcagggggccgagggctgaggccaggcaatcacgggctatgcccggggagctgtcgggagtggcgggaatcggggccatgcccggggagctgtcgggagtggcgggaatcggggccatgcccggggagctgtcgggagtggcgggaaatggggggcatcaccatgcctgccgtcgggttcctgcgctgacacctggtctgtgcacc

SEQ ID NO: 1591 - DNA, 2957 bp, Homo sapiens
cgggtggctttgcgggcgctcgcggtaagtttgcgccaagtgcgcggcagccgggacgcagacggcggcggcggcgagaggcggagcccggggaccaccccccatcaccctccccccagtcacctcacgtaccacaacctcacgtaacctctcaccccccctccgatacccccagccccgggatggcagcgcccgccagccttcccggccggaccggctgtcgccagtgccggctttagcctgtgggactaggccccgccgaggcctgacccccggagccgggacccactgtgcagccagcagccgggccgggactgaggggccgctcccccctcgcggcccgtcgggaggacgctgtcgtcccggggactgggggccggggggtgggggggagccagggcgaggaagtcgggacccgtattgggaaaaaagcggggccggggtcaggagcgccccctcccctcacctcccccctccccccggggttgggggggccggagcagagagcacccagcccgggaggtggatgaatgtgggagaaaatggagaccaagacgatcgtgtacgacttggacacatcaggggggctgatggagcaaatccaagctctgctggctccccccaagacggacgaggcagaaaagcgcagtcggaagcctgagaaggagccccggagaagcggcagggccaccaaccacgacagctgcgatagctgcaaggaaggtggagatctcctgtgctgcgaccactgcccggctgccttccacctccagtgctgtaaccctccactgagtgaagaaatgttgcctcctggagagtggatgtgtcaccggtgcactgttcgccgaaagaaacgagagcagaaaaaggagctgggtcatgtcaatggactggtggacaaatctggcaaacggactacatcccccagcagtgacactgacttgttggacagatcggccagcaaaactgaactaaaggccattgcccatgcccggatcctggaaaggagagccagcaggcctggcacacccacatccagcgccagcacagagactcccacctctgagcagaatgatgtcgacgaagacatcattgacgtggatgaggaaccagtagcagcggagccagactatgtgcagccccagctgaggcggccctttgagctgctgattgctgccgccatggagcggaaccccacccaatttcagttgcccaatgaactgacttgtaccactgcactaccaggttctagcaagaggagaagaaaggaggaaaccacagggaaaaatgttaagaagacacagcatgaattagatcacaatggtctcgttcccttacccgtcaaagtctgcttcacgtgtaacaggagttgccgtgtggctcctctcatccagtgtgactattgccctctcctgtttcacatggattgcctcgagccgccgctcactgccatgcccctgggcagatggatgtgtccgaatcacatcgaacatgtggtgctgaaccagaagaatatgacactgagcaatcggtgccaggtgtttgatcgtttccaggacaccgtttcgcagcatgtcgtcaaagtggacttcctgaaccgaatccacaagaagcacccccctaaccggcgtgtgctccagtcggtcaaaagaagaagcttgaaggttcctgatgctataaaatctcagtaccagtttccaccccctctcattgcacccgcggccattcgggacggggagctgatctgcaatgggatccctgaggaatcacagatgcaccttttgaactctgagcacttagccacccaagcagagcagcaagagtggctctgtagtgttgttgcgctccagtgcagcatattgaaacatttatctgctaagcagatgccttcgcattgggactctgaacagacagagaaggctgatattaagcctgttattgtgactgacagctcagtcaccacctccctgcaaacagctgacaagacacctacaccttcccactaccccttgtcctgcccctcagggattagcacccagaattccctgagctgctctccaccccaccagtccccagccctagaggacatcggctgcagttcttgtgcggaaaaatccaagaaaaccccttgtgggactgccaatgggccagtgaacacagaggtgaaagctaatggcccacacctctacagcagccctactgattccacggacccccggcgacttccaggcgctaacaccccactaccaggcctctcacaccggcaaggctggccccggcccctcacgccaccagcggctgggggccttcagaaccacaccgtcggcatcattgtgaagacagagaatgccactggccccagctcttgcccccagaggagtttggttcctgtcccaagcctgcccccttccattcccagctcttgtgccagcatcgagaacaccagcactttgcaaagaaagactgtccaatcacagataggacctccgttgacagattcaaggccactgggctcacccccaaacgccacccgggtgctcactcccccgcaagcagcaggagatggtatcttggccacaacagccaaccaacgattcagctcaccagcgccatcgtcaggtgagtgctgctcagccttgggttgatttggaataattttatgctctttctggcaaataagattctaaaagcacttatatccctgtgaatacttcagaggactttggcctttgtattgtttgtcttactctcatttccgtaatagaagaggaagcacatgttaacttgtcccgtttataaatgggactgcttaggctctgaaagcttcagtgatttccttaaaatgacctactgagtcagtggcaggattggaaccacagcccaggtctcctgactccatcccataccttccaggcctaggcctctgcctgttttgttctgtcaccttaaaagaaggc

SEQ ID NO: 1592 - DNA, 4759 bp, Homo sapiens
cttagtttgcacacaaacaccaatggatgaacagtccctagcttcctgcggctgcgccttgacccctacaagctttctcaagcgcctgcgcgagacctcaggtcccgcccttttgtctcagtgcgctggcgcagggcagaaaggtggggcttcggtcctccagacgaatgccagcgcggctgcgcgctggggggtactccctcaccgcggctgcgcgggagccaggccgccggctgtcactgcggttgcgcgcggcgagcgccgatcccggggcgcctgcgcgggtggctttgcgggcgctcgcggtaagtttgcgccaagtgcgcggcagccgggacgcagacggcggcggcggcgagaggcggagcccggggaccaccccccatcaccctccccccagtcacctcacgtaccacaacctcacgtaacctctcaccccccctccgatacccccagccccgggatggcagcgcccgccagccttcccggccggaccggctgtcgccagtgccggctttagcctgtgggactaggccccgccgaggcctgacccccggagccgggacccactgtgcagccagcagccgggccgggactgaggggccgctcccccctcgcggcccgtcgggaggacgctgtcgtcccggggactgggggccggggggtgggggggagccagggcgaggaagtcgggacccgtattgggaaaaaagcggggccggggtcaggagcgccccctcccctcacctcccccctccccccggggttgggggggccggagcagagagcacccagcccgggaggtggatgaatgtgggagaaaatggagaccaagacgatcgtgtacgacttggacacatcaggggggctgatggagcaaatccaagctctgctggctccccccaagacggacgaggcagaaaagcgcagtcggaagcctgagaaggagccccggagaagcggcagggccaccaaccacgacagctgcgatagctgcaaggaaggtggagatctcctgtgctgcgaccactgcccggctgccttccacctccagtgctgtaaccctccactgagtgaagaaatgttgcctcctggagagtggatgtgtcaccggtgcactgttcgccgaaagaaacgagagcagaaaaaggagctgggtcatgtcaatggactggtggacaaatctggcaaacggactacatcccccagcagtgacactgacttgttggacagatcggccagcaaaactgaactaaaggccattgcccatgcccggatcctggaaaggagagccagcaggcctggcacacccacatccagcgccagcacagagactcccacctctgagcagaatgatgtcgacgaagacatcattgacgtggatgaggaaccagtagcagcggagccagactatgtgcagccccagctgaggcggccctttgagctgctgattgctgccgccatggagcggaaccccacccaatttcagttgcccaatgaactgacttgtaccactgcactaccaggttctagcaagaggagaagaaaggaggaaaccacagggaaaaatgttaagaagacacagcatgaattagatcacaatggtctcgttcccttacccgtcaaagtctgcttcacgtgtaacaggagttgccgtgtggctcctctcatccagtgtgactattgccctctcctgtttcacatggattgcctcgagccgccgctcactgccatgcccctgggcagatggatgtgtccgaatcacatcgaacatgtggtgctgaaccagaagaatatgacactgagcaatcggtgccaggtgtttgatcgtttccaggacaccgtttcgcagcatgtcgtcaaagtggacttcctgaaccgaatccacaagaagcacccccctaaccggcgtgtgctccagtcggtcaaaagaagaagcttgaaggttcctgatgctataaaatctcagtaccagtttccaccccctctcattgcacccgcggccattcgggacggggagctgatctgcaatgggatccctgaggaatcacagatgcaccttttgaactctgagcacttagccacccaagcagagcagcaagagtggctctgtagtgttgttgcgctccagtgcagcatattgaaacatttatctgctaagcagatgccttcgcattgggactctgaacagacagagaaggctgatattaagcctgttattgtgactgacagctcagtcaccacctccctgcaaacagctgacaagacacctacaccttcccactaccccttgtcctgcccctcagggattagcacccagaattccctgagctgctctccaccccaccagtccccagccctagaggacatcggctgcagttcttgtgcggaaaaatccaagaaaaccccttgtgggactgccaatgggccagtgaacacagaggtgaaagctaatggcccacacctctacagcagccctactgattccacggacccccggcgacttccaggcgctaacaccccactaccaggcctctcacaccggcaaggctggccccggcccctcacgccaccagcggctgggggccttcagaaccacaccgtcggcatcattgtgaagacagagaatgccactggccccagctcttgcccccagaggagtttggttcctgtcccaagcctgcccccttccattcccagctcttgtgccagcatcgagaacaccagcactttgcaaagaaagactgtccaatcacagataggacctccgttgacagattcaaggccactgggctcacccccaaacgccacccgggtgctcactcccccgcaagcagcaggagatggtatcttggccacaacagccaaccaacgattcagctcaccagcgccatcgtcagatggcaaggtcagccccggcacgttatccataggaagcgctttaaccgtaccctctttcccagccaactctactgccatggtggacctcaccaactcacttcgagcatttatggatgtcaatggagaaatcgagataaatatgctggacgagaagctgatcaagtttctggccttgcagagaatacatcagcttttcccctcccgggtccaaccttcaccgggcagtgtcgggacacatcagctggcttctggagggcaccacatagaagtgcaaagaaaggaggtacaggcccgagctgtgttctaccccctcttagggttgggaggagctgtgaacatgtgctatcgaaccctctacatcgggacaggagctgacatggatgtgtgccttacaaactatggtcactgtaactacgtgtccgggaaacatgcctgcatattctacgatgagaataccaaacattatgagctgttaaactacagtgagcatgggacaacggtggacaatgtgctgtattcatgtgacttctcggagaagaccccgccaacccccccaagcagtattgttgccaaagtgcagagtgtcatcaggcgccgccggcaccagaaacaggacgaagagccaagtgaggaggcagccatgatgagttcccaggcccaggggccgcagcggagaccctgcaattgcaaagccagcagctcgagcttgattgggggcagtggggccggctgggagggcacagccttactgcaccatggcagctacatcaagctgggctgcctgcagtttgtcttcagcatcactgagtttgcgaccaaacagcccaaaggcgatgccagcctgctgcaggatggggtcttggccgagaagctctctctcaagccccaccagggccctgtgctgcgctccaactctgttccttaggactggcggctaccccgccactggcctgtacacccacccaagactcctgcaatgcaaaaatgtacacaaaccaagcccgggtgttttctatactctaccagaaacccttcaactacaatctttgcatgaaatgaagaaaaccttttgactgttttttaaaaatcctttttcttttctcaagttctagggggcatttgcacatatatttgtactcaacatttcatgggaaagcggcagacctgagctgaggaacagcgtgggcagggagggaaagacccagggtctggacacttcctccaacacaaaacccttccccacccacctcctgctccctccccctcgcccaccattgtaaaataatcagaaacttgttctattttgtggcagtgacaatagttttatattaaaagaaaaaatacagttttcatacagcaaaatctatacaatatcattgttttatttaatataaagatcgctacccaccttccttccatggttcccaccctccacgttattttccctttctgcagcggttgcactacaggtagctactgtgtattatggacaaatgagaaatgaattctttttctggctgtccatctattttatttcaaataaggaaaagtgtatttggattttgtgtaaatacatctagtgatgacattttttcaatgtttttaaaaaccgtgtacagtactacatgtggtagagcgttttctcaaattgtctattgtagcaaaaatgtttttgtcgtaaacctgttttgtctcctttttttgttctcttgccacttctctcctcttcctcctgcccctggttccctcctctcctcccacccccacaaccagtaccaatgtacatagtaattgtaatgttttagactttacagaaactttcctgtattctgtatataaaaaacaaaaatacttcaaa

SEQ ID NO: 1593 - DNA, 3080 bp, Homo sapiens
cgggtggctttgcgggcgctcgcggtaagtttgcgccaagtgcgcggcagccgggacgcagacggcggcggcggcgagaggcggagcccggggaccaccccccatcaccctccccccagtcacctcacgtaccacaacctcacgtaacctctcaccccccctccgatacccccagccccgggatggcagcgcccgccagccttcccggccggaccggctgtcgccagtgccggctttagcctgtgggactaggccccgccgaggcctgacccccggagccgggacccactgtgcagccagcagccgggccgggactgaggggccgctcccccctcgcggcccgtcgggaggacgctgtcgtcccggggactgggggccggggggtgggggggagccagggcgaggaagtcgggacccgtattgggaaaaaagcggggccggggtcaggagcgccccctcccctcacctcccccctccccccggggttgggggggccggagcagagagcacccagcccgggaggtggatgaatgtgggagaaaatggagaccaagacgatcgtgtacgacttggacacatcaggggggctgatggagcaaatccaagctctgctggctccccccaagacggacgaggcagaaaagcgcagtcggaagcctgagaaggagccccggagaagcggcagggccaccaaccacgacagctgcgatagctgcaaggaaggtggagatctcctgtgctgcgaccactgcccggctgccttccacctcctggtctaccaggactttgtagcacccatctctttgtttcatggtacttttcatgatgggcccacctgttcatttgcacagaaacgagagcagaaaaaggagctgggtcatgtcaatggactggtggacaaatctggcaaacggactacatcccccagcagtgacactgacttgttggacagatcggccagcaaaactgaactaaaggccattgcccatgcccggatcctggaaaggagagccagcaggcctggcacacccacatccagcgccagcacagagactcccacctctgagcagaatgatgtcgacgaagacatcattgacgtggatgaggaaccagtagcagcggagccagactatgtgcagccccagctgaggcggccctttgagctgctgattgctgccgccatggagcggaaccccacccaatttcagttgcccaatgaactgacttgtaccactgcactaccaggttctagcaagaggagaagaaaggaggaaaccacagggaaaaatgttaagaagacacagcatgaattagatcacaatggtctcgttcccttacccgtcaaagtctgcttcacgtgtaacaggagttgccgtgtggctcctctcatccagtgtgactattgccctctcctgtttcacatggattgcctcgagccgccgctcactgccatgcccctgggcagatggatgtgtccgaatcacatcgaacatgtggtgctgaaccagaagaatatgacactgagcaatcggtgccaggtgtttgatcgtttccaggacaccgtttcgcagcatgtcgtcaaagtggacttcctgaaccgaatccacaagaagcacccccctaaccggcgtgtgctccagtcggtcaaaagaagaagcttgaaggttcctgatgctataaaatctcagtaccagtttccaccccctctcattgcacccgcggccattcgggacggggagctgatctgcaatgggatccctgaggaatcacagatgcaccttttgaactctgagcacttagccacccaagcagagcagcaagagtggctctgtagtgttgttgcgctccagtgcagcatattgaaacatttatctgctaagcagatgccttcgcattgggactctgaacagacagagaaggctgatattaagcctgttattgtgactgacagctcagtcaccacctccctgcaaacagctgacaagacacctacaccttcccactaccccttgtcctgcccctcagggattagcacccagaattccctgagctgctctccaccccaccagtccccagccctagaggacatcggctgcagttcttgtgcggaaaaatccaagaaaaccccttgtgggactgccaatgggccagtgaacacagaggtgaaagctaatggcccacacctctacagcagccctactgattccacggacccccggcgacttccaggcgctaacaccccactaccaggcctctcacaccggcaaggctggccccggcccctcacgccaccagcggctgggggccttcagaaccacaccgtcggcatcattgtgaagacagagaatgccactggccccagctcttgcccccagaggagtttggttcctgtcccaagcctgcccccttccattcccagctcttgtgccagcatcgagaacaccagcactttgcaaagaaagactgtccaatcacagataggacctccgttgacagattcaaggccactgggctcacccccaaacgccacccgggtgctcactcccccgcaagcagcaggagatggtatcttggccacaacagccaaccaacgattcagctcaccagcgccatcgtcagatggcaaggtcagccccggcacgttatccataggaagcgctttaaccgtaccctctttcccagccaactctactgccatggtggacctcaccaactcacttcgagcatttatggatgtcaatggagaaatcgagataaatatgctggacgagaagctgatcaagtttctggccttgcagagaatacatcagcttttcccctcccgggtccaaccttcaccgggcagtgtcgggacacatcagctggcttctggagggcaccacatagaaggtgcgcatgtacacacctgtcaccacatcatcagatctcccctctacgtgtgcgaatggtcaccttgcctccatggagaatctgagcttccagtatctcaaacctccttgtgtgcttttcatgggcttaataaagcaccatggtttttttctgaagagagcaggaacaagatggcaaccacagctttctga

SEQ ID NO: 1594 - DNA, 3681 bp, Homo sapiens
agtcgccacccagactacatttcccgacaggcctcccggctctcccgccctccctcccgagacacgagccgaactgggcgtcaggtcggggagccggtcgggttcccgctcaccgccgccgccgccgccccctgcagccactctcccgcctctaccgccgcgggagctgcatcgtccactccggtcggcggtggaaccgccagtccggggtcacagagcttgagaagcgacgcgctgagccccccatcacctccagcccgggcgacccctcccgggtccgccctcgccctgcgcagccgcccgagcccccagccccgggcggccccgctccagcatcccagctcctgcactctcgcagccgccgccgccccccgcccggaacatggactctgactcttgcgccgccgccttccacccggaggaatactcccccagttgcaagaggcgcaggaccgtggaagacttcaacaaattctgcacctttgtcttggcctatgctggctacatcccttatccgaaggaggaactccctttaaggagcagccccagccctgctaacagcactgctggtaccattgacagcgacggctgggacgcgggtttctcagacatcgcgtcctcagtgcccttgccagtctctgaccgctgctttagccacctgcagcctactctcttgcagcgagccaagcccagtaacttcctgctggacagaaagaaaacggacaagctgaagaagaagaagaagaggaagcgcagggacagtgatgcgcctgggaaagaggggtacagggggggcttgctgaagctggaagccgctgacccctacgtggagacccccacgagtcccaccttgcaggatatcccccaggctcccagcgacccctgctcgggctgggactccgatactccctcgagtggatcttgtgccactgtgtcacctgatcaggtcaaagaaataaaaactgaaggcaaacggactatcgtccggcagggaaagcaggtggtgttccgagatgaggacagcactggcaatgatgaggacatcatggtggactcagatgacgattcctgggacctcgtgacctgcttctgcatgaagccatttgccggccgccccatgatcgagtgtaatgagtgccacacctggattcacctgtcctgtgcgaaaatccggaaatccaatgttccagaagtgtttgtctgccaaaagtgccgggactccaagtttgacatccgccgttccaaccgctcgcggacgggctcccggaagctgttcctggactgactgctggctggcgaggaggctgcgagcgtggaatcggaagcgaccgcgggcttttttgcccttctcttagttgagcacagaaccctcagctctggtgcgggcagatccctgccatttaggtgcctaagcaaaaggacaggctgtccaaggtagaaactgtacatagccggtgaccgaatgcgacctttgccagccagagctgctgccagagctgcgttccctgcagtggaggtggactggacacccacgtgcagcgggtttggctcatttgaaaatgagggtccgtggtagctgtgcgttttgctatcattgctaagagattcccgctgattgggctcagtgccagctgttattctgcttccactgtgttggggagaggtgttcggtttccccagcctgttaatgaacagccatacgtgtaagctttttcttgagtgttaagtcttttaccaaaagtgtctgtacagcagccatccaagttgcccctacttagtggcttgccctctgcctgcctcagctgctgcctgaccggctgggggaggcactggcgggaggcctcgggctcccctggaagggcgctgggctggcgggtcagctggtggttcttaggtttccttctgtttgttaaaagggacaatgtggccacttctctgtggaaagggagttggttggggggttgagatggcccgtgttcataactcagtttcctgttttgcacgatgtaaaaaccctgtctttttgcacgatacagccaaaagtattggctgatttcttgctgagtgccctcttagttggtgtgtgaggtcttggtgggctcaggccagctgtttgcgagtgtgggaactcataggttctgtctttgtctcttcctttcacctcattctggtagcagcataaaggttaggcaatcactgggacccgcatggtgttcctccaaagaatagggtaaaggagagctgggagggagccctctccgttgggtgactcttgtgtgccctttagacaggctggcctgccggttccacagggtacagttaggacttgagtctttctttttctgttttgagttggtgagtgagtgatagggtaacatgggccttcaggatgaccccttggaactgtgccgagttccttaaatctcagctgggatcctggacctgggaggcccctgtgagggccagctctggaaaaacctgggagttgatgccggaggctgtggaagaactctgctcgagggcagggtgccctggaacactggtagttctggggctgggagggagaggggctccggctttctctgaaatgaacactgctcttcagcagttcaagtacttgttctcaaaacattttctaattgattggtaggttttcataagcattgtttctttaaggcatggaaagggaagaatgctcaagcaagtcatgtttgttttcagtgggatgggcccgcgttctcactgctgggggcttccccttcatgtggcacctttgtgccaggccaccaggcagactcttcccaccttctcccactgaagcaccaaggggcttgaaccgtaatttggctaatcagaggcattttttttgtcctagtatctttcacacttgtccaaccgtcttatttttttaaaagttctgttgcttgtattaacacgaaactagagagaaatagtttctgaagccagtttattgtgaagatccccaagggggaggttcggtagagaaaaatagtaagctggtttagaaactgacgagggcaaacagccaggacgcattggagaggaatttgccaaagatctaccctgagataacgcctgtccagtgtcttcaccacgtgaataaccagcgctccaaagtgtttttctgctttgaaaaaaaaaaattccacaagcttttaaaggtgcatttaagaatccatgtgactttagaatggaactgccggccctggcaactgtcacgtgtgctagaaggttcgatgcctctggaatgcatgtgatactcatctccattttgtttccttgattgcatttttgttcttttagcagatctgtccctgtgggtggtgtctaagaagtcggacaccttggtttttgtgttagattgagctgggcagctgcaatcagcttctttatatgcaaattaggcacgacccatctgtggttcctggttggtggctaatgaagtgaggggagggagggatgtcaccccaaaagtaggccctcccattggctttggccaggccagacacttcacatcgtttacatggttctgtgtaattttaaagtttatgtgtataaagcgaagctgtttctgtgaaactgtatattttgtaaataaatatattgctactttgaggttcatgattcaaggttcaggcgattgcgttctgtgctgaagga

SEQ ID NO: 1595 - DNA, 6463 bp, Homo sapiens
ctctcttgctcgctcgctccctctctctcctgctggctgcctgttctaggaagccagcgcggagaggggggggatgcacagcacaggggagagagattgcgcatgttggtcagtcgtgttttaaagagtacagtgcggggaggctgagaggggcgcatgcaacaacaacttttggaaggatggaagagaagaggcgaaaatactccatcagcagtgacaactctgacaccactgacagtcatgcgacatctacatccgcatcaagatgctccaaactgcccagcagcaccaagtcgggctggccccgacagaacgaaaagaagccctccgaggttttccggacagacttgatcacagccatgaagatcccggactcataccagctcagcccggatgactactacatcctggcagacccatggcgacaggaatgggagaaaggtgtgcaggtgcctgccggggcagaggccatcccagagcccgtggtgaggatcctcccaccactggaaggcccccctgcccaggcatccccgagcagcaccatgcttggtgagggctcccagcctgattggccagggggcagccgctatgacttggacgagattgatgcctactggctggagctcatcaactcggagcttaaggagatggagaggccggagctggacgagctgacattagagcgtgtgctggaggagctggagaccctgtgccaccagaatatggccagggccattgagacgcaggaggggctgggcatcgagtacgacgaggatgttgtctgcgacgtgtgtcgctctcctgagggcgaggatggcaacgagatggtcttctgtgacaagtgcaacgtctgtgtgcatcaggcatgctacgggatcctcaaggtgcccacgggcagctggctgtgccggacgtgtgccctgggtgtccagccaaagtgcctgctctgccccaagcgaggaggagccttgaagcccactagaagtgggaccaagtgggtgcatgtcagctgtgccctatggattcctgaggtcagcatcggctgcccagagaagatggagcccatcaccaagatctcgcatatcccagccagccgctgggctctgtcctgcagcctctgcaaggaatgcacaggcacctgcatccagtgttccatgccttcctgcgtcacagcgttccatgtcacatgcgcctttgaccacggcctggaaatgcggactatattagcagacaacgatgaggtcaagttcaagtcattctgccaggagcacagtgacgggggcccacgtaatgagcccacatctgagcccacggaacccagccaggctggcgaggacctggaaaaggtgaccctgcgcaagcagcggctgcagcagctagaggaggacttctacgagctggtggagccggctgaggtggctgagcggctggacctggctgaggcactggtcgacttcatctaccagtactggaagctgaagaggaaagccaatgccaaccagccgctgctgacccccaagaccgacgaggtggacaacctggcccagcaggagcaggacgtcctctaccgccgcctgaagctcttcacccatctgcggcaggacctagagagggttagaaatctgtgctacatggtgacaaggcgcgagagaacgaaacacgccatctgcaaactccaggagcagatattccacctgcagatgaaacttattgaacaggatctgtgtcgaggcctgtccacctcattccccatcgatggcaccttcttcaacagctggctggcacagtcggtgcagatcacagcagagaacatggccatgagcgagtggccactgaacaatgggcaccgcgaggaccctgctccagggctgctgtcagaggaactgctgcaggacgaggagacactgctcagcttcatgcgggacccctcgctgcgacctggtgaccctgctaggaaggcccgaggccgcacccgcctgcctgccaagaagaaaccaccaccaccaccaccgcaggacgggcctggttcacggacgactccagacaaagcccccaagaagacctggggccaggatgcaggcagtggcaaggggggtcaagggccacctaccaggaagccaccacgtcggacatcttctcacttgccgtccagccctgcagccggggactgtcccatcctagccacccctgaaagccccccgccactggcccctgagaccccggacgaggcagcctcagtagctgctgactcagatgtccaagtgcctggccctgcagcaagccctaagcctttgggccggctccggccaccccgcgagagcaaggtaacccggagattgccgggtgccaggcctgatgctgggatgggaccaccttcagctgtggctgagaggcccaaggtcagcctgcattttgacactgagactgatggctacttctctgatggggagatgagcgactcagatgtagaggccgaggacggtggggtgcagcggggtccccgggaggcaggggcagaggaggtggtccgcatgggcgtactggcctcctaactcacccccttccctgtcccaggccctgccctggtccccccacaaggcctcagcccagtcacaactgccatttccagtctctgctgagtgtcccagaccctcgaggctgccactccgtcgtggttttatttttaatatagagagagttttgaattctacactgttgtctttcctctgtgctggcctaggacattaggattccttccacggctccggccgctaggaccctgccaggtcccgcgcaccatccctgccctgcccacgtggtattgctgggctcctggctagatgcaagcaaggtggacaagagctcaggactccagcccactgccactgggtgacacagactgtcgtttgggcattatttcatggcagatgggccagtccagggcctaccccgccttgcccccagatcccactggggtccatttggggggtcctgctacactccaccgatccccaaggaagtataataaacgatacccagccagagtctactcactgtcacaagcacaacgagtttatatgagaaagcactgagggggtgcagagggcccgctagttccaggggaactgaaagctgttcctgatcagcccgtatcatctgaggcctgcctgcccaccctgccaccctcccctcccttgctgctctgcccctgccagtgcccagcccagcggctctgggaaggggttcccagaatccctcctgagctgtgccatttactcaggggactcccaaacagccagctgccagtgcaggtggagggctgtaggggagggccagtgcccagacagggtcatggggctcagaccagcccactgtagagaatcactctgaggctccaacttccttccttccttcggggccagtctcggccgaagtctggtcacgctcagacagagctgaccagaccagaccgtttgccttttcaagtttcctagtcctgctacaagatgagcttcttccgtggtttccttttggaaactcctccttccaacaagcagtgggatcccggggcccagggcgggccggtgttggccgctggggctgttgtaagtcttgctggatgttcccctgttcctgagccttaacccctcgcacagccatccccccccccgtcctgccatccccccccgccgtcctgccttccccaccccacccttaggtcccaggtagttgctctgaagagtttcagtagagtggccccagggtgatagctcagggaacaacaaaaaaggaattccgtgaaaacatttttttttctttgatgaattactcctgggtcacttccaccactggtaaagccagaacttctccaaaaagaaccttgcaaaaagtccagtgaatcagtcgaatcattctgtggatgccaaagaatattttgaccataatacagcacagcctggacctgacaacttgtcatttggacttttttttaaatggagttctttagcaacaaagtatagaaacatgttcattgcacacacccaaggagaagagctcaagcgcttggaagaggatgctttgctgctgctgaagtgtacctgggtgttagatttcagatcctgggctgagcccactgtgagctttcctaaactgtgagactcacagaggggaaagatactgacggtgaaaccagcatggaaaacgtctttaccatgtggttccctcctccccaaatacataaagcaaataagcaggatggggaacagcttgaccttcatccacccctaactccaaaactatcaaggtacgacagtggcattgtcatcgacactcaatttcatgtgaattttagcaaaacaggaaacaaagataatgactcagttcagaggatcggacaaatgtgtctagtccgggtggactcggagggagtggggtgggcttcaaggattctgggcgttgggatggcatgagctaccctgtagagtttagtctgcctgcccgccttggtagtagtgaccagtcagtgtcagcatcagtgtcccaaccccagtctctgtttactgcctttgaacagaacttcttccttccccatgctttgggtcacctcgggctgcaaccctgtctgtgccagattgcccggtctgaccctgcaggaagcaaagaggtgagcttaaagaacaaccaaactctgccaggggtcccagaaagcccagggtccagcagtctcagcacttggccccttgccccttcacaccatcctggggcaggggctgggcctccctggtggcaggggtgggtggagaattagggagagggtgcaacgagtctggccccttgcctcgggctggctggtgttcttccaagagcctctgctcacattgttggcctctggattctggcccttcttcattggctgttgctttggactggactgttgctgagcctgtgtcctgcagaacccagatgtctgttaggctggctggctgctgcgaggggaggggggtggcctttcatttggggtgccctttcactcccaggccaagccctggagcaatcttcttcaggcagctgtctccacctccaggatgtccagcaggctgcaaggagaaggatgccagccacccatcctcccccagttcccagcctttcccctgttggtcacagccgcttctgtctttttccggtctactgtccccagtgtagagggctttgctgtccctgagactgaggcaggttccttttccaggtcagaggtggaggtagatctttctctcaaccacatctgcctccacacacagctcctccgcagggaaggagaagctgctctgtaactcattctggctatcgtcccccttctcactgacctgaccgcccaccacctccttccccctcatcacatgacaaaggataatgtgcaagaaaagtatttttatgtatcataaatgtattttgaaacaaatgagaagaagaaaggtagaagggtttattttattaaatgagcctgacttagtgacagtgtgtgagcatttgcaatgtaagggcctcagcttccttggagaagccaccccaggtttccagacatagatgttgaattgtttgtggggggtgtgccaggccacgtctcgtgtgtccgtatgcaggcatgcctgtgtatactgtgtatgggcacactgggactagctgggacaattcctagagattcaactgcccaattctaaccaacattggcagcggctgaacttggcatttccttgctaactgccagatgtggccaacctttgtccatatgcaaaccactgaaaaatgatctggatttctatagcaaggcccttggggagggcactctcccatgcccttggcctcgctggccacattggccaatgagccagggctggagtctgagacctttggttgttctttaaggcacctcctgccactttctccctcagaggcacaaacactttgtgttccacgtcagtttgaggggacggtggggggatgatatgaatgtcacaggaggagacaccttctgtctttgtttcaaagaaagtgatgtgccatttgttaatatacaagagaaatattgaaaatatattgaaaagagcaattttaaattatttttggcttatgttgcaatatttattttcttgtattagaaaagattcctttgtagagaaaaaatgtatttttcattaacgcaaagacctatttctcctttttgtacattgtccatgtgcgcaacccttaacgagcaatagaatgtatggtcacctgggtgtggccagtgcccgctgtgccctgcatgattctgtgttgccgctgctgcatagttcccagccccatcctgtcctgctcactcatgggggcttccagaccccggccccaccagggcttgtgtcatagggagccctttgcactcctcgtgtgttggcaaacgcagttaataaagcagtgttttctgtgc

SEQ ID NO: 1596 - DNA, 2482 bp, Homo sapiens
aggctcttcttccagaaactgcgaggatccgagcgtactgtttgtgcaccacaagatggaagagaagaggcgaaaatactccatcagcagtgacaactctgacaccactgacagtcatgcgacatctacatccgcatcaagatgctccaaactgcccagcagcaccaagtcgggctggccccgacagaacgaaaagaagccctccgaggttttccggacagacttgatcacagccatgaagatcccggactcataccagctcagcccggatgactactacatcctggcagacccatggcgacaggaatgggagaaaggtgtgcaggtgcctgccggggcagaggccatcccagagcccgtggtgaggatcctcccaccactggaaggcccccctgcccaggcatccccgagcagcaccatgcttggtgagggctcccagcctgattggccagggggcagccgctatgacttggacgagattgatgcctactggctggagctcatcaactcggagcttaaggagatggagaggccggagctggacgagctgacattagagcgtgtgctggaggagctggagaccctgtgccaccagaatatggccagggccattgagacgcaggaggggctgggcatcgagtacgacgaggatgttgtctgcgacgtgtgtcgctctcctgagggcgaggatggcaacgagatggtcttctgtgacaagtgcaacgtctgtgtgcatcaggcatgctacgggatcctcaaggtgcccacgggcagctggctgtgccggacgtgtgccctgggtgtccagccaaagtgcctgctctgccccaagcgaggaggagccttgaagcccactagaagtgggaccaagtgggtgcatgtcagctgtgccctatggattcctgaggtcagcatcggctgcccagagaagatggagcccatcaccaagatctcgcatatcccagccagccgctgggctctgtcctgcagcctctgcaaggaatgcacaggcacctgcatccagtgttccatgccttcctgcgtcacagcgttccatgtcacatgcgcctttgaccacggcctggaaatgcggactatattagcagacaacgatgaggtcaagttcaagtcattctgccaggagcacagtgacgggggcccacgtaatgagcccacatctgagcccacggaacccagccaggctggcgaggacctggaaaaggtgaccctgcgcaagcagcggctgcagcagctagaggaggacttctacgagctggtggagccggctgaggtggctgagcggctggacctggctgaggcactggtcgacttcatctaccagtactggaagctgaagaggaaagccaatgccaaccagccgctgctgacccccaagaccgacgaggtggacaacctggcccagcaggagcaggacgtcctctaccgccgcctgaagctcttcacccatctgcggcaggacctagagagggttagaaatctgtgctacatggtgacaaggcgcgagagaacgaaacacgccatctgcaaactccaggagcagatattccacctgcagatgaaacttattgaacaggatctgtgtcgagagcggtctgggaggagagcaaagggcaagaagagtgactcgaagaggaagggctgcgagggctccaagggcagcactgagaagaaagagaaagtgaaggcggggcctgactcagtcctggggcagctggcaggcctgtccacctcattccccatcgatggcaccttcttcaacagctggctggcacagtcggtgcagatcacagcagagaacatggccatgagcgagtggccactgaacaatgggcaccgcgaggaccctgctccagggctgctgtcagaggaactgctgcaggacgaggagacactgctcagcttcatgcgggacccctcgctgcgacctggtgaccctgctaggaaggcccgaggccgcacccgcctgcctgccaagaagaaaccaccacgtcggacatcttctcacttgccgtccagccctgcagccggggactgtcccatcctagccacccctgaaagccccccgccactggcccctgagaccccggacgaggcagcctcagtagctgctgactcagatgtccaagtgcctggccctgcagcaagccctaagcctttgggccggctccggccaccccgcgagagcaaggtaacccggagattgccgggtgccaggcctgatgctgggatgggaccaccttcagctgtggctgagaggcccaaggtcagcctgcattttgacactgagactgatggctacttctctgatggggagatgagcgactcagatgtagaggccgaggacggtggggtgcagcggggtccccgggaggcaggggcagaggaggtggtccgcatgggcgtactggcctcctaactcacccccttccctgtcccaggccctgccctggtccccccacaa

SEQ ID NO: 1597 - DNA, 887 bp, Homo sapiens
cccctctcccggcccggtgcacgcgggcgctgcacgcgggggcagcatgctcggctcctggggttggaggctctgcacaaattagacagtttttttggaggggcgggggacaccctttccagatggaagagaagaggcgaaaatactccatcagcagtgacaactctgacaccactgacagtcatgcgacatctacatccgcatcaagatgctccaaactgcccagcagcaccaagtcgggctggccccgacagaacgaaaagaagccctccgaggttttccggacagacttgatcacagccatgaagatcccggactcataccagctcagcccggatgactactacatcctggcagacccatggcgacaggaatgggagaaaggtgtgcaggtgcctgccggggcagaggccatcccagagcccgtggtgaggatcctcccaccactggaaggcccccctgcccaggcatccccgagcagcaccatgcttggtgagggctcccagcctgattggccagggggcagccgctatgacttggacgagattgatgcctactggctggagctcatcaactcggagcttaaggagatggagaggccggagctggacgagctgacattagagcgtgtgctggaggagctggagaccctgtgccaccagaatatggccagggccattgagacgcaggaggggctgggcatcgagtacgacgaggatgttgtctgcgacgtgtgtcgctctcctgagggcgaggatggcaacgagatggtcttctgtgacaagtgcaacgtctgtgtgcatcaggcatgctacgggatcctcaaggtgcccacgggcagctggctgtgccggacgtgtgccctgggtgtccagccaaagtgcctg

SEQ ID NO: 1598 - DNA, 2784 bp, Homo sapiens
atacacagggggttggtgaatggtgccgaccgcggccatcgcagttggaggctattttttggggggggtgagtagcgtccatggagttactttgcgcccactcctagcggcaccggcttaggtcctgcgggccgaccccctcccgcgccggccccaggagctcccggcttcgggagcatccttcccgcgccggtccctgcagcggcgcgtagccgagggcagcgcccgtcaggggggcaccgcggagcaagatggaagagaagaggcgaaaatactccatcagcagtgacaactctgacaccactgacagtcatgcgacatctacatccgcatcaagatgctccaaactgcccagcagcaccaagtcgggctggccccgacagaacgaaaagaagccctccgaggttttccggacagacttgatcacagccatgaagatcccggactcataccagctcagcccggatgactactacatcctggcagacccatggcgacaggaatgggagaaaggtgtgcaggtgcctgccggggcagaggccatcccagagcccgtggtgaggatcctcccaccactggaaggcccccctgcccaggcatccccgagcagcaccatgcttggtgagggctcccagcctgattggccagggggcagccgctatgacttggacgagattgatgcctactggctggagctcatcaactcggagcttaaggagatggagaggccggagctggacgagctgacattagagcgtgtgctggaggagctggagaccctgtgccaccagaatatggccagggccattgagacgcaggaggggctgggcatcgagtacgacgaggatgttgtctgcgacgtgtgtcgctctcctgagggcgaggatggcaacgagatggtcttctgtgacaagtgcaacgtctgtgtgcatcaggcatgctacgggatcctcaaggtgcccacgggcagctggctgtgccggacgtgtgccctgggtgtccagccaaagtgcctgctctgccccaagcgaggaggagccttgaagcccactagaagtgggaccaagtgggtgcatgtcagctgtgccctatggattcctgaggtcagcatcggctgcccagagaagatggagcccatcaccaagatctcgcatatcccagccagccgctgggctctgtcctgcagcctctgcaaggaatgcacaggcacctgcatccagtgttccatgccttcctgcgtcacagcgttccatgtcacatgcgcctttgaccacggcctggaaatgcggactatattagcagacaacgatgaggtcaagttcaagtcattctgccaggagcacagtgacgggggcccacgtaatgagcccacatctgagcccacggaacccagccaggctggcgaggacctggaaaaggtgaccctgcgcaagcagcggctgcagcagctagaggaggacttctacgagctggtggagccggctgaggtggctgagcggctggacctggctgaggcactggtcgacttcatctaccagtactggaagctgaagaggaaagccaatgccaaccagccgctgctgacccccaagaccgacgaggtggacaacctggcccagcaggagcaggacgtcctctaccgccgcctgaagctcttcacccatctgcggcaggacctagagagggttagaaatctgtgctacatggtgacaaggcgcgagagaacgaaacacgccatctgcaaactccaggagcagatattccacctgcagatgaaacttattgaacaggatctgtgtcgagcaggcctgtccacctcattccccatcgatggcaccttcttcaacagctggctggcacagtcggtgcagatcacagcagagaacatggccatgagcgagtggccactgaacaatgggcaccgcgaggaccctgctccagggctgctgtcagaggaactgctgcaggacgaggagacactgctcagcttcatgcgggacccctcgctgcgacctggtgaccctgctaggaaggcccgaggccgcacccgcctgcctgccaagaagaaaccaccaccaccaccaccgcaggacgggcctggttcacggacgactccagacaaagcccccaagaagacctggggccaggatgcaggcagtggcaaggggggtcaagggccacctaccaggaagccaccacgtcggacatcttctcacttgccgtccagccctgcagccggggactgtcccatcctagccacccctgaaagccccccgccactggcccctgagaccccggacgaggcagcctcagtagctgctgactcagatgtccaagtgcctggccctgcagcaagccctaagcctttgggccggctccggccaccccgcgagagcaaggtaacccggagattgccgggtgccaggcctgatgctgggatgggaccaccttcagctgtggctgagaggcccaaggtcagcctgcattttgacactgagactgatggctacttctctgatggggagatgagcgactcagatgtagaggccgaggacggtggggtgcagcggggtccccgggaggcaggggcagaggaggtggtccgcatgggcgtactggcctcctaactcacccccttccctgtcccaggccctgccctggtccccccacaaggcctcagcccagtcacaactgccatttccagtctctgctgagtgtcccagaccctcgaggctgccactccgtcgtggttttatttttaatatagagagagttttgaattct

SEQ ID NO: 1599 - DNA, 2750 bp, Homo sapiens
ggtttaaaaagaaacagaaacatacacagggggttggtgaatggtgccgaccgcggccatcgcagttggaggctattttttgggggggatggaagagaagaggcgaaaatactccatcagcagtgacaactctgacaccactgacagtcatgcgacatctacatccgcatcaagatgctccaaactgcccagcagcaccaagtcgggctggccccgacagaacgaaaagaagccctccgaggttttccggacagacttgatcacagccatgaagatcccggactcataccagctcagcccggatgactactacatcctggcagacccatggcgacaggaatgggagaaaggtgtgcaggtgcctgccggggcagaggccatcccagagcccgtggtgaggatcctcccaccactggaaggcccccctgcccaggcatccccgagcagcaccatgcttggtgagggctcccagcctgattggccagggggcagccgctatgacttggacgagattgatgcctactggctggagctcatcaactcggagcttaaggagatggagaggccggagctggacgagctgacattagagcgtgtgctggaggagctggagaccctgtgccaccagaatatggccagggccattgagacgcaggaggggctgggcatcgagtacgacgaggatgttgtctgcgacgtgtgtcgctctcctgagggcgaggatggcaacgagatggtcttctgtgacaagtgcaacgtctgtgtgcatcaggcatgctacgggatcctcaaggtgcccacgggcagctggctgtgccggacgtgtgccctgggtgtccagccaaagtgcctgctctgccccaagcgaggaggagccttgaagcccactagaagtgggaccaagtgggtgcatgtcagctgtgccctatggattcctgaggtcagcatcggctgcccagagaagatggagcccatcaccaagatctcgcatatcccagccagccgctgggctctgtcctgcagcctctgcaaggaatgcacaggcacctgcatccagtgttccatgccttcctgcgtcacagcgttccatgtcacatgcgcctttgaccacggcctggaaatgcggactatattagcagacaacgatgaggtcaagttcaagtcattctgccaggagcacagtgacgggggcccacgtaatgagcccacatctgagcccacggaacccagccaggctggcgaggacctggaaaaggtgaccctgcgcaagcagcggctgcagcagctagaggaggacttctacgagctggtggagccggctgaggtggctgagcggctggacctggctgaggcactggtcgacttcatctaccagtactggaagctgaagaggaaagccaatgccaaccagccgctgctgacccccaagaccgacgaggtggacaacctggcccagcaggagcaggacgtcctctaccgccgcctgaagctcttcacccatctgcggcaggacctagagagggttagaaatctgtgctacatggtgacaaggcgcgagagaacgaaacacgccatctgcaaactccaggagcagatattccacctgcagatgaaacttattgaacaggatctgtgtcgagagcggtctgggaggagagcaaagggcaagaagagtgactcgaagaggaagggctgcgagggctccaagggcagcactgagaagaaagagaaagtgaaggcggggcctgactcagtcctggggcagctggcaggcctgtccacctcattccccatcgatggcaccttcttcaacagctggctggcacagtcggtgcagatcacagcagagaacatggccatgagcgagtggccactgaacaatgggcaccgcgaggaccctgctccagggctgctgtcagaggaactgctgcaggacgaggagacactgctcagcttcatgcgggacccctcgctgcgacctggtgaccctgctaggaaggcccgaggccgcacccgcctgcctgccaagaagaaaccaccaccaccaccaccgcaggacgggcctggttcacggacgactccagacaaagcccccaagaagacctggggccaggatgcaggcagtggcaaggggggtcaagggccacctaccaggaagccaccacgtcggacatcttctcacttgccgtccagccctgcagccggggactgtcccatcctagccacccctgaaagccccccgccactggcccctgagaccccggacgaggcagcctcagtagctgctgactcagatgtccaagtgcctggccctgcagcaagccctaagcctttgggccggctccggccaccccgcgagagcaaggtaacccggagattgccgggtgccaggcctgatgctgggatgggaccaccttcagctgtggctgagaggcccaaggtcagcctgcattttgacactgagactgatggctacttctctgatggggagatgagcgactcagatgtagaggccgaggacggtggggtgcagcggggtccccgggaggcaggggcagaggaggtggtccgcatgggcgtactggcctcctaactcacccccttccctgtcccaggccctgccctggtccccccacaaggcctcagcccagtcacaactgccatttccagtctctgctgagtgtcccagaccctcgaggctgccactccgtcgtggttttatttttaatatagagagagttttgaattct

SEQ ID NO: 1600 - DNA, 567 bp, Homo sapiens
aacagacccaaggccccgccaccgccggctagcagcccgacagcccgcccgcctggcgagcgcaggctcttcttccagaaactgcgaggatccgagcgtactgtttgtgcaccacaagatggaagagaagaggcgaaaatactccatcagcagtgacaactctgacaccactgacagtcatgcgacatctacatccgcatcaagatgctccaaactgcccagcagcaccaagtcgggctggccccgacagaacgaaaagaagccctccgaggttttccggacagacttgatcacagccatgaagatcccggactcataccagctcagcccggatgactactacatcctggcagacccatggcgacaggaatgggagaaaggtgtgcaggtgcctgccggggcagaggccatcccagagcccgtggtgaggatcctcccaccactggaaggcccccctgcccaggcatccccgagcagcaccatgcttggtgagggctcccagcctgattggccagggggcagccgctatgacttggacgagattgatgcctactggctggagctcat

SEQ ID NO: 1601 - DNA, 4931 bp, Homo sapiens
atacaatagtgctccgcgccgcctcagccgccgccgccgcccaaccgcctgcccagcgctgaggcctgacgggccgggcggacgagggccgagggcgggagctgaggcgcggggggcggccccggcggggggcgggggcgaggaggggattaaggggcaggtgcgagggagggaagagaagaaagcgagcggttaggggggcggttaccactccgaccggactcacccggcacattgccgggccgcggcgtggagccgggcaggagccgcgagccagctgcgcgaaggatgctccaggatgaaacgccataggcctgtcagcagcagtgacagttcagacgaaagtccttccacttcctttacttctggctcaatgtataggatcaagtcaaaaattccaaatgaacacaagaaacctgctgaggtattccggaaggacctcatcagtgccatgaaacttccagattctcaccacattaatcctgatagctattacctctttgctgatacatggaaggaagaatgggaaaagggagtccaggtaccagccagtccagacaccgttccacagccttctctcaggattatagctgagaaggtaaaggacgttctgtttatccgaccccggaagtatattcactgctccagcccagacaccacagagcctggctacatcaacatcatggagttggcagcatctgtttgccgctatgacctagatgacatggacatcttctggcttcaggaactcaatgaagaccttgcagaaatgggttgtgggccagttgatgagaatcttatggaaaagacagtagaagtcctggaacgccattgccatgaaaatatgaaccatgctattgagacagaggaagggctaggcatagagtatgatgaagatgtgatctgtgatgtgtgccggtctccagacagtgaagaagggaatgatatggtgttctgtgataagtgtaacgtctgtgtgcatcaggcctgctatggcatcctcaaggtcccagaaggcagctggctgtgtcgctcctgtgtcctgggcatttatccgcaatgtgtgttatgtccaaagaaaggtggagccctgaagaccaccaagacagggactaaatgggctcatgtcagctgtgccctgtggatcccagaggtcagcattgcttgtcctgagaggatggaaccgatcacgaagatctcccacatcccacccagtcggtgggccttagtctgcaacttgtgcaagttgaagacgggggcttgtattcagtgctctataaaaagctgcatcactgccttccacgtcacctgtgcctttgagcacggcctagagatgaagaccatcctagatgagggagacgaagtgaagttcaagtcatattgcctcaagcatagccaaaacaggcagaaacttggagaagctgagtacccccaccacagggctaaagagcagagccaggccaaaagtgagaaaaccagcctgcgggcacagaagcttcgggagctggaggaggagttctattccttggtacgagtggaagatgtggccgcagagctgggtatgcccacgctagctgtggactttatctataactactggaaactgaagcggaaaagtaacttcaataagccattatttcctccaaaggaggatgaagaaaatgggctggtgcagccaaaagaggaaagcattcacactcgaatgagaatgtttatgcatctacgccaggacctggagagggtccgaaatctgtgctatatgataagcagacgagagaagctgaagctgtcacacaacaaaatacaggaacagatcttcggtttgcaagtccagcttcttaaccaagaaattgatgcagggcttcctttgacaaatgcacttgaaaactcactgttttacccaccaccaagaattaccttgaagttaaaaatgcccaaatcaaccccagaagaccacagaaacagctccacagaaaccgatcagcagccccactctcctgacagcagctcatctgttcacagtataaggaacatgcaggtgcctcaggagtcactagaaatgagaacaaaatcgtatccgagatacccactagagagcaagaataaccgtttgctggccagtctcagccattctaggagtgaagcaaaggagtccagtcctgcttggagaaccccgtcctcggagtgctatcatgggcagtcactgggaaagcctctggtccttcaggctgccctccatggacagtcttccattgggaatgggaaaagtcagcctaactccaagtttgccaaatccaatggcctggagggcagctggtctgggaatgtcacccaaaaagacagctcgagtgagatgttctgtgaccaggagcctgtgttcagcccccacttggtcagtcagggcagctttagaaaatccactgtagaacactttagtaggtcctttaaagagaccaccaataggtgggtgaagaacacagaggacctccagtgctatgtgaagccaaccaagaatatgagccccaaggagcagttctggggtagacaggttctcaggcggtctgcagggagagctccatatcaggaaaatgatggctattgcccagatttggagctgagtgattcagaggcagaaagtgatgggaataaagaaaaagtcagggtaaggaaagatagctcagacagggaaaatcctccccatgactctagacgggattgccatggtaaaagcaagacacatcccctttcccacagttcaatgcaaaggtgattagaaacttccaaggatgacccaacctttgcctttgccccatatattggggaaaacccatacaccaaaaggattttagcatatgttaagaggaattgcagtgaaaaggataacatttttccatagtaaattgtcttgcagtttttgaaaatgtttcaagtctagtttttacaagcacattacagtaattgcaggttgtccagaggttggtttgtcagaggctattgggaacagctgggcccagggtatttgctcagtaaatattttggggcagctttccggttatataacacattgacaagtatatgtattaagagtccttgcattgttaactgatttgcaagagaccatgattatcagacactaaaactacttatcttttgaagctacagcatgtgactccccagagctcctgtctgtaggaagtttctaattccctggtatctataaacccttttcaggggagagaccggagaccccatcttagatactgtcaactcactactgtcttcctttgttctgcacaaggttgagtttctttcacagtatcttaacttactgagtcaatactcctcatgcttatcagtgtccagtgcctgttcctaaacttgcttgttggggacacactcataactatttcacctgactgacaagcataaaaggctaacttgtggatagtgtttacaaaagtacaaaagtactacttccaaggaaaatgctctgattctctgtttaggcatttgtgaaggattccagagcctttcccaaagtgagaccatttctggggtatttgtaccaggtcagggtttttgtgttgttttcaaataagtttgactaaaataagtttggctgacagtttttgtatacctgctttaatgtttataaaatttttattgaggtataattaaaatatagtaaaatgcacagaggttaagtattcttacctgctttaattttgaaacagatttttattgtcaaacagaatttgaaagcatgtgtttaacacatggatataatttagctttgtgtcacctttgaatctgaggcagtttcccaaacaaaaaggctggagccatttttcagaagttgcttataccctgttcccaaactatcagccttgattaatttctagtaggaagagaataattacatttgcgggggggggggtggataaaaaacatgtctgcttctcatttaaataagagagaaatgatgccgttttttaaatgtgaagcagactataattctcagctctcttttcttcttagccttaaattaatattctctttcttctagttttggaaagtgtagtgggaatattcagacaaaagaggccattttccatttttaaagcttcttactggtgaaacagcccagttgtagtaggtgccagtcagtcaaggcaggggccctctctccgtcaatatggaaaactcagcagttttcctctcccccagttgtgttcttgtaacgttgttaatgggttcctttgctttttgctttctccttttctgaaaatgtatgtgttttgcctctcttttggctacatcttcaaaatatttcttttgtgcctatgtacatgtgtaaacatgccatagcatgtgtggtaggtgtcctgtattttgtttgggaaaaaaactatcaaaatgaggaagagaatttcccctatttatgcactaggtttctgtgctttttctttgagttctctggagtagatattaatttgataccttcatggtaatgaaattatgatggagctgtgttataaattccttatgtcagaggccagtgcggtagcctttgtcccttcatgcctttcaattctgagtgggaggaaaagcaaacatcaaaacagtgcttcagccaaattccatatgtaatgccattgggagagtattgactaaaatatcattcgtcagggaaatatagttgtaatatttttacaggatattcctaggtaaatgaaggagccttcagttgtaaatttcaattaccccaaaatgtatttgctacattttgttgtttgaagtattacctcttaaccttctttgttaatttttttcattttgtcttatatagtccagttttccaagataagctcagtcctttttcaaatgtcccctttttaccaatactttttcattaaattatgaaaactgct

SEQ ID NO: 1602 - DNA, 4685 bp, Homo sapiens
agaagaacgcgcggcgggcagacggctgggagccgctccggatgctccaggatgaaacgccataggcctgtcagcagcagtgacagttcagacgaaagtccttccacttcctttacttctggctcaatgtataggatcaagtcaaaaattccaaatgaacacaagaaacctgctgaggtattccggaaggacctcatcagtgccatgaaacttccagattctcaccacattaatcctgatagctattacctctttgctgatacatggaaggaagaatgggaaaagggagtccaggtaccagccagtccagacaccgttccacagccttctctcaggattatagctgagaaggtaaaggacgttctgtttatccgaccccggaagtatattcactgctccagcccagacaccacagagcctggctacatcaacatcatggagttggcagcatctgtttgccgctatgacctagatgacatggacatcttctggcttcaggaactcaatgaagaccttgcagaaatgggttgtgggccagttgatgagaatcttatggaaaagacagtagaagtcctggaacgccattgccatgaaaatatgaaccatgctattgagacagaggaagggctaggcatagagtatgatgaagatgtgatctgtgatgtgtgccggtctccagacagtgaagaagggaatgatatggtgttctgtgataagtgtaacgtctgtgtgcatcaggcctgctatggcatcctcaaggtcccagaaggcagctggctgtgtcgctcctgtgtcctgggcatttatccgcaatgtgtgttatgtccaaagaaaggtggagccctgaagaccaccaagacagggactaaatgggctcatgtcagctgtgccctgtggatcccagaggtcagcattgcttgtcctgagaggatggaaccgatcacgaagatctcccacatcccacccagtcggtgggccttagtctgcaacttgtgcaagttgaagacgggggcttgtattcagtgctctataaaaagctgcatcactgccttccacgtcacctgtgcctttgagcacggcctagagatgaagaccatcctagatgagggagacgaagtgaagttcaagtcatattgcctcaagcatagccaaaacaggcagaaacttggagaagctgagtacccccaccacagggctaaagagcagagccaggccaaaagtgagaaaaccagcctgcgggcacagaagcttcgggagctggaggaggagttctattccttggtacgagtggaagatgtggccgcagagctgggtatgcccacgctagctgtggactttatctataactactggaaactgaagcggaaaagtaacttcaataagccattatttcctccaaaggaggatgaagaaaatgggctggtgcagccaaaagaggaaagcattcacactcgaatgagaatgtttatgcatctacgccaggacctggagagggtccgaaatctgtgctatatgataagcagacgagagaagctgaagctgtcacacaacaaaatacaggaacagatcttcggtttgcaagtccagcttcttaaccaagaaattgatgcagggcttcctttgacaaatgcacttgaaaactcactgttttacccaccaccaagaattaccttgaagttaaaaatgcccaaatcaaccccagaagaccacagaaacagctccacagaaaccgatcagcagccccactctcctgacagcagctcatctgttcacagtataaggaacatgcaggtgcctcaggagtcactagaaatgagaacaaaatcgtatccgagatacccactagagagcaagaataaccgtttgctggccagtctcagccattctaggagtgaagcaaaggagtccagtcctgcttggagaaccccgtcctcggagtgctatcatgggcagtcactgggaaagcctctggtccttcaggctgccctccatggacagtcttccattgggaatgggaaaagtcagcctaactccaagtttgccaaatccaatggcctggagggcagctggtctgggaatgtcacccaaaaagacagctcgagtgagatgttctgtgaccaggagcctgtgttcagcccccacttggtcagtcagggcagctttagaaaatccactgtagaacactttagtaggtcctttaaagagaccaccaataggtgggtgaagaacacagaggacctccagtgctatgtgaagccaaccaagaatatgagccccaaggagcagttctggggtagacaggttctcaggcggtctgcagggagagctccatatcaggaaaatgatggctattgcccagatttggagctgagtgattcagaggcagaaagtgatgggaataaagaaaaagtcagggtaaggaaagatagctcagacagggaaaatcctccccatgactctagacgggattgccatggtaaaagcaagacacatcccctttcccacagttcaatgcaaaggtgattagaaacttccaaggatgacccaacctttgcctttgccccatatattggggaaaacccatacaccaaaaggattttagcatatgttaagaggaattgcagtgaaaaggataacatttttccatagtaaattgtcttgcagtttttgaaaatgtttcaagtctagtttttacaagcacattacagtaattgcaggttgtccagaggttggtttgtcagaggctattgggaacagctgggcccagggtatttgctcagtaaatattttggggcagctttccggttatataacacattgacaagtatatgtattaagagtccttgcattgttaactgatttgcaagagaccatgattatcagacactaaaactacttatcttttgaagctacagcatgtgactccccagagctcctgtctgtaggaagtttctaattccctggtatctataaacccttttcaggggagagaccggagaccccatcttagatactgtcaactcactactgtcttcctttgttctgcacaaggttgagtttctttcacagtatcttaacttactgagtcaatactcctcatgcttatcagtgtccagtgcctgttcctaaacttgcttgttggggacacactcataactatttcacctgactgacaagcataaaaggctaacttgtggatagtgtttacaaaagtacaaaagtactacttccaaggaaaatgctctgattctctgtttaggcatttgtgaaggattccagagcctttcccaaagtgagaccatttctggggtatttgtaccaggtcagggtttttgtgttgttttcaaataagtttgactaaaataagtttggctgacagtttttgtatacctgctttaatgtttataaaatttttattgaggtataattaaaatatagtaaaatgcacagaggttaagtattcttacctgctttaattttgaaacagatttttattgtcaaacagaatttgaaagcatgtgtttaacacatggatataatttagctttgtgtcacctttgaatctgaggcagtttcccaaacaaaaaggctggagccatttttcagaagttgcttataccctgttcccaaactatcagccttgattaatttctagtaggaagagaataattacatttgcgggggggggggtggataaaaaacatgtctgcttctcatttaaataagagagaaatgatgccgttttttaaatgtgaagcagactataattctcagctctcttttcttcttagccttaaattaatattctctttcttctagttttggaaagtgtagtgggaatattcagacaaaagaggccattttccatttttaaagcttcttactggtgaaacagcccagttgtagtaggtgccagtcagtcaaggcaggggccctctctccgtcaatatggaaaactcagcagttttcctctcccccagttgtgttcttgtaacgttgttaatgggttcctttgctttttgctttctccttttctgaaaatgtatgtgttttgcctctcttttggctacatcttcaaaatatttcttttgtgcctatgtacatgtgtaaacatgccatagcatgtgtggtaggtgtcctgtattttgtttgggaaaaaaactatcaaaatgaggaagagaatttcccctatttatgcactaggtttctgtgctttttctttgagttctctggagtagatattaatttgataccttcatggtaatgaaattatgatggagctgtgttataaattccttatgtcagaggccagtgcggtagcctttgtcccttcatgcctttcaattctgagtgggaggaaaagcaaacatcaaaacagtgcttcagccaaattccatatgtaatgccattgggagagtattgactaaaatatcattcgtcagggaaatatagttgtaatatttttacaggatattcctaggtaaatgaaggagccttcagttgtaaatttcaattaccccaaaatgtatttgctacattttgttgtttgaagtattacctcttaaccttctttgttaatttttttcattttgtcttatatagtccagttttccaagataagctcagtcctttttcaaatgtcccctttttaccaatactttttcattaaattatgaaaactgcta

SEQ ID NO: 1603 - DNA, 636 bp, Homo sapiens
gggtggcgacggcgcccagcccgccagaagaacgcgcggcgggcagacggctgggagccgctccggatgctccaggatgaaacgccataggcctgtcagcagcagtgacagttcagacgaaagtccttccacttcctttacttctggctcaatgtataggatcaagtcaaaaattccaaatgaacacaagaaacctgctgaggtattccggaaggacctcatcagtgccatgaaacttccagattctcaccacattaatcctgatagctattacctctttgctgatacatggaaggaagaatgggaaaagggagtccaggtaccagccagtccagacaccgttccacagccttctctcaggattatagctgagaaggtaaaggacgttctgtttatccgaccccggaagtatattcactgctccagcccagacaccacagagcctggctacatcaacatcatggagttggcagcatctgtttgccgctatgacctagatgacatggacatcttctggcttcaggaactcaatgaagaccttgcagaaatgggttgtgggccagttgatgagaatcttatggaaaagacagtagaagtcctggaacgccattgccatgaaaatatgaaccatgctat

SEQ ID NO: 1604 - DNA, 492 bp, Homo sapiens
ctccgggagtggaagcgggcggcgcggagcgcacagtcccggcccggcctcgccgcgctccgggtcgctccggttccacatcgtggtcgcctccggcgtccccggcgccttggggccgagagcgtgtgtgggctgaggatgctccaggatgaaacgccataggcctgtcagcagcagtgacagttcagacgaaagtccttccacttcctttacttctggctcaatgtataggatcaagtcaaaaattccaaatgaacacaagaaacctgctgaggtattccggaaggacctcatcagtgccatgaaacttccagattctcaccacattaatcctgatagctattacctctttgctgatacatggaaggaagaatgggaaaagggagtccaggtaccagccagtccagacaccgttccacagccttctctcaggattatagctgagaaggtaaaggacgttctgtttatccgaccccggaagtatattcactg

SEQ ID NO: 1605 - DNA, 1997 bp, Homo sapiens
agagtccttctgtcggttggtcctggagcggcgcagccggagtggggccgtgaggctggaatgcagtgacatcatctcagagctgactgcaacctctgcctcctggattcaagcaattctcctgcctcagcctcccgagtagctaggattacaggcggatgccaccatgcccggctaatttttgtatttttggaagagatgggttttcaccatattcgccaagctagtcttgaactcctgacctcaagtgatccactctcctcggcctcccaaagtgctaggattacaggccactgtgcctggccaagaggtcacttttcatgtccaggctgcatggagaataaaggcagccccgttgatgactgaaaatgacaaagcatccacctaacagacgaggaatcagctttgaagtgggagcccagttggaagcccgggaccgtttaaaaaactggtatccagctcacatagaagacattgactacgaggaaggaaaagtactcatccatttcaagcgttggaaccatcgttatgatgagtggttctgctgggacagtccttatttacgccctttagagaaaatacagctgaggaaagagggcttgcatgaagaggatggatcttctgaatttcaaataaatgagcaggtccttgcttgctggtctgattgtcgtttttacccggccaaagtcactgctgttaacaaggatggtacttacactgtgaaattttatgatggagtagttcagactgtcaaacatattcatgtcaaagctttttccaaagatcagaatattgtgggtaatgctaggcctaaagaaacagatcacaaaagtctttcatcatctcctgataaacgagagaagtttaaagaacagagaaaagcaacagtgaatgtgaagaaagacaaagaagataaacccttaaagacagaaaagcgacccaagcagcctgataaagaaggaaagttaatctgttctgaaaaggggaaagtgtcagagaaaagtcttcccaagaacgagaaggaagacaaggaaaacatttccgaaaatgacagagagtattctggagatgcccaagtggataagaaacctgaaaatgacattgtgaagagtccacaagaaaacttgagggaacccaaaagaaaacgaggcagacccccttccatagctcctactgctgtggattcaaactctcaaactttgcaaccaataacattggaactgagaagaaggaaaatatcaaaaggatgtgaagtcccattaaaacgtcctcggcttgacaaaaattcatcccaggaaaagtcaaaaaactactcggaaaacactgacaaagacttatcgaggagacgttcctccaggctgtccactaatgggacccatgagatcctagatcctgacttggttgtatcagatttggttgatacggatcctttgcaagacacgttgtctagtaccaaggaatctgaagaaggtcagttgaagtctgctttggaagctggccaggtctcatctgcactgacttgccactcctttggggatggatccggggctgcaggcttggagttgaactgcccatcaatgggagaaaacacgatgaaaacagaaccgacttctccccttgtggaattacaagagatttcgactgtggaagtaacaaatacttttaagaaaacagatgattttgggtcatctaatgcaccagctgtcgacctagaccataagtttagatgcaaagttgtggactgtttaaaatttttccgcaaagccaaactgttgcactatcacatgaagtatttccatggaatggagaagtcactggagccagaagagagcccgggaaagaggcatgtccaaaccaggggcccttcagcttcagacaagcccagccaggagaccctgaccaggaagcgggtctctgccagttccccaactacaaaagacaaggaaaagaataaagagaagaaattcaaggagtttgtgagagtgaagccaaagaag

SEQ ID NO: 1606 - DNA, 1814 bp, Homo sapiens
agagtccttctgtcggttggtcctggagcggcgcagccggagtggggccgtgagcacgagtacacgagacaggattgagaaaggagagattcaaattgtgacttcagattcaaaggcaattaaaggaattaaacgagaataaaggcagccccgttgatgactgaaaatgacaaagcatccacctaacagacgaggaatcagctttgaagtgggagcccagttggaagcccgggaccgtttaaaaaactggtatccagctcacatagaagacattgactacgaggaaggaaaagtactcatccatttcaagcgttggaaccatcgttatgatgagtggttctgctgggacagtccttatttacgccctttagagaaaatacagctgaggaaagagggcttgcatgaagaggatggatcttctgaatttcaaataaatgagcaggtccttgcttgctggtctgattgtcgtttttacccggccaaagtcactgctgttaacaaggatggtacttacactgtgaaattttatgatggagtagttcagactgtcaaacatattcatgtcaaagctttttccaaagatcagaatattgtgggtaatgctaggcctaaagaaacagatcacaaaagtctttcatcatctcctgataaacgagagaagtttaaagaacagagaaaagcaacagtgaatgtgaagaaagacaaagaagataaacccttaaagacagaaaagcgacccaagcagcctgataaagaaggaaagttaatctgttctgaaaaggggaaagtgtcagagaaaagtcttcccaagaacgagaaggaagacaaggaaaacatttccgaaaatgacagagagtattctggagatgcccaagtggataagaaacctgaaaatgacattgtgaagagtccacaagaaaacttgagggaacccaaaagaaaacgaggcagacccccttccatagctcctactgctgtggattcaaactctcaaactttgcaaccaataacattggaactgagaagaaggaaaatatcaaaaggatgtgaagtcccattaaaacgtcctcggcttgacaaaaattcatcccaggaaaagtcaaaaaactactcggaaaacactgacaaagacttatcgaggagacgttcctccaggctgtccactaatgggacccatgagatcctagatcctgacttggttgtatcagatttggttgatacggatcctttgcaagacacgttgtctagtaccaaggaatctgaagaaggtcagttgaagtctgctttggaagctggccaggtctcatctgcactgacttgccactcctttggggatggatccggggctgcaggcttggagttgaactgcccatcaatgggagaaaacacgatgaaaacagaaccgacttctccccttgtggaattacaagagatttcgactgtggaagtaacaaatacttttaagaaaacagatgattttgggtcatctaatgcaccagctgtcgacctagaccataagtttagatgcaaagttgtggactgtttaaaatttttccgcaaagccaaactgttgcactatcacatgaagtatttccatggaatggagaagtcactggagccagaagagagcccgggaaagaggcatgtccaaaccaggggcccttcagcttcagacaagcccagccaggagaccctgaccaggaagcgggtctctgccagttccccaactacaaaagacaaggaaaagaataaagagaagaaattcaaggagtttgtgagagtgaagccaaagaagaaaaagaaaaagaaaaaga

SEQ ID NO: 1607 - DNA, 5922 bp, Homo sapiens
atacgctgggcgcgtcccgggggtcacgtggtgcagagcacgcagagtccttctgtcggttggtcctggagcggcgcagccggagtggggccgtgaggagaataaaggcagccccgttgatgactgaaaatgacaaagcatccacctaacagacgaggaatcagctttgaagtgggagcccagttggaagcccgggaccgtttaaaaaactggtatccagctcacatagaagacattgactacgaggaaggaaaagtactcatccatttcaagcgttggaaccatcgttatgatgagtggttctgctgggacagtccttatttacgccctttagagaaaatacagctgaggaaagagggcttgcatgaagaggatggatcttctgaatttcaaataaatgagcaggtccttgcttgctggtctgattgtcgtttttacccggccaaagtcactgctgttaacaaggatggtacttacactgtgaaattttatgatggagtagttcagactgtcaaacatattcatgtcaaagctttttccaaagatcagaatattgtgggtaatgctaggcctaaagaaacagatcacaaaagtctttcatcatctcctgataaacgagagaagtttaaagaacagagaaaagcaacagtgaatgtgaagaaagacaaagaagataaacccttaaagacagaaaagcgacccaagcagcctgataaagaaggaaagttaatctgttctgaaaaggggaaagtgtcagagaaaagtcttcccaagaacgagaaggaagacaaggaaaacatttccgaaaatgacagagagtattctggagatgcccaagtggataagaaacctgaaaatgacattgtgaagagtccacaagaaaacttgagggaacccaaaagaaaacgaggcagacccccttccatagctcctactgctgtggattcaaactctcaaactttgcaaccaataacattggaactgagaagaaggaaaatatcaaaaggatgtgaagtcccattaaaacgtcctcggcttgacaaaaattcatcccaggaaaagtcaaaaaactactcggaaaacactgacaaagacttatcgaggagacgttcctccaggctgtccactaatgggacccatgagatcctagatcctgacttggttgtatcagatttggttgatacggatcctttgcaagacacgttgtctagtaccaaggaatctgaagaaggtcagttgaagtctgctttggaagctggccaggtctcatctgcactgacttgccactcctttggggatggatccggggctgcaggcttggagttgaactgcccatcaatgggagaaaacacgatgaaaacagaaccgacttctccccttgtggaattacaagagatttcgactgtggaagtaacaaatacttttaagaaaacagatgattttgggtcatctaatgcaccagctgtcgacctagaccataagtttagatgcaaagttgtggactgtttaaaatttttccgcaaagccaaactgttgcactatcacatgaagtatttccatggaatggagaagtcactggagccagaagagagcccgggaaagaggcatgtccaaaccaggggcccttcagcttcagacaagcccagccaggagaccctgaccaggaagcgggtctctgccagttccccaactacaaaagacaaggaaaagaataaagagaagaaattcaaggagtttgtgagagtgaagccaaagaagaaaaagaaaaagaaaaagaaaaccaaacctgaatgcccctgcagtgaggagatcagtgacacctcccaggaaccttctccacccaaggcatttgctgttaccaggtgtgggtcctcacacaagccaggggtccatatgagcccgcagcttcatggcccagaatctggacaccacaaagggaaagtgaaagcattggaggaggataatttgagtgagtcctcttctgagagctttctctggagtgatgatgagtatggccaagatgtggatgtgaccaccaacccagatgaggaacttgatggggatgaccgctatgacttcgaggtggtccgctgcatctgtgaggtccaggaggaaaatgacttcatgattcagtgtgaagagtgccagtgctggcagcatggggtctgcatgggattactggaagaaaatgtgcccgagaaatacacctgttatgtttgccaagaccctccaggtcagaggcctggcttcaagtactggtatgacaaggagtggctgagcaggggacatatgcatggcctggcatttctagaagagaactactcccatcagaatgccaagaagatcgtggccacccaccagcttcttggtgatgtgcagagagtgattgaggttctgcatggcctgcagctcaagatgagcatcttgcaaagccgggagcatcctgatctgccgctgtggtgccagccttggaaacagcactcaggggaggggagatctcatttcagaaacatccctgtcactgacaccaggagcaaggaggaagctccaagctatagaactttgaacggggcagtggagaagcccaggcccctggccctgcccctgccgcgttctgtggaggaatcctatatcaccagtgagcattgctaccagaagccccgcgcctattaccctgccgtggagcagaagctggtggtggagacgaggggctctgccctcgacgatgcggtcaaccccctccatgagaacggcgatgattccctttccccgcgcctgggctggcctctagaccaagacaggagcaagggggacagtgaccccaaacccggctccccaaaggtgaaggaatatgtctccaaaaaggccctaccagaagaagcccctgctcggaagctgctggacagaggtggagaggggctgctgagctcccagcaccagtggcagtttaacctgctgacccatgtggaatctcttcaggatgaagttacgcacaggatggactccattgagaaggagttggatgtgttggagagctggctggactacactggggaactggagccccctgagccgctggccaggcttccgcagctcaagcattgtatcaagcagctgctgatggacctgggcaaggtgcagcagatcgccctctgctgctcaacatgaaactgggcacccaaaactcatgggggcacaatcctggggcacctgcaggaggagcttcgcatatttaaataaataaacctagcatgctgaatgcacgtgacaccgactgacttcagggatctgggccaggagtgtggtggacattggacaaagaggccattttggctgcgggaggacactctgatctcgaagcctgccataaaggtagcaaatagactcttgggattcccctcttctgtgcacatcgttgaatgaagagagtctttttgcacaaacttcacttgaaattgtgccactgatgataaacggaatgagagccaaaaaagtttagttggagacagttgtaaattcaatttggagtttatttaattgacttttctatcacgttggggcacatgccaactccctggtttcttcctggcatggtgtttgggcagcaggcatcattttccttttctagcttcataggaatattgtgagctcaccatgctgtggaggttgggaaagagcagagtcttggctgccctgctttctccttaggactcttcacttttctcaccacatctcttgcatgacttcatggtactggggacaagtttgtatgccttcaccccagagctggctgggttatggcttttgtagcagagcccatacagcctatggaagaactagaatctcactcacagtaataagaatctaggaggaattccaaaccgaagcaggcagggtctggaacccaaaggacagcattttctacccacttcttaatattgacagcttccccgttctatttaatgtccaaaaatgtttcccaaaatttcaaactctttcactgtaaagatttgttacaaagaatgtggtttggggaattaccttattttatattgttgtaaacaaacttcaaattctacatgtgcgacttttctccttcctgaagggtgtttagtagtcagcgttttcagaattgttttgttactatactttaacattttacatttcctgtttgtattattttgtgagagcaaggtgatcatgctgcttaaggtccaggtacaacctatttgtaccttttgagacaatatttgtgttacttttgcaggttacggttccacatgtaattgctatattttgttttgtttttccttactaggcaaagttaaaatgttccatgctttgaggagtgacccatttcactactttgttttcttatcactaaaggcaaaaatcaaagcacagttgtccattaacacttataagttaattatgggtttatgagtctgtaatgttatatgctgcaaacatttactatgtaaacgtgaagtagccaataatatctcaatagtagtaacagtatctttagcgacctttggaatagttaagcacaggtcattgtggacatgaattcaggcctctgtactaaaatctatttcagggaatgttctgtctagtgatttgctcaccatttgatatataatgaattataggacaagtataagctgatctgctatagctgtccatcagagagaatacacgtggctataacatctataacaaaacgacgattcctctacaagaggctgtttctcactgctaacgttggtgtttctggcgtgggaagaaatgcacaggcgtgcatggcatgcacgttcagacagctgcattgtaagagttctgtcatgcagtctgaaaagggaagaaacaggatggctttctgtagccacacctgtgaggcgtgatgattgttgtattattagattactgatttttcttttctgaaaatacatttgagttttaatcacatctgtggaagctgtaacttttaaggtagtcaatttcatgtcttgttcaacgatgtaagcagaaactgaattgccctaattttgccaactggccattattgggattattgtttaaatttttggtaaaggaagtaatctcctttcattcattgtgacttttgttcttagggaagcagagaagactccccaagttcttataacctcattgtgcttccctaatttaaagccatgttgaggggctccattcccaattcctgggtcaaggtgaattaaccctatgttggagcactggaaaccgttatttgcaaacattgctgttaccatttagaaatatgtgcactatcagctgggtgcagtggctcacgtctgtaatcccagcactttgggaggccgaggcaggtggatcacctgaggtcaggagttcgagaccagcctggccaacagggtgaaaccccgtctctactaaaagtacaaaaattagctgggcgtggtggcggacgcctgtaatctcagctacttgggaggctgaagcaggagaggtgctggaacctgggaggcggaggttgaagtgagccgagattgcgctattgcactccagctcgggcgacaactgcaagactccatctcaaaaaaataaaaataaaagaaaagaaagaaatatgtgcactacctaagttttgtctttagaaaaactatccacctataaaaaattaccttgacaaaaatagttccggtttgactaatcattttgtttctttaagtggtaagtgtatgcaaggtggatccttgatgagccaacattgcactgtggatacatatctatgtttacgcgctattagaacagaaggcgctgtatatagaaatgttgctttgaagcaatatttgcaaaacacgcagacttctgtatctgtatttggaaaaaataaaacaggttcttgttgctatgtttcagtta

SEQ ID NO: 1608 - DNA, 5824 bp, Homo sapiens
gggggtcacgtggtgcagagcacgcagagtccttctgtcggttggtcctggagcggcgcagccggagtggggccgtgaggagaataaaggcagccccgttgatgactgaaaatgacaaagcatccacctaacagacgaggaatcagctttgaagtgggagcccagttggaagcccgggaccgtttaaaaaactggtatccagctcacatagaagacattgactacgaggaaggaaaagtactcatccatttcaagcgttggaaccatcgttatgatgagtggttctgctgggacagtccttatttacgccctttagagaaaatacagctgaggaaagagggcttgcatgaagaggatggatcttctgaatttcaaataaatgagcaggtccttgcttgctggtctgattgtcgtttttacccggccaaagtcactgctgttaacaaggatggtacttacactgtgaaattttatgatggagtagttcagactgtcaaacatattcatgtcaaagctttttccaaagatcagaatattgtgggtaatgctaggcctaaagaaacagatcacaaaagtctttcatcatctcctgataaacgagagaagtttaaagaacagagaaaagcaacagtgaatgtgaagaaagacaaagaagataaacccttaaagacagaaaagcgacccaagcagcctgataaagaaggaaagttaatctgttctgaaaaggggaaagtgtcagagaaaagtcttcccaagaacgagaaggaagacaaggaaaacatttccgaaaatgacagagagtattctggagatgcccaaaaaacgaggcagacccccttccatagctcctactgctgtggattcaaactctcaaactttgcaaccaataacattggaactgagaagaaggaaaatatcaaaaggatgtgaagtcccattaaaacgtcctcggcttgacaaaaattcatcccaggaaaagtcaaaaaactactcggaaaacactgacaaagacttatcgaggagacgttcctccaggctgtccactaatgggacccatgagatcctagatcctgacttggttgtatcagatttggttgatacggatcctttgcaagacacgttgtctagtaccaaggaatctgaagaaggtcagttgaagtctgctttggaagctggccaggtctcatctgcactgacttgccactcctttggggatggatccggggctgcaggcttggagttgaactgcccatcaatgggagaaaacacgatgaaaacagaaccgacttctccccttgtggaattacaagagatttcgactgtggaagtaacaaatacttttaagaaaacagatgattttgggtcatctaatgcaccagctgtcgacctagaccataagtttagatgcaaagttgtggactgtttaaaatttttccgcaaagccaaactgttgcactatcacatgaagtatttccatggaatggagaagtcactggagccagaagagagcccgggaaagaggcatgtccaaaccaggggcccttcagcttcagacaagcccagccaggagaccctgaccaggaagcgggtctctgccagttccccaactacaaaagacaaggaaaagaataaagagaagaaattcaaggagtttgtgagagtgaagccaaagaagaaaaagaaaaagaaaaagaaaaccaaacctgaatgcccctgcagtgaggagatcagtgacacctcccaggaaccttctccacccaaggcatttgctgttaccaggtgtgggtcctcacacaagccaggggtccatatgagcccgcagcttcatggcccagaatctggacaccacaaagggaaagtgaaagcattggaggaggataatttgagtgagtcctcttctgagagctttctctggagtgatgatgagtatggccaagatgtggatgtgaccaccaacccagatgaggaacttgatggggatgaccgctatgacttcgaggtggtccgctgcatctgtgaggtccaggaggaaaatgacttcatgattcagtgtgaagagtgccagtgctggcagcatggggtctgcatgggattactggaagaaaatgtgcccgagaaatacacctgttatgtttgccaagaccctccaggtcagaggcctggcttcaagtactggtatgacaaggagtggctgagcaggggacatatgcatggcctggcatttctagaagagaactactcccatcagaatgccaagaagatcgtggccacccaccagcttcttggtgatgtgcagagagtgattgaggttctgcatggcctgcagctcaagatgagcatcttgcaaagccgggagcatcctgatctgccgctgtggtgccagccttggaaacagcactcaggggaggggagatctcatttcagaaacatccctgtcactgacaccaggagcaaggaggaagctccaagctatagaactttgaacggggcagtggagaagcccaggcccctggccctgcccctgccgcgttctgtggaggaatcctatatcaccagtgagcattgctaccagaagccccgcgcctattaccctgccgtggagcagaagctggtggtggagacgaggggctctgccctcgacgatgcggtcaaccccctccatgagaacggcgatgattccctttccccgcgcctgggctggcctctagaccaagacaggagcaagggggacagtgaccccaaacccggctccccaaaggtgaaggaatatgtctccaaaaaggccctaccagaagaagcccctgctcggaagctgctggacagaggtggagaggggctgctgagctcccagcaccagtggcagtttaacctgctgacccatgtggaatctcttcaggatgaagttacgcacaggatggactccattgagaaggagttggatgtgttggagagctggctggactacactggggaactggagccccctgagccgctggccaggcttccgcagctcaagcattgtatcaagcagctgctgatggacctgggcaaggtgcagcagatcgccctctgctgctcaacatgaaactgggcacccaaaactcatgggggcacaatcctggggcacctgcaggaggagcttcgcatatttaaataaataaacctagcatgctgaatgcacgtgacaccgactgacttcagggatctgggccaggagtgtggtggacattggacaaagaggccattttggctgcgggaggacactctgatctcgaagcctgccataaaggtagcaaatagactcttgggattcccctcttctgtgcacatcgttgaatgaagagagtctttttgcacaaacttcacttgaaattgtgccactgatgataaacggaatgagagccaaaaaagtttagttggagacagttgtaaattcaatttggagtttatttaattgacttttctatcacgttggggcacatgccaactccctggtttcttcctggcatggtgtttgggcagcaggcatcattttccttttctagcttcataggaatattgtgagctcaccatgctgtggaggttgggaaagagcagagtcttggctgccctgctttctccttaggactcttcacttttctcaccacatctcttgcatgacttcatggtactggggacaagtttgtatgccttcaccccagagctggctgggttatggcttttgtagcagagcccatacagcctatggaagaactagaatctcactcacagtaataagaatctaggaggaattccaaaccgaagcaggcagggtctggaacccaaaggacagcattttctacccacttcttaatattgacagcttccccgttctatttaatgtccaaaaatgtttcccaaaatttcaaactctttcactgtaaagatttgttacaaagaatgtggtttggggaattaccttattttatattgttgtaaacaaacttcaaattctacatgtgcgacttttctccttcctgaagggtgtttagtagtcagcgttttcagaattgttttgttactatactttaacattttacatttcctgtttgtattattttgtgagagcaaggtgatcatgctgcttaaggtccaggtacaacctatttgtaccttttgagacaatatttgtgttacttttgcaggttacggttccacatgtaattgctatattttgttttgtttttccttactaggcaaagttaaaatgttccatgctttgaggagtgacccatttcactactttgttttcttatcactaaaggcaaaaatcaaagcacagttgtccattaacacttataagttaattatgggtttatgagtctgtaatgttatatgctgcaaacatttactatgtaaacgtgaagtagccaataatatctcaatagtagtaacagtatctttagcgacctttggaatagttaagcacaggtcattgtggacatgaattcaggcctctgtactaaaatctatttcagggaatgttctgtctagtgatttgctcaccatttgatatataatgaattataggacaagtataagctgatctgctatagctgtccatcagagagaatacacgtggctataacatctataacaaaacgacgattcctctacaagaggctgtttctcactgctaacgttggtgtttctggcgtgggaagaaatgcacaggcgtgcatggcatgcacgttcagacagctgcattgtaagagttctgtcatgcagtctgaaaagggaagaaacaggatggctttctgtagccacacctgtgaggcgtgatgattgttgtattattagattactgatttttcttttctgaaaatacatttgagttttaatcacatctgtggaagctgtaacttttaaggtagtcaatttcatgtcttgttcaacgatgtaagcagaaactgaattgccctaattttgccaactggccattattgggattattgtttaaatttttggtaaaggaagtaatctcctttcattcattgtgacttttgttcttagggaagcagagaagactccccaagttcttataacctcattgtgcttccctaatttaaagccatgttgaggggctccattcccaattcctgggtcaaggtgaattaaccctatgttggagcactggaaaccgttatttgcaaacattgctgttaccatttagaaatatgtgcactatcagctgggtgcagtggctcacgtctgtaatcccagcactttgggaggccgaggcaggtggatcacctgaggtcaggagttcgagaccagcctggccaacagggtgaaaccccgtctctactaaaagtacaaaaattagctgggcgtggtggcggacgcctgtaatctcagctacttgggaggctgaagcaggagaggtgctggaacctgggaggcggaggttgaagtgagccgagattgcgctattgcactccagctcgggcgacaactgcaagactccatctcaaaaaaataaaaataaaagaaaagaaagaaatatgtgcactacctaagttttgtctttagaaaaactatccacctataaaaaattaccttgacaaaaatagttccggtttgactaatcattttgtttctttaagtggtaagtgtatgcaaggtggatccttgatgagccaacattgcactgtggatacatatctatgtttacgcgctattagaacagaaggcgctgtatatagaaatgttgctttgaagcaatatttgcaaaacacgcagacttctgtatctgtatttggaaaaaataaaacaggttcttgtt

SEQ ID NO: 1609 - DNA, 1086 bp, Homo sapiens
ggcaggaacaatgggggttaaaggtcggacggaagttcccgaagcttccggtggccggcttagttaggagctatggctaaacatcatcctgatttgatcttttgccgcaagcaggctggtgttgccatcggaagactgtgtgaaaaatgtgatggcaagtgtgtgatttgtgactcctatgtgcgtccctgcactctggtgcgcatatgtgatgagtgtaactatggatcttaccaggggcgctgtgtgatctgtggaggacctggggtctctgatgcctattattgtaaggagtgcaccatccaggagaaggacagagatggctgcccaaagattgtcaatctggggagctctaagacagacctcttctatgaacgcaaaaaatacggcttcaagaagaggtgattggtgggtggccccttcctccccccaacatcagtctgctgcagctgccagaaaacatgcctactactaccagcagaaagggagcagagcccagagcatcaccaggagtgcctgctagtgtactggcagcttgccaccccctcctctcccttcacccagacacgtggtagggatggaaaaggattcttcacagagcactctggcacaccatatcggagaaaacttgatagattagttaatggtttttcttgaattcgagaagcaaagatctgttctccatattggtatgttctccctcaaccaagatcttctaaaaagaaataatattttagtcttctgcttgaggaactgactgtgaagcgacgcccagtgaaaaacatgttcttgcagcagctctggtggcagctgtccttgaggaacctttggtgtgtggtgggaagctatcagaacaagaaatgtaggcatttcccgttttttttggggggggggtgggggggcagggctctgccctcttgaaaggcatttacttgtttaacacttgtccagctacagtggggtacagtagctggctattcacaggcatcatcatagcccactagtctcatattattttccttttgagaaattggaaactctttctgttgctattatattaataaagttggtgtttattttctggta

SEQ ID NO: 1610 - DNA, 2130 bp, Homo sapiens
cgcagtcttcgccggcgcagtcaccgcgcagggcggccgcccggaggtagctaccacggcctgtgtcaacgactaaagctccagtacagcggcgccctcagacagctgggagggtggctctggccgggagcggcggccggtgagctaccgcgaggaggagcggcggaggcgacctcggcccggccctgcactggccgcccggcaggcgcgacatgagcctggtctggcatccgcgggatgctccttaagccccttctccggctgttaacctccggggaacggttgtgaccacaccgacacgtattttacagataaatcattcttgcggcggcgggtcgaacacgtttatttattttttattttctcaacaagcttttacccagcacctgtccagtgaaacaacttgataatcgtttcgaggggcgtccgccgggttaggaagccactgcctggcagcttgtggaagcctcatttgcaaagccacccctcagatgttttgaagatcgtgacgtcttgtaactagcagtgtgtgcacagaatcctactcaaggaacgtcttggcccagcgatgcaaagaactgaagtttcaagctggaagagcctgtattgtcctcacaatagtatagaagaattcaagagaggagagagagacagcaccgaatgaagactgtaaaagaaaagaaggaatgccagagattgagaaaatctgccaagactaggagggtaacccagaggaaaccgtcttcagggcctgtttgctggctatgccttcgagaacctggggatcccgaaaaattaggggaatttcttcagaaagacaatatcagcgtgcattatttctgtcttatcttatctagtaagctgcctcagaggggccagtccaacagaggcttccatggatttctgcctgaagacatcaaaaaggaggcagcccgggcttctaggaagatctgctttgtgtgcaagaaaaagggagctgctatcaactgccagaaggatcagtgcctcagaaacttccatctgccttgtggccaagaaaggggttgcctttcacaattttttggagagtacaaatcattttgtgacaaacatcgcccaacacagaacatccaacatgggcatgtgggggaggaaagctgcatcttatgttgtgaagacttatcccaacagagtgttgagaacatccagagcccgtgttgtagtcaagccatctaccaccgcaagtgcatacagaaatatgcccacacatcagcaaagcatttcttcaaatgtccacagtgtaacaatcgaaaagagtttcctcaagaaatgctgagaatgggaattcatattccagacagagatgctgcctgggaactcgagccaggggctttctcagacttatatcagcgctatcagcactgtgatgcccccatctgtctgtatgaacaaggcagagacagctttgaggatgaagggaggtggtgcctcattctgtgtgctacatgcggatcccacggaacccacagggactgctcctctcttagatctaacagtaagaaatgggagtgtgaggagtgttcacctgctgcagccacagactacatacctgaaaactcaggggacatcccttgctgcagcagcaccttccaccctgaggaacatttctgcagagacaacaccttggaagagaatccgggcctttcttggactgattggccagaaccttccttattagaaaagccagagtcctctcgtggcaggaggagctactcctggaggtccaagggtgtcagaatcactaacagctgcaaaaaatccaagtaacaccttctgagtagctgctgtcccacacaatagggtatgaagctgcgctcctccatcgggtttggggagggagcactctgggactgtgagacaaggaagcagggccagcagtgagactatgagccaagcaaagagaagtctcagtggagcatgaggagggagcagtccagatgccaacaaggaaatgcgtttatggctacaagagtgcctctgctttctcctcctctcctcccaccaaggattcttccaccttaatcttgttttcatatgcctcttcttacttcacccatgtttgttgttatgcaaataaaggttttctctcca

SEQ ID NO: 1611 - DNA, 1472 bp, Homo sapiens
cctactcaaggaacgtcttggcccagcgatgcaaagaactgaagtttcaagctggaagagcctgtattgtcctcacaatagtatagaagaattcaagagaggagagagagacagcaccgaatgaagactgtaaaagaaaagaaggaatgccagagattgagaaaatctgccaagactaggagggtaacccagaggaaaccgtcttcagggcctgtttgctggctatgccttcgagaacctggggatcccgaaaaattaggggaatttcttcagaaagacaatatcagcgtgcattatttctgtcttatcttatctagtaagctgcctcagaggggccagtccaacagaggcttccatggatttctgcctgaagacatcaaaaaggaggcagcccgggcttctaggaagatctgctttgtgtgcaagaaaaagggagctgctatcaactgccagaaggatcagtgcctcagaaacttccatctgccttgtggccaagaaaggggttgcctttcacaattttttggagagtacaaatcattttgtgacaaacatcgcccaacacagaacatccaacatgggcatgtgggggaggaaagctgcatcttatgttgtgaagacttatcccaacagagtgttgagaacatccagagcccgtgttgtagtcaagccatctaccaccgcaagtgcatacagaaatatgcccacacatcagcaaagcatttcttcaaatgtccacagtgtaacaatcgaaaagagtttcctcaagaaatgctgagaatgggaattcatattccagacaggaggtggtgcctcattctgtgtgctacatgcggatcccacggaacccacagggactgctcctctcttagatctaacagtaagaaatgggagtgtgaggagtgttcacctgctgcagccacagactacatacctgaaaactcaggggacatcccttgctgcagcagcaccttccaccctgaggaacatttctgcagagacaacaccttggaagagaatccgggcctttcttggactgattggccagaaccttccttattagaaaagccagagtcctctcgtggcaggaggagctactcctggaggtccaagggtgtcagaatcactaacagctgcaaaaaatccaagtaacaccttctgagtagctgctgtcccacacaatagggtatgaagctgcgctcctccatcgggtttggggagggagcactctgggactgtgagacaaggaagcagggccagcagtgagactatgagccaagcaaagagaagtctcagtggagcatgaggagggagcagtccagatgccaacaaggaaatgcgtttatggctacaagagtgcctctgctttctcctcctctcctcccaccaaggattcttccaccttaatcttgttttcatatgcctcttcttacttcacccatgtttgttgttatgcaaataaaggttttctctcc

SEQ ID NO: 1612 - DNA, 1196 bp, Homo sapiens
tttaatagaaagatctgctttgtgtgcaagaaaaagggagctgctatcaactgccagaaggatcagtgcctcagaaacttccatctgccttgtggccaagaaaggggttgcctttcacaattttttggagagtacaaatcattttgtgacaaacatcgcccaacacagaacatccaacatgggcatgtgggggaggaaagctgcatcttatgttgtgaagacttatcccaacagagtgttgagaacatccagagcccgtgttgtagtcaagccatctaccaccgcaagtgcatacagaaatatgcccacacatcagcaaagcatttcttcaaatgtccacagtgtaacaatcgaaaagagtttcctcaagaaatgctgagaatgggaattcatattccagacagcagagatgctgcctgggaactcgagccaggggctttctcagacttatatcagcgctatcagcactgtgatgcccccatctgtctgtatgaacaaggcagagacagctttgaggatgaagggaggtggtgcctcattctgtgtgctacatgcggatcccacggaacccacagggactgctcctctcttagatctaacagtaagaaatgggagtgtgaggagtgttcacctgctgcagccacagactacatacctgaaaactcaggggacatcccttgctgcagcagcaccttccaccctgaggaacatttctgcagagacaacaccttggaagagaatccgggcctttcttggactgattggccagaaccttccttattagaaaagccagagtcctctcgtggcaggaggagctactcctggaggtccaagggtgtcagaatcactaacagctgcaaaaaatccaagtaacaccttctgagtagctgctgtcccacacaatagggtatgaagctgcgctcctccatcgggtttggggagggagcactctgggactgtgagacaaggaagcagggccagcagtgagactatgagccaagcaaagagaagtctcagtggagcatgaggagggagcagtccagatgccaacaaggaaatgcgtttatggctacaagagtgcctctgctttctcctcctctcctcccaccaaggattcttccaccttaatcttgttttcatatgcctcttcttacttcacccatgtttgttgttatgcaaataaaggttttctctcc

SEQ ID NO: 1613 - DNA, 1328 bp, Homo sapiens
aaggaatgccagagattgagaaaatctgccaagactaggagggtaacccagaggaaaccgtcttcagggcctgtttgctggctatgcttcgagaacctggggatcccgaaaaattaggggaatttcttcagaaagacaatatcagcgtgcattatttctgtcttatcttatctagtaagctgcctcagaggggccagtccaacagaggctccatggatttctgcctgaagacatcaaaaaggaggcagcccgggcttctaggaagatctgctttgtgtgcaagaaaaagggagctgctatcaactgccagaaggatcagtgcctcagaaacttccatctgccttgtggccaagaaaggggttgcctttcacaattttttggagagtacaaatcattttgtgacaaacatcgcccaacacagaacatccaacatgggcatgtgggggaggaaagctgcatcttatgttgtgaagacttatcccaacagagtgttgagaacatccagagcccgtgttgtagtcaagccatctaccaccgcaagtgcatacagaaatatgcccacacatcagcaaagcatttcttcaaatgtccacagtgtaacaatcgaaagagtttcctcaagaaatgctgagaatgggaattcatattccagacaggaggtggtgcctcattctgtgtgctacatgcggatcccacggaacccacagggactgctcctctcttagatctaacagtaagaaatgggagtgtgaggagtgttcacctgctgcagccacagactacatacctgaaaactcaggggacatcccttgctgcagcagcaccttccaccctgaggaacatttctgcagagacaacaccttggaagagaatccgggcctttcttggactgattggccagaaccttccttattagaaaagccagagtcctctcgtggcaggaggagctactcctggaggtccaagggtgtcagaatcactaacagctgcaaaaaatccaagtaacaccttctgagtagctgctgtcccacacaatagggtatgaagctgcgctcctccatcgggtttggggagggagcactctgggactgtgagacaaggaagcagggccagcagtgagactatgagccaagcaaagagaagtctcagtggagcatgaggagggagcagtccagatgccaacaaggaaatgcgtttatggctacaagagtgcctctgctttctcctcctctcctcccaccaaggattcttccaccttaatcttgttttcatatgcctcttcttacttcacccatgtttgttgttatgcaaataaaggttttctctcc

SEQ ID NO: 1614 - DNA, 558 bp, Homo sapiens
ctctgggaccttccccagcactctgggtgtaaggggcagccctggtgtacagccactcacccctgacatttgctctgaaggtcgtagatctcctccacttgcacccccttgacacctgcgatgaggaaaggaaagcagtagggaaggacagcccctgatgagtgagggcgcaggggtgggccgccacagccccggtccggcagggagaaaaggctcttaccgaaatcttccacgagcaggcttttacccagcacctgtccagtgaaacaacttgataatcgtttcgaggggcgtccgccgggttaggaagccactgcctggcagcttgtggaagcctcatttgcaaagccacccctcagatgttttgaagatcgtgacgtcttgtaactagcagtgtgtgcacagaatcctactcaagctggaagagcctgtattgtcctcacaatagtatagaagaattcaagagaggagagagagacagcaccgaatgaagactgtaaaagaaaagaaggaatgccagagattgagaaaatctgccaagactaggagggtaaccca

SEQ ID NO: 1615 - DNA, 1822 bp, Homo sapiens
ggtcatagtccgcgtgacccacccccgtttgcgcgctcgcagtcttcgccggcgcagtcaccgcgcagggcggccgcccggaggtagctaccacggcctgtgtcaacgactaaagctccagtacagcggcgccctcagacagctgggagggtggctctggccgggagcggcggccggtgagctaccgcgaggaggagcggcggaggcgacctcggcccggccctgcactggccgcccggcaggcgcgacatgagcctggtctggcatccgcgggatgctccttaagccccttctccggctgttaacctccggggaacggttgtgaccacaccgacacgtattttacagataaatcattcttgcggcggcgggtcgaacacgtttatttattttttattttctcaacaagcttttacccagcacctgtccagtgaaacaacttgataatcgtttcgaggggcgtccgccgggttaggaagccactgcctggcagcttgtggaagcctcatttgcaaagccacccctcagatgttttgaagatcgtgacgtcttgtaactagcagtgtgtgcacagaatcctactcaagctggaagagcctgtattgtcctcacaatagtatagaagaattcaagagaggagagagagacagcaccgaatgaagactgtaaaagaaaagaaggaatgccagagattgagaaaatctgccaagactaggagggtaacccagaggaaaccgtcttcagggcctgtttgctggctatgccttcgagaacctggggatcccgaaaaattaggggaatttcttcagaaagacaatatcagcgtgcattatttctgtcttatcttatctagtaagctgcctcagaggggccagtccaacagaggcttccatggatttctgcctgaagacatcaaaaaggaggcagcccgggcttctaggaagatctgctttgtgtgcaagaaaaagggagctgctatcaactgccagaaggatcagtgcctcagaaacttccatctgccttgtggccaagaaaggggttgcctttcacaattttttggagagtacaaatcattttgtgacaaacatcgcccaacacagaacatccaacatgggcatgtgggggaggaaagctgcatcttatgttgtgaagacttatcccaacagagtgttgagaacatccagagcccgtgttgtagtcaagccatctaccaccgcaagtgcatacagaaatatgcccacacatcagcaaagcatttcttcaaatgtccacagtgtaacaatcgaaaagagtttcctcaagaaatgctgagaatgggaattcatattccagacagagatgctgcctgggaactcgagccaggggctttctcagacttatatcagcgctatcagcactgtgatgcccccatctgtctgtatgaacaaggcagagacagctttgaggatgaagggaggtggtgcctcattctgtgtgctacatgcggatcccacggaacccacagggactgctcctctcttagatctaacagtaagaaatgggagtgtgaggagtgttcacctgctgcagccacagactacatacctgaaaactcaggggacatcccttgctgcagcagcaccttccaccctgaggaacatttctgcagagacaacaccttggaagagaatccgggcctttcttggactgattggccagaaccttccttattagaaaagccagagtcctctcgtggcaggaggagctactcctggaggtccaagggtgtcagaatcactaacagctgcaaaaaatccaagtaacaccttctgagtagctgctg

SEQ ID NO: 1616 - DNA, 2247 bp, Homo sapiens
acctttcagggagatttgagagaaagactccagaagcccgcggggagagcaggggttctggggaagataaagcccttcatccaggatccctctgtgaccataagatgagatggaccaaacgcccccggcgcgtcctgaatatctggtctcagggattcgaactccccctgtgaggaggaacagcaaactggccaccctgggcaggatcttcaaaccctggaaatggaggaaaaagaaaaacgaaaaactgaagcagacaacgtcagcgctggagaagaagatggccggcaggcaaggccgagaggagctcatcaagaaggggctgctggagatgatggagcaggatgctgaaagcaaaacttgcaaccccgatggaggaccccgatctgtacagagtgaaccacccactcccaagtcggagacgctgacttcagaagatgcccagcccggaagccccttggccactgggacggaccaggtctccctggacaagccactgtcctcagctgcccacttggacgatgcagccaagatgccttctgcatccagtggtgaagaagcagacgctggcagcctcctgcccaccaccaatgagctctcccaagccttagctggggctgactccctggacagtcctcccagacctctggagagatccgtgggccagctccccagccccccactgctgcccactccgccacccaaggcaagctccaaaaccacaaaaaatgtcacaggccaagccacactcttccaagcctccagcatgaagagtgccgacccttccctccggggccagctctccacacccacggggtctccgcatctcaccacggtccaccggcctcttcccccaagccgcgtcattgaggagctgcacagggcgctggccacgaagcaccgccaggacagttttcaaggaagagaaagtaaagggtctccaaagaagcggctggatgtccgtctgtcgagaacgtccagcgtggagcggggcaaggagagggaggaggcttggagctttgacggggcattggagaacaagcgaactgccgctaaggaatctgaggagaacaaggagaacctgatcataaattctgaactcaaagacgacttgcttttgtatcaggacgaggaggcgctgaacgactccattatttctggaacactgccacggaaatgcaagaaggagctcctggccgtgaagctaaggaaccggccaagcaaacaggaactagaagaccggaacattttccccagaaggactgatgaagaaagacaggagatccggcagcagatcgagatgaagctttccaaacggctgagccaaagacctgccgtggaagagctggagagaagaaatatcttgaaacaaaggaatgatcagacagagcaggaagaaagaagagaaatcaagcaaagattgacaagaaagcttaatcagagacccactgttgatgaattaagagacagaaaaattctgatacgattcagtgattacgtggaagtagcaaaagcgcaggactatgacaggagggcagacaaaccctggacgagactgtcagcagcagataaggcagcaattcgtaaagaattaaatgagtacaaaagtaatgaaatggaggtacatgcatcaagcaagcacttgacaagattccacaggccatagagattttcttctgagaagaatttgtgtttaattttttgataccaacactgaacattcatcagggaactttcctgaagttcagctcaagactaccctacctgctgtgtttgtgagaagagtaggatcacacacacaggtgcaatcttgaccacacttacctgcaagaggagtaaccagaggacacacttccttccttctttggtgtctgaggagtgtgaactgttggggtcagttaagacccaacataactctatcagaagaaaactgttgtttgcctttcaaccttgttttacagttctgcagtgtaatggaggacgggcaacgtgcatgtgcaggctcaccactcccaggcctctgacatgagggacatgtgacagtgtcattcagtattatgttcaaaagacatttttatcctgatcataattaatttgaaaactctttaagttcatgttatacaagatgatttactgtattatacttttccttttttatataatgtctaacaaaaaatacagctgcaacattttgattcctgttaattttgttctttaattaaatgactacttattgcaggaaattaa

SEQ ID NO: 1617 - DNA, 2162 bp, Homo sapiens
cattcaaacccagtccattctggctcatggggcccaagccttgctctgctgccccaggctgtgtaggatgcatctgcggtggccattcttctctccagaggtccttcctaggactgactttgtggagattctgtgctggtaggtggcggggcaagacacgcctgtctctccccctggaaggagtcagtccagcaagaaacctgatgaaaccagtgactcccagctctggatgagatggaccaaacgcccccggcgcgtcctgaatatctggtctcagggattcgaactccccctgtgaggaggaacagcaaactggccaccctgggcaggatcttcaaaccctggaaatggaggaaaaagaaaaacgaaaaactgaagcagacaacgtcagcgctggagaagaagatggccggcaggcaaggccgagaggagctcatcaagaaggggctgctggagatgatggagcaggatgctgaaagcaaaacttgcaaccccgatggaggaccccgatctgtacagagtgaaccacccactcccaagtcggagacgctgacttcagaagatgcccagcccggaagccccttggccactgggacggaccaggtctccctggacaagccactgtcctcagctgcccacttggacgatgcaggccaagccacactcttccaagcctccagcatgaagagtgccgacccttccctccggggccagctctccacacccacggggtctccgcatctcaccacggtccaccggcctcttcccccaagccgcgtcattgaggagctgcacagggcgctggccacgaagcaccgccaggacagttttcaaggaagagaaagtaaagggtctccaaagaagcggctggatgtccgtctgtcgagaacgtccagcgtggagcggggcaaggagagggaggaggcttggagctttgacggggcattggagaacaagcgaactgccgctaaggaatctgaggagaacaaggagaacctgatcataaattctgaactcaaagacgacttgcttttgtatcaggacgaggaggcgctgaacgactccattatttctggaacactgccacggaaatgcaagaaggagctcctggccgtgaagctaaggaaccggccaagcaaacaggaactagaagaccggaacattttccccagaaggactgatgaagaaagacaggagatccggcagcagatcgagatgaagctttccaaacggctgagccaaagacctgccgtggaagagctggagagaagaaatatcttgaaacaaaggaatgatcagacagagcaggaagaaagaagagaaatcaagcaaagattgacaagaaagcttaatcagagacccactgttgatgaattaagagacagaaaaattctgatacgattcagtgattacgtggaagtagcaaaagcgcaggactatgacaggagggcagacaaaccctggacgagactgtcagcagcagataaggcagcaattcgtaaagaattaaatgagtacaaaagtaatgaaatggaggtacatgcatcaagcaagcacttgacaagattccacaggccatagagattttcttctgagaagaatttgtgtttaattttttgataccaacactgaacattcatcagggaactttcctgaagttcagctcaagactaccctacctgctgtgtttgtgagaagagtaggatcacacacacaggtgcaatcttgaccacacttacctgcaagaggagtaaccagaggacacacttccttccttctttggtgtctgaggagtgtgaactgttggggtcagttaagacccaacataactctatcagaagaaaactgttgtttgcctttcaaccttgttttacagttctgcagtgtaatggaggacgggcaacgtgcatgtgcaggctcaccactcccaggcctctgacatgagggacatgtgacagtgtcattcagtattatgttcaaaagacatttttatcctgatcataattaatttgaaaactctttaagttcatgttatacaagatgatttactgtattatacttttccttttttatataatgtctaacaaaaaatacagctgcaacattttgattcctgttaattttgttctttaattaaatgactacttattgcaggaaattaa

SEQ ID NO: 1618 - DNA, 2728 bp, Homo sapiens
gcaattgcaagagcaaagattcttccttttcccttttttcctgggggggtggggggtggggtggggggagggagcgcccccagacattccaggacatcaccccctgccccaagcacgcaataaacactgacaagaaaaagtttttatttcctggttcaacttttttttttttccctggaatatagactgaagaatgggaataaacacgaataaataacaaagcgaggccgcgcacgccgggatgcgcctggctgcagccggcgaggctattgtctccccgccctgaagccagccccggcgtctttctccagctcgtttcctttcccggccttttttttttttttttttttttaattttcttttttaaaaagacgccccctccagccccctcgccggtgaccttggccgcctcggatgctctgattccacgcggctcgctctaacttgcccccgcgccggccgggcccatggccgcgtcggaggacgggagcggctgcctcgtgtcgcggggccgctcgcagagtgaccccagcgtcctcaccgactcctcggccacctcctccgcggacgccggggagaacccagatgagatggaccaaacgcccccggcgcgtcctgaatatctggtctcagggattcgaactccccctgtgaggaggaacagcaaactggccaccctgggcaggatcttcaaaccctggaaatggaggaaaaagaaaaacgaaaaactgaagcagacaacgtcagcgctggagaagaagatggccggcaggcaaggccgagaggagctcatcaagaaggggctgctggagatgatggagcaggatgctgaaagcaaaacttgcaaccccgatggaggaccccgatctgtacagagtgaaccacccactcccaagtcggagacgctgacttcagaagatgcccagcccggaagccccttggccactgggacggaccaggtctccctggacaagccactgtcctcagctgcccacttggacgatgcagccaagatgccttctgcatccagtggtgaagaagcagacgctggcagcctcctgcccaccaccaatgagctctcccaagccttagctggggctgactccctggacagtcctcccagacctctggagagatccgtgggccagctccccagccccccactgctgcccactccgccacccaaggcaagctccaaaaccacaaaaaatgtcacaggccaagccacactcttccaagcctccagcatgaagagtgccgacccttccctccggggccagctctccacacccacggggtctccgcatctcaccacggtccaccggcctcttcccccaagccgcgtcattgaggagctgcacagggcgctggccacgaagcaccgccaggacagttttcaaggaagagaaagtaaagggtctccaaagaagcggctggatgtccgtctgtcgagaacgtccagcgtggagcggggcaaggagagggaggaggcttggagctttgacggggcattggagaacaagcgaactgccgctaaggaatctgaggagaacaaggagaacctgatcataaattctgaactcaaagacgacttgcttttgtatcaggacgaggaggcgctgaacgactccattatttctggaacactgccacggaaatgcaagaaggagctcctggccgtgaagctaaggaaccggccaagcaaacaggaactagaagaccggaacattttccccagaaggactgatgaagaaagacaggagatccggcagcagatcgagatgaagctttccaaacggctgagccaaagacctgccgtggaagagctggagagaagaaatatcttgaaacaaaggaatgatcagacagagcaggaagaaagaagagaaatcaagcaaagattgacaagaaagcttaatcagagacccactgttgatgaattaagagacagaaaaattctgatacgattcagtgattacgtggaagtagcaaaagcgcaggactatgacaggagggcagacaaaccctggacgagactgtcagcagcagataaggcagcaattcgtaaagaattaaatgagtacaaaagtaatgaaatggaggtacatgcatcaagcaagcacttgacaagattccacaggccatagagattttcttctgagaagaatttgtgtttaattttttgataccaacactgaacattcatcagggaactttcctgaagttcagctcaagactaccctacctgctgtgtttgtgagaagagtaggatcacacacacaggtgcaatcttgaccacacttacctgcaagaggagtaaccagaggacacacttccttccttctttggtgtctgaggagtgtgaactgttggggtcagttaagacccaacataactctatcagaagaaaactgttgtttgcctttcaaccttgttttacagttctgcagtgtaatggaggacgggcaacgtgcatgtgcaggctcaccactcccaggcctctgacatgagggacatgtgacagtgtcattcagtattatgttcaaaagacatttttatcctgatcataattaatttgaaaactctttaagttcatgttatacaagatgatttactgtattatacttttccttttttatataatgtctaacaaaaaatacagctgcaacattttgattcctgttaattttgttctttaattaaatgactacttattgcaggaaattaa

SEQ ID NO: 1619 - DNA, 2372 bp, Homo sapiens
cattcaaacccagtccattctggctcatggggcccaagccttgctctgctgccccaggctgtgtaggatgcatctgcggtggccattcttctctccagaggtccttcctaggactgactttgtggagattctgtgctggtaggtggcggggcaagacacgcctgtctctccccctggaaggagtcagtccagcaagaaacctgatgaaaccagtgactcccagctctggatgagatggaccaaacgcccccggcgcgtcctgaatatctggtctcagggattcgaactccccctgtgaggaggaacagcaaactggccaccctgggcaggatcttcaaaccctggaaatggaggaaaaagaaaaacgaaaaactgaagcagacaacgtcagcgctggagaagaagatggccggcaggcaaggccgagaggagctcatcaagaaggggctgctggagatgatggagcaggatgctgaaagcaaaacttgcaaccccgatggaggaccccgatctgtacagagtgaaccacccactcccaagtcggagacgctgacttcagaagatgcccagcccggaagccccttggccactgggacggaccaggtctccctggacaagccactgtcctcagctgcccacttggacgatgcagccaagatgccttctgcatccagtggtgaagaagcagacgctggcagcctcctgcccaccaccaatgagctctcccaagccttagctggggctgactccctggacagtcctcccagacctctggagagatccgtgggccagctccccagccccccactgctgcccactccgccacccaaggcaagctccaaaaccacaaaaaatgtcacaggccaagccacactcttccaagcctccagcatgaagagtgccgacccttccctccggggccagctctccacacccacggggtctccgcatctcaccacggtccaccggcctcttcccccaagccgcgtcattgaggagctgcacagggcgctggccacgaagcaccgccaggacagttttcaaggaagagaaagtaaagggtctccaaagaagcggctggatgtccgtctgtcgagaacgtccagcgtggagcggggcaaggagagggaggaggcttggagctttgacggggcattggagaacaagcgaactgccgctaaggaatctgaggagaacaaggagaacctgatcataaattctgaactcaaagacgacttgcttttgtatcaggacgaggaggcgctgaacgactccattatttctggaacactgccacggaaatgcaagaaggagctcctggccgtgaagctaaggaaccggccaagcaaacaggaactagaagaccggaacattttccccagaaggactgatgaagaaagacaggagatccggcagcagatcgagatgaagctttccaaacggctgagccaaagacctgccgtggaagagctggagagaagaaatatcttgaaacaaaggaatgatcagacagagcaggaagaaagaagagaaatcaagcaaagattgacaagaaagcttaatcagagacccactgttgatgaattaagagacagaaaaattctgatacgattcagtgattacgtggaagtagcaaaagcgcaggactatgacaggagggcagacaaaccctggacgagactgtcagcagcagataaggcagcaattcgtaaagaattaaatgagtacaaaagtaatgaaatggaggtacatgcatcaagcaagcacttgacaagattccacaggccatagagattttcttctgagaagaatttgtgtttaattttttgataccaacactgaacattcatcagggaactttcctgaagttcagctcaagactaccctacctgctgtgtttgtgagaagagtaggatcacacacacaggtgcaatcttgaccacacttacctgcaagaggagtaaccagaggacacacttccttccttctttggtgtctgaggagtgtgaactgttggggtcagttaagacccaacataactctatcagaagaaaactgttgtttgcctttcaaccttgttttacagttctgcagtgtaatggaggacgggcaacgtgcatgtgcaggctcaccactcccaggcctctgacatgagggacatgtgacagtgtcattcagtattatgttcaaaagacatttttatcctgatcataattaatttgaaaactctttaagttcatgttatacaagatgatttactgtattatacttttccttttttatataatgtctaacaaaaaatacagctgcaacattttgattcctgttaattttgttctttaattaaatgactacttattgcaggaaattaa

SEQ ID NO: 1620 - DNA, 2518 bp, Homo sapiens
gcaattgcaagagcaaagattcttccttttcccttttttcctgggggggtggggggtggggtggggggagggagcgcccccagacattccaggacatcaccccctgccccaagcacgcaataaacactgacaagaaaaagtttttatttcctggttcaacttttttttttttccctggaatatagactgaagaatgggaataaacacgaataaataacaaagcgaggccgcgcacgccgggatgcgcctggctgcagccggcgaggctattgtctccccgccctgaagccagccccggcgtctttctccagctcgtttcctttcccggccttttttttttttttttttttttaattttcttttttaaaaagacgccccctccagccccctcgccggtgaccttggccgcctcggatgctctgattccacgcggctcgctctaacttgcccccgcgccggccgggcccatggccgcgtcggaggacgggagcggctgcctcgtgtcgcggggccgctcgcagagtgaccccagcgtcctcaccgactcctcggccacctcctccgcggacgccggggagaacccagatgagatggaccaaacgcccccggcgcgtcctgaatatctggtctcagggattcgaactccccctgtgaggaggaacagcaaactggccaccctgggcaggatcttcaaaccctggaaatggaggaaaaagaaaaacgaaaaactgaagcagacaacgtcagcgctggagaagaagatggccggcaggcaaggccgagaggagctcatcaagaaggggctgctggagatgatggagcaggatgctgaaagcaaaacttgcaaccccgatggaggaccccgatctgtacagagtgaaccacccactcccaagtcggagacgctgacttcagaagatgcccagcccggaagccccttggccactgggacggaccaggtctccctggacaagccactgtcctcagctgcccacttggacgatgcaggccaagccacactcttccaagcctccagcatgaagagtgccgacccttccctccggggccagctctccacacccacggggtctccgcatctcaccacggtccaccggcctcttcccccaagccgcgtcattgaggagctgcacagggcgctggccacgaagcaccgccaggacagttttcaaggaagagaaagtaaagggtctccaaagaagcggctggatgtccgtctgtcgagaacgtccagcgtggagcggggcaaggagagggaggaggcttggagctttgacggggcattggagaacaagcgaactgccgctaaggaatctgaggagaacaaggagaacctgatcataaattctgaactcaaagacgacttgcttttgtatcaggacgaggaggcgctgaacgactccattatttctggaacactgccacggaaatgcaagaaggagctcctggccgtgaagctaaggaaccggccaagcaaacaggaactagaagaccggaacattttccccagaaggactgatgaagaaagacaggagatccggcagcagatcgagatgaagctttccaaacggctgagccaaagacctgccgtggaagagctggagagaagaaatatcttgaaacaaaggaatgatcagacagagcaggaagaaagaagagaaatcaagcaaagattgacaagaaagcttaatcagagacccactgttgatgaattaagagacagaaaaattctgatacgattcagtgattacgtggaagtagcaaaagcgcaggactatgacaggagggcagacaaaccctggacgagactgtcagcagcagataaggcagcaattcgtaaagaattaaatgagtacaaaagtaatgaaatggaggtacatgcatcaagcaagcacttgacaagattccacaggccatagagattttcttctgagaagaatttgtgtttaattttttgataccaacactgaacattcatcagggaactttcctgaagttcagctcaagactaccctacctgctgtgtttgtgagaagagtaggatcacacacacaggtgcaatcttgaccacacttacctgcaagaggagtaaccagaggacacacttccttccttctttggtgtctgaggagtgtgaactgttggggtcagttaagacccaacataactctatcagaagaaaactgttgtttgcctttcaaccttgttttacagttctgcagtgtaatggaggacgggcaacgtgcatgtgcaggctcaccactcccaggcctctgacatgagggacatgtgacagtgtcattcagtattatgttcaaaagacatttttatcctgatcataattaatttgaaaactctttaagttcatgttatacaagatgatttactgtattatacttttccttttttatataatgtctaacaaaaaatacagctgcaacattttgattcctgttaattttgttctttaattaaatgactacttattgcaggaaattaa

SEQ ID NO: 1621 - DNA, 539 bp, Homo sapiens
cacactgccagcgctcacactgcactcccaggccctgctgtaggtgctaatctgatgggggcagccttagggagggctctgtccccagcaggaggacccttggtgtctctgtggtccttgaatcctggtgtctgttgaaatgcctcctcctctgggcaccttccaggaccaggccaggtgacaccaccattccacccccgtctctacccctttcctggactttcttccttccctgccctggctggggaagcagcggctgcctgcctgtgttcaccccacaccaccgctggggttgtgagaatcgctccttagcaccctggaggacacctctccccctcgccggtgaccttggccgcctcggatgctctgattccacgcggctcgctctaacttgcccccgcgccggccgggcccatggccgcgtcggaggacgggagcggctgcctcgtgtcgcggggccgctcgcagagtgaccccagcgtcctcaccgactcctcggccacctcctccgcggacgccggggagaacccagatgagat

SEQ ID NO: 1622 - DNA, 1786 bp, Homo sapiens
aaaaacacaaagaaacaaaaagtacgggagaggatcagttcattctcctgactcctggttggtctcaagacctcccctgttgcctgtgctctggaagattccccatagtacctactaggtgggccagagaaggatggatttgtgggaccctggaaggctgggaagaggactgagaagccacagccctgcgctgggaagagccacggagatgagatggaccaaacgcccccggcgcgtcctgaatatctggtctcagggattcgaactccccctgtgaggaggaacagcaaactggccaccctgggcaggatcttcaaaccctggaaatggaggaaaaagaaaaacgaaaaactgaagcagacaacgtcagcgctggagaagaagatggccggcaggcaaggccgagaggagctcatcaagaaggggctgctggagatgatggagcaggatgctgaaagcaaaacttgcaaccccgatggaggaccccgatctgtacagagtgaaccacccactcccaagtcggagacgctgacttcagaagatgcccagcccggaagccccttggccactgggacggaccaggtctccctggacaagccactgtcctcagctgcccacttggacgatgcagccaagatgccttctgcatccagtggtgaagaagcagacgctggcagcctcctgcccaccaccaatgagctctcccaagccttagctggggctgactccctggacagtcctcccagacctctggagagatccgtgggccagctccccagccccccactgctgcccactccgccacccaaggcaagctccaaaaccacaaaaaatgtcacaggccaagccacactcttccaagcctccagcatgaagagtgccgacccttccctccggggccagctctccacacccacggggtctccgcatctcaccacggtccaccggcctcttcccccaagccgcgtcattgaggagctgcacagggcgctggccacgaagcaccgccaggacagttttcaaggaagagaaagtaaagggtctccaaagaagcggctggatgtccgtctgtcgagaacgtccagcgtggagcggggcaaggagagggaggaggcttggagctttgacggggcattggagaacaagcgaactgccgctaaggaatctgaggagaacaaggagaacctgatcataaattctgaactcaaagacgacttgcttttgtatcaggacgaggaggcgctgaacgactccattatttctggaacactgccacggaaatgcaagaaggagctcctggccgtgaagctaaggaaccggccaagcaaacaggaactagaagaccggaacattttccccagaaggactgatgaagaaagacaggagatccggcagcagatcgagatgaagctttccaaacggctgagccaaagacctgccgtggaagagctggagagaagaaatatcttgaaacaaaggaatgatcagacagagcaggaagaaagaagagaaatcaagcaaagattgacaagaaagcttaatcagagacccactgttgatgaattaagagacagaaaaattctgatacgattcagtgattacgtggaagtagcaaaagcgcaggactatgacaggagggcagacaaaccctggacgagactgtcagcagcagataaggcagcaattcgtaaagaattaaatgagtacaaaagtaatgaaatggaggtacatgcatcaagcaagcacttgacaagattccacaggccatagagattttcttctgaga

SEQ ID NO: 1623 - DNA, 3100 bp, Homo sapiens
gtacccgcccagctgctggaggcgccggcagcgcccgccagacccgccagcccagcggcccgggctctggggaaaccggcgctcccgacaggggagcaccgggcctctgagctccctcgggagcctttcacgaggtcagctacgtctttgttgtgcgcgttcctgaacttttggtccattaaccaacaattagacacgccggtattcagtgcctggcgcggtgctagatgctgggtgtaatctcagaaaaatacattcaggggcgcgcctgagggtgctggctgctggcatctcaggtgctttacgtgcattcgtgaagaagcccatcagtatttcttgaataccagatctctatttctgaatatagaccccaagctaagtgaagctttagcctctaagctcaacatgtatgaagctttgccaggccctgctcctgaaaatgaagatggccttgtgaaagtgaaggaggaagatcccacctgggagcaggtgtgcaactcacaggagggcagctcccacactcaggagatttgccgcctgcgctttcggcacttctgctaccaggaggctcacggaccccaggaagctctggcccaactccgagaactttgtcatcaatggctgagaccggagatgcacaccaaggaacagataatggaactgctggtgctggagcagttcctgaccatcctgcccaaggagctccagccctgtgtgaagacatatcctctggagagtggagaggaggcagtgacagtgctggagaatctagagacaggaagtggagacacaggacaacaggcctctgtctatattcagggacaggacatgcacccaatggtggcagaatatcaaggagtctctttggagtgtcagagcctccagctcctgcctgggataaccaccctgaagtgtgaacctccacagcgtcctcaagggaacccccaagaagtgagtgggcctgttccccacggatcagctcatctccaggaaaaaaaccccagagacaaggctgtagtgcctgtgtttaacccagtcaggtcccagacattggtgaagactgaggaagaaacagcccaggccgttgctgcagagaagtggtcacatctgagtctgactcggaggaacctctgtgggaactcagctcaggagacagttatgagcctcagtccgatgactgaagaaattgtaactaaagatagattgtttaaagcaaagcaagaaacttctgaagaaatggaacaaagtggagaagcctcaggaaagcccaacagagagtgtgcaccccagattccttgtagtactcctattgctactgaaaggacagttgcacatttgaacactctgaaggaccgtcacccaggtgatttgtgggcccgcatgcacatctcatccctggaatatgctgcaggagacattacccgaaaagggagaaaaaaagacaaagctcgagtgagtgaactgctccaaggcctctcattctctggtgactcagatgtggaaaaagataatgagcctgagatccagcctgctcaaaagaagttaaaggtatcatgtttcccagaaaagagttggaccaaaagagacattaaacccaattttccaagctggtcagcactggattctggacttttgaatctcaagagcgaaaagttgaacccagtagagctttttgaattattttttgatgatgaaacattcaacttaattgtcaatgaaaccaataattatgcttctcagaaaaatgtcagcttggaagtcacagttcaggaaatgaggtgtgtgtttggtgtcttacttttgagtggatttatgaggcatcctagaagggaaatgtattgggaagtctctgacaccgatcagaacctggttagagatgcaatcagaagggacagatttgaattgattttctcaaacctgcactttgcagataatggccacctagatcaaaaagataagtttacaaagttgagacctctcataaaacaaatgaataaaaatttcctcttgtatgctcccctggaagaatactattgctttgataagtcaatgtgtgaatgctttgatagtgaccaattcctgaatggaaagcctattagaattggctataaaatttggtgtggtacaaccacacagggttatctggtttggtttgaaccctatcaagaagaatcaactatgaaggtagatgaggatcctgatcttgggttaggtggaaatctagtgatgaacttcgctgatgttcttttagagagaggtcagtatccctatcacctgtgttttgatagcttctttacaagtgtcaaattgttgtcagccttgaaaaagaagggggtgagggcaacaggaacaattcgtgagaacaggaccgaaaaatgtccccttatgaatgtagaacatatgaaaaaaatgaagagagggtattttgatttccgaatagaagaaaacaatgagataattttgtgtcgttggtatggggatggcattatcagtctgtgctccaatgctgtgggcatagaaccagtcaatgaggtaagctgttgtgatgctgataacgaagaaatccctcagataagtcaaccatccatagtaaaagtgtatgatgaatgcaaggaaggtgtagctaaaatggatcaaattatttcgaaatacagggtgaggataagaagcaagaaatggtactcaattttggtgagctacatgattgatgtagccatgaacaatgcatggcaactacacagagcctgtaacccaggtgcttctctagaccccttggattttcggagatttgttgcacatttctacttggaacacaatgctcatctgtcagattagggtacataaaatggacatagtgcagacattaataagacatagaaaaataataattatacatgctgttgtaccctcccaaagtaaatctgatatatgtaatgaagttattaaataatacttttaaaaatcagacatttatatagagtttcaaagactattgtaacaagtaatgttaaaaattgtctgtgagaatgttgaactgtagtacctttctctatgtcaagttttgtgtcagacatgggaaatcatgtatttgttcaattga

SEQ ID NO: 1624 - DNA, 3114 bp, Homo sapiens
actccgctgcgggcgcggcgcagggagaagcttttgtacccgcccagctgctggaggcgccggcagcgcccgccagacccgccagcccagcggcccgggctctggggaaaccggcgctcccgacaggggagcaccgggcctctgagctccctcgggagcctttcacgaggtcagctacgtctttgttgtgcgcgttcctgaacttttggtccattaaccaacaattagacacgccggtattcagtgcctggcgcggtgctagatgctgggtgtaatctcagaaaaatacattcaggggcgcgcctgagggtgctggctgctggcatctcaggtgctttacgtgcattcgtgaagaagcccatcagtatttcttgaataccagaccccaagctaagtgaagctttagcctctaagctcaacatgtatgaagctttgccaggccctgctcctgaaaatgaagatggccttgtgaaagtgaaggaggaagatcccacctgggagcaggtgtgcaactcacaggagggcagctcccacactcaggagatttgccgcctgcgctttcggcacttctgctaccaggaggctcacggaccccaggaagctctggcccaactccgagaactttgtcatcaatggctgagaccggagatgcacaccaaggaacagataatggaactgctggtgctggagcagttcctgaccatcctgcccaaggagctccagccctgtgtgaagacatatcctctggagagtggagaggaggcagtgacagtgctggagaatctagagacaggaagtggagacacaggacaacaggcctctgtctatattcagggacaggacatgcacccaatggtggcagaatatcaaggagtctctttggagtgtcagagcctccagctcctgcctgggataaccaccctgaagtgtgaacctccacagcgtcctcaagggaacccccaagaagtgagtgggcctgttccccacggatcagctcatctccaggaaaaaaaccccagagacaaggctgtagtgcctgtgtttaacccagtcaggtcccagacattggtgaagactgaggaagaaacagcccaggccgttgctgcagagaagtggtcacatctgagtctgactcggaggaacctctgtgggaactcagctcaggagacagttatgagcctcagtccgatgactgaagaaattgtaactaaagatagattgtttaaagcaaagcaagaaacttctgaagaaatggaacaaagtggagaagcctcaggaaagcccaacagagagtgtgcaccccagattccttgtagtactcctattgctactgaaaggacagttgcacatttgaacactctgaaggaccgtcacccaggtgatttgtgggcccgcatgcacatctcatccctggaatatgctgcaggagacattacccgaaaagggagaaaaaaagacaaagctcgagtgagtgaactgctccaaggcctctcattctctggtgactcagatgtggaaaaagataatgagcctgagatccagcctgctcaaaagaagttaaaggtatcatgtttcccagaaaagagttggaccaaaagagacattaaacccaattttccaagctggtcagcactggattctggacttttgaatctcaagagcgaaaagttgaacccagtagagctttttgaattattttttgatgatgaaacattcaacttaattgtcaatgaaaccaataattatgcttctcagaaaaatgtcagcttggaagtcacagttcaggaaatgaggtgtgtgtttggtgtcttacttttgagtggatttatgaggcatcctagaagggaaatgtattgggaagtctctgacaccgatcagaacctggttagagatgcaatcagaagggacagatttgaattgattttctcaaacctgcactttgcagataatggccacctagatcaaaaagataagtttacaaagttgagacctctcataaaacaaatgaataaaaatttcctcttgtatgctcccctggaagaatactattgctttgataagtcaatgtgtgaatgctttgatagtgaccaattcctgaatggaaagcctattagaattggctataaaatttggtgtggtacaaccacacagggttatctggtttggtttgaaccctatcaagaagaatcaactatgaaggtagatgaggatcctgatcttgggttaggtggaaatctagtgatgaacttcgctgatgttcttttagagagaggtcagtatccctatcacctgtgttttgatagcttctttacaagtgtcaaattgttgtcagccttgaaaaagaagggggtgagggcaacaggaacaattcgtgagaacaggaccgaaaaatgtccccttatgaatgtagaacatatgaaaaaaatgaagagagggtattttgatttccgaatagaagaaaacaatgagataattttgtgtcgttggtatggggatggcattatcagtctgtgctccaatgctgtgggcatagaaccagtcaatgaggtaagctgttgtgatgctgataacgaagaaatccctcagataagtcaaccatccatagtaaaagtgtatgatgaatgcaaggaaggtgtagctaaaatggatcaaattatttcgaaatacagggtgaggataagaagcaagaaatggtactcaattttggtgagctacatgattgatgtagccatgaacaatgcatggcaactacacagagcctgtaacccaggtgcttctctagaccccttggattttcggagatttgttgcacatttctacttggaacacaatgctcatctgtcagattagggtacataaaatggacatagtgcagacattaataagacatagaaaaataataattatacatgctgttgtaccctcccaaagtaaatctgatatatgtaatgaagttattaaataatacttttaaaaatcagacatttatatagagtttcaaagactattgtaacaagtaatgttaaaaattgtctgtgagaatgttgaactgtagtacctttctctatgtcaagttttgtgtcagacatgggaaatcatgtatttgttcaattg

SEQ ID NO: 1625 - DNA, 5112 bp, Homo sapiens
atcttgtcttgttcccgaagaagtagaagcatcgaaagcgttggagaggtgttaccggaacggcggcgacaagggtgttcccgaactagagtggggcatacataatcttgctgctatgcttcgaagctgtagtctgaatcaacctaagttttaaacagaaggtgaacctctgagatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaactcttgcaccttaattttatggttttaatctaaggaacgtacttttataaaaaggcagctggaattttgtataacaggttttaaaggtaccttctctcacctcccccaaagaaaatggtttttacttaatagtttgtcaaagtttgtaaattgtacccatggacttttgccagattccaactttaagggtatgaaagagggctagaaatagacctttacttttcatttggaagtatttgacaactttctaaacttttcttcctattttggggattttcaagtaatatattctctgtgtgtataacgtgtggttcactcctgtaaaatgaaattgctggaatcaatcaagccagtgcaccagtagagttatttgtaaggaacgattgtgtttgacagtaatagtcaagtctggaactatattctacagtcacccacttctgttttagaagcattttgaaacactttttggggttatagaaataagactcatgattcaatatatttatttatatttttaaagtataatatgacctcaaatcaatggaggaatgctgtattatgcaggtttgtgtcaatttcctgacattaaaattgtctgattttgtccgtttcttaaaattatgattagtgagtggtctaacagtttaaggcattgataacttacaagtagaatggggctctcaaagcattttaactcagttgctttagggtccatttttttatgtaatcacttactcagtgataaatgaatctctgaaaacaaatgcttttacattttaatttaaaaagaaaacaggtgcaggccacagaaaagttttaaagtatgccttcttaccagcaatagttcattttaaaaatcatgccagatttttgccaagatcagtgtttcctcaacatgaagatagaaatagatttgtatagtgtgctcttgtacctctacatagattattatataattttgagcagttacacatttatctaaaggaaataaatcaactgtgaataaatgcatgtttaccaaaatggctgtttacagtgcatttagttctgatatttataaagatgacatttcacagaataactttaaaatagtttgaaattctatatagtttagacatcgatcacatctggagacaaaataaaatgtgcaatattttttatgtaggcgagctaacacagtgtacctaattgcagaattatctgattaatttgtaatagataagttgtataacattttcatatcttaaaatgttttttagatcaatcttgaagtgaaatattttcaaaataaaattctacagaaaaattctgttggctatgatatgcacatttttgggcaagttatgaactagagccaaaagtagtatttgacagttttatttactctgccgtaatttgcaagcttatcagttaagtctgtagtttttttaaaagccgtcatgatatttgtgattattagtacataaaccagtgttataatttgatatttgggtttttcagacttttagtggcagatttagagaattctttattttcttgacatgtgatatagtatttatttaccttgagtggtaaggttttataaggtagggtttccatgatttaggatgtgaatgcaaaaacttacacataagttaattagatgtataatttggttatgaaatcttttctaaaataataccaccagaaaattaacagatcaaatttttgagacaatccttggtctggattggttaatgaaaatgtcttgtttaagaggttctattaaaaaatatttctagtgtattagtcataattgtttttgtggagtgggggtaaaccacaccattaagggaataaaatgtaatttgaaagaggtgattataagatttgtttcaggccccaaaatataaataaaaattggtgtggaatct

SEQ ID NO: 1626 - DNA, 3142 bp, Homo sapiens
ccgggtgagacaaatcgggcgccatcttgtcttgttcccgaagaagtagaagcatcgaaagcgttggagaggtgttaccggaacggcggcgacaagggtgttcccgaactagagtggatagaaaatcaagtatattttaaaagaagggatgtgggatcaaggaggacagccttggcagcagtggcccttgaaccagcaacaatggatgcagtcattccagcaccaacaggatccaagccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccagaacaatcacaactttggtggaccacccgataattttgcagtggggccagtgaaccagtttgactatcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattgacgcagtaaaacgcaggactcttcccgcttggattcgcgaaggtcttgaaaaaatggaacgtgaaaagcagaagaaattggagaaagaaagaatggaacaacaacgttcacaattgtccaaaaaagaaaaaaaggccacagaagatgctgaaggaggggatggccctcgtttacctcagagaagtaaatttgatagtgatgaggaagaagaagacactgaaaatgttgaggctgcaagtagtgggaaagtcaccagaagtccatccccagttcctcaagaagagcacagtgaccctgagatgactgaagaggagaaagagtatcaaatgatgttgctgacaaaaatgcttctaacagaaattctgctggatgtcacagatgaagaaatttattacgtagccaaagatgcacaccgcaaagcaacgaaagctcctgcaaaacagctggcacagtccagtgcactggcttccctcactggactcggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaagaaggctaagaagcctaaacatagtcgatcgcgatccgtggagaaatctcaaaggtctggtaagaaggcaagccgcaaacacaagtctaagtcccgatcaaggtagtatactttttaaagtattttgtctgatttttaaaaaaaattgactgaatttattcaaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaaccagaatcttttttttttttaatctgtaaataggtgtactttttccaatgctgctccaagttacttaataggatttctttgtattacgtttttttcaaaaaatatagtgcataataagactataaacatgccattctctttcagctgtaatgttcttaaaattattcttgaatgtactgtgatgtcaataaagctctttagttcatttttgttaaa

SEQ ID NO: 1627 - DNA, 6254 bp, Homo sapiens
ggaaatatcgaaggaaccgactttgaactccagagggatcttttctttggaggttccccgatgcagccctcaagatgcatccgcactccacacctaggaattgcccgcgcccatagagggcaggagtgcggccctttgtactggccaagagtcagcgaatagagaatttgcagcccagaggcaatgggttatttccctgtcggggtgggccccagccgatttctgcacctttttgggtatccaggcataaccctcactatgtttcactgactcctgcgtttgcaaagtcccttaaggtagaatgaccctattttctgaaccagctcgtggacagaacctttgaatttggaaaatccagagatggagtccacagcctaccctctcaatttgagcctgaaagaagaggaagaggaagaagagattcagagccgggaactagaggacggcccggcagacatgcagaaagtacgaatctgctctgagggcggatgggtaccggccctatttgatgaggtggccatatatttttccgatgaggaatgggaagttttgacggagcaacaaaaggccctctaccgggaagtcatgaggatgaattatgaaactgtcctgtccctggaattcccattccctaagccagacatgatcacccgtttggaaggggaggaggagtctcagaattctgacgagtggcagctccaaggaggcacctctgcagaaaatgaagaatctgacgtaaagcctccagactggccaaacccaatgaatgctacctcccagtttcctcagcctcagcactttgacagctttggcctccgtctgcctcgggatatcacagagctgcccgagtggagtgaggggtaccccttctacatggccatgggcttcccagggtatgacctctcggctgatgacatagctgggaagtttcagttcagccggggcatgcgccgcagttacgacgcagggttcaagctgatggtagtggaatatgctgagagtaccaacaactgccaggctgccaagcagtttggagtattggaaaaaaacgttcgagactggcgcaaagtgaagccacagcttcaaaacgcccacgccatgcggcgggcattccgaggccccaagaatgggaggtttgctctggtggaccagcgtgtggccgaatatgtcagatacatgcaggccaaaggggaccccatcacccgggaggcgatgcagctgaaagctctcgaaatcgcccaggaaatgaacattccagagaaagggttcaaggcaagcttgggttggtgtcgaagaatgatgagaaggtatgacctgtctctgaggcataaagtgcccgtgccccagcacctgccggaagacctgactgagaaactcgtcacttaccagcgcagtgtcctggctctgcgcagggcgcatgactatgaggtagctcagatggggaatgcagatgagacgcccatttgtttagaggtgccatcacgggtaactgttgataaccagggcgaaaagcctgtcttggtcaagacaccaggcagggaaaaactgaaaatcacagcaatgcttggtgtcttggctgatgggaggaagttaccaccgtacatcattttgaggggaacatatatccccccggggaagtttcccagtgggatggaaattcgctgccaccggtatgggtggatgactgaagacttgatgcaggactggttggaagtggtgtggagacggaggacaggagcagtgcccaagcagcgagggatgctgatcttgaatggcttccggggccatgccacagattccgtgaagaactccatggaaagcatgaacactgacatggtgatcatcccagggggtctgacctcacagcttcaggtgctggatgtcgtggtctacaagccactgaatgacagtgtgcgggcccagtactccaactggcttctggctgggaacctggcgctgagcccaaccgggaatgctaagaagccacccctgggcctctttctggagtgggtcatggtcgcgtggaatagcatctcaagtgagtccatcgtccaagggttcaagaagtgccatatctccagcaacttggaggaggaagacgatgtcctgtgggaaatcgagagtgagttgccaggaggaggagaaccaccaaaagattgtgacaccgaaagcatggctgagagcaactgaagggaaagggaaaggtaaccactcaggagtagatactcagtgcctttgctgacatgtctgtgttctacaaacaccttctctccattatttttctgtttttaagttcccttagagcctacagtgcagtagtgtagatcaggggtccccaacccccaggtcacggaccatactggtccatggcctgtcaggaactgggctgcacagcaggaggtgagcggcaggtgagcaagcattaccacctgagctccgcccgctgtcacagcagcggcattagattctcataggagcacaaaccctgttgtgaactgcacatgtgagggatctaggttgcaggctcctcaatgcctgaggatctgaggcggaacagtttcatcccaaagccatcctaccacccactaccccgcacttcctgggtccctgcaaaaattgtcttccatgaaaccagtccctggtgccagaaaagttggggactgctggtatagataacagaccattagcattttctcctttatatgaaacatttattatttgatttatttgtgtctattttgctctgtggcttggacccagaaacacttgtataataggtgaaatgaacaaagaatgagctgccagaacatctgagagctgtaaagttaaaattatttggacccaaagaagcatagtctgacgttgttcagttcacacaaaattttgtctgaaaagccaacttttttctttcccttttaaattatgctgaacatttagggccagtatgtgtaactgacatgctgggacagttgtactcacttttgctggcctgtaggactgtgacatagggagaacactaagtgtgtcctccgggcctcgggtctcagtcctggagctatctacagtatgttaccagcgagtaagaataatagcttctacttgcttttccctacagagttcaggagttttaaaacgtcatcttagtctcattatgaccttcacatgggctatgacaataatttcctgtagtcagcagatgtctgaaggaagatattttttaactgaatctttacaccaaaaaaagaaaataaaacggtgcgtatctaggactctagtgagggctgaggacaataggcctggaattttctgggttgagtacacaagaagaacagctttcaaaggaaagtaggaatggaggcctaactgagacaacactagtgaaatgaccccacccacctacacctccagagaggaggaggatgagcatgtacagcaggggggacacccacaaagaacaaacaattcatttacctgttcgttctcatctccctaattataaattaaattgatcctccagacagtgttttatatgaaggaagaagccaccttttttacagaggacctgaaaccgtcaaccatcttcacacattctttttctttcttttaaagtataattaggtatttccatcttccttgcttttttctccaaatgaaatgctaatgggagccttattttacccacttcagctatataagtccatctgtgtttcaaagagtgacttatgtctcctgccttgcttccaaattaaattgtactcatattgctgaatcccattgtaattctgggatccctggaattacaatggagcaagaagttcttactattacattcaaaatcaccaaaattgcttttttttcccccttgggtcctccttgctttgagaaaccccatgaatccagcctcccttttctgctgacccttatattgcctgcattggatatcaaactgaattacattgagtttccatcttttcttcatttaccttttgcttttccctctccttgttagataacatttttgtgcacttttaatttcctaagctccttaccacctcagggacatgattaaaaacttccagaagaggaaaggagaaaaagctatgctaagttgcatttatgaatgttggcctgtaatattggtcatgagcttttgctcttctagtctgccacaattctctctgcagctcctgaggaagtgatgggagtagacagattcacagtgaacaagagatttgggagaccaagtgggcataaaactacgtcttggcctctatttggaaatctgaatgatggaattattatgtttgttaaaagttataccaaaaagccaagggttaattcatttaggttctctctgttttccagcaaatggaactctgatttaaacagctggggatgaaattcctcaagatgattattcctgaaagtgtggatgcgctggatgcgcagggaacatcaggaaaaggccacggggctctgaacagccccggtccagacagcagcctgtacatccatcccaggacacagcccagcccctccccacaccatacaaggtatcagaaaagtctaggacctatcatttcatcagagacatgatcagaaaagaaactgcttctgccccatttcttgttttggagattactccatctgtccatcaaaagaaacctgtaaatatgaaagaacaaaggttatttcctggagaaaagacaatttattcaacaccaacgagggactcatcatatgggcacaactctggtgtccttctatggagaaaacctcaagtaaagttttattctgcctttgaaaatgcttccaaaagtagaccctgtccccacacaggtcaagactacagagaaggctttgtagaaatgtgtcacctatgtacacctgctacttacacatttcctcttttggaaaaatgagatacttagaataacaagaaaattaagacatactggcctggtgccagcagatggcttttctatagacaaactaggttagtgtggaagatataggttaaaataaactatgctgttttatttatcttcccaacctgattggcagctagacttttttagggtctcatttaatggccctgtttttttcattattatatttaatgatagggcaggatttcgtatgcaagctcttgtttctcaggctgcctgcagaagaagtcgctataaattatctgttgtctacatggtacaaggcccattgactcatctgatgcttgttttgttaatttctttaatatttttatcacggggcagtgggagggcttgggcttttagccacagctgttttaagacttctgatctcctgccctgcaggaataggtgggaagtcattgaatttttacactatagtaatttgcattcccacataagtttgagtgttacgaaaacattcctttaaagggatctgtgctacacaaaatatgccaggacctcacagacaaagccattgctagaaatgtcattccaatgatcagatctggaaacaggctgccataaccacttttccttcttgtagactcagctcacctgtatatttaaactgttcttggcatcttgaaacacctatttctactcaggtactcattgtcctgttactgattcacctttctgatccttttcaaccagttttcccccaaggggggaaattttacttaacctctagtatttgaacaactcaatatttgaattgttgccccatttgcttttacctgtactgtattcttggtcatctcaaatggcgtctaaacccagctactttgcattccagaagtttccattccctccaattccacctaatttttcatctgtcctagttactggctctttcttcatgtcttatttctcttgctttgggagcttaaaagattttacaagacctaattttgggttccttccttggagccatagttaccctgccaagaagagtagaaaatgggttcaactcctgtttcgctccaccaacacctctgtgagtctcatcatcagctgagcgatgatgccttacaggttgcatagcactggaactttcctagagtaacggctctgctgccagggtttctctgggctcattcttccactgacttaattatgatctatgcctaacagagccccagtacaactattttgcagaatggctgttaccctagaattactatagcacatattgagatatagttgtactccctagtagataggaactgaccccaacaataaactttgataataaagacaata

SEQ ID NO: 1628 - DNA, 5754 bp, Homo sapiens
accctccctcctcccaccacgtgtcctccccgctccctcccgaggggccgcgcgcacgggaggacggagaggcggaaaggatggcgctgtgacagccgggccggagccctcgcgtccccaccccgcgccctggccgctgggcccggcgagatggagtccacagcctaccctctcaatttgagcctgaaagaagaggaagaggaagaagagattcagagccgggaactagaggacggcccggcagacatgcagaaagtacgaatctgctctgagggcggatgggtaccggccctatttgatgaggtggccatatatttttccgatgaggaatgggaagttttgacggagcaacaaaaggccctctaccgggaagtcatgaggatgaattatgaaactgtcctgtccctggaattcccattccctaagccagacatgatcacccgtttggaaggggaggaggagtctcagaattctgacgagtggcagctccaaggaggcacctctgcagaaaatgaagaatctgacgtaaagcctccagactggccaaacccaatgaatgctacctcccagtttcctcagcctcagcactttgacagctttggcctccgtctgcctcgggatatcacagagctgcccgagtggagtgaggggtaccccttctacatggccatgggcttcccagggtatgacctctcggctgatgacatagctgggaagtttcagttcagccggggcatgcgccgcagttacgacgcagggttcaagctgatggtagtggaatatgctgagagtaccaacaactgccaggctgccaagcagtttggagtattggaaaaaaacgttcgagactggcgcaaagtgaagccacagcttcaaaacgcccacgccatgcggcgggcattccgaggccccaagaatgggaggtttgctctggtggaccagcgtgtggccgaatatgtcagatacatgcaggccaaaggggaccccatcacccgggaggcgatgcagctgaaagctctcgaaatcgcccaggaaatgaacattccagagaaagggttcaaggcaagcttgggttggtgtcgaagaatgatgagaaggtatgacctgtctctgaggcataaagtgcccgtgccccagcacctgccggaagacctgactgagaaactcgtcacttaccagcgcagtgtcctggctctgcgcagggcgcatgactatgaggtagctcagatggggaatgcagatgagacgcccatttgtttagaggtgccatcacgggtaactgttgataaccagggcgaaaagcctgtcttggtcaagacaccaggcagggaaaaactgaaaatcacagcaatgcttggtgtcttggctgatgggaggaagttaccaccgtacatcattttgaggggaacatatatccccccggggaagtttcccagtgggatggaaattcgctgccaccggtatgggtggatgactgaagacttgatgcaggactggttggaagtggtgtggagacggaggacaggagcagtgcccaagcagcgagggatgctgatcttgaatggcttccggggccatgccacagattccgtgaagaactccatggaaagcatgaacactgacatggtgatcatcccagggggtctgacctcacagcttcaggtgctggatgtcgtggtctacaagccactgaatgacagtgtgcgggcccagtactccaactggcttctggctgggaacctggcgctgagcccaaccgggaatgctaagaagccacccctgggcctctttctggagtgggtcatggtcgcgtggaatagcatctcaagtgagtccatcgtccaagggttcaagaagtgccatatctccagcaacttggaggaggaagacgatgtcctgtgggaaatcgagagtgagttgccaggaggaggagaaccaccaaaagattgtgacaccgaaagcatggctgagagcaactgaagggaaagggaaagcaaatggaactctgatttaaacagctggggatgaaattcctcaagatgattattcctgaaagtgtggatgcgctggatgcgcagggaacatcaggaaaaggccacggggctctgaacagccccggtccagacagcagcctgtacatccatcccaggacacagcccagcccctccccacaccatacaaggtatcagaaaagtctaggacctatcatttcatcagagacatgatcagaaaagaaactgcttctgccccatttcttgttttggagattactccatctgtccatcaaaagaaacctgtaaatatgaaagaacaaaggttatttcctggagaaaagacaatttattcaacaccaacgagggactcatcatatgggcacaactctggtgtccttctatggagaaaacctcaagtaaagttttattctgcctttgaaaatgcttccaaaagtagaccctgtccccacacaggtcaagactacagagaaggctttgtagaaatgtgtcacctatgtacacctgctacttacacatttcctcttttggaaaaatgagatacttagaataacaagaaaattaagacatactggcctggtgccagcagatggcttttctatagacaaactaggttagtgtggaagatataggttaaaataaactatgctgttttatttatcttcccaacctgattggcagctagacttttttagggtctcatttaatggccctgtttttttcattattatatttaatgatagggcaggatttcgtatgcaagctcttgtttctcaggctgcctgcagaagaagtcgctataaattatctgttgtctacatggtacaaggcccattgactcatctgatgcttgttttgttaatttctttaatatttttatcacggggcagtgggagggcttgggcttttagccacagctgttttaagacttctgatctcctgccctgcaggaataggtgggaagtcattgaatttttacactatagtaatttgcattcccacataagtttgagtgttacgaaaacattcctttaaagggatctgtgctacacaaaatatgccaggacctcacagacaaagccattgctagaaatgtcattccaatgatcagatctggaaacaggctgccataaccacttttccttcttgtagactcagctcacctgtatatttaaactgttcttggcatcttgaaacacctatttctactcaggtactcattgtcctgttactgattcacctttctgatccttttcaaccagttttcccccaaggggggaaattttacttaacctctagtatttgaacaactcaatatttgaattgttgccccatttgcttttacctgtactgtattcttggtcatctcaaatggcgtctaaacccagctactttgcattccagaagtttccattccctccaattccacctaatttttcatctgtcctagttactggctctttcttcatgtcttatttctcttgctttgggagcttaaaagattttacaagacctaattttgggttccttccttggagccatagttaccctgccaagaagagtagaaaatgggttcaactcctgtttcgctccaccaacacctctgtgagtctcatcatcagctgagcgatgatgccttacaggttgcatagcactggaactttcctagagtaacggctctgctgccagggtttctctgggctcattcttccactgacttaattatgatctatgcctaacagagccccagtacaactattttgcagaatggctgttaccctagaattactatagcacatattgagatatagttgtactccctagtagataggaactgaccccaacaataaactttgataataaagacaataggctatggtgattttatttctttacctattagcattgtgaaaagttacattcaaggtattggctacaccttattctccatccggtttggtaccaatatattacatctttcagtcaaaaagtgttcatgagatgcagtgtaagtaatattggtatctgtgaagacacagggaagaacgtgtgcagtggggcaagtttgacataaatagcttttttcctcagtcatgttttgtatgctctcagcagtggtacattaccaaaatcacatgaaagaaatcccataaagggatctgaattttaaatgaaagtatgatgaacccgcaagtcttaattatgcacttttaataaaattagtcctgacaatttacagtgcccataaagtagtagttgattctccaggaataatctggcagtgttatttttccttttcaacccatcagcattaaatgctgagccactctccaagtctgacccctagactaagcttccttactcttactcttcctcccagaggcattttggaatgagtcaaaggcatggtaggacacggcatttacctgtggtcatcacttcaggcaatggaaaggaaaagtgtttgtccttggttgatcagagaagtgggtgataagaacgtgctaaataacaaacctgcacacttgtacctctgaacctaaaatgttttttttttaattcagaacaacaaaagaacatgctaagcgagtcctcccacctgcctggtaaaatacagccagctttatcacacctggttttgcacagtgataaattcctgcaggaaaaaataagttttattctaagtctgaaattatatggtttccaacagctttttccctcgttaaaataattatttttctacatgatgcttgataataagcatttgtttcttaacctaattagagaagcgattgcactcgagtccccacagctggcagtggtgttacagatggaaccagcctttggtggacagagttcagatgtttcaggggctcttgtgaaaatgctaagtattactgtttctaccttactgccctgcactttaccccatcatctcccctccttagaaaatgatttcataggaaaattggcatggagagcagatagtagagtgtagacctgaaatacatgaggcaaaggcagtcttccagcattctatggtcccaccaggtgggtaggtgactaggaattcaggccaggtcctagagagtagtgagaagttttccagtttgcagtttcctctgtgctgtatgtacagccatacagcctatggaacctgacattgcagtgggcagcaggacacggtcaaggctcctagctgcctctccatctatggaactatgaaatttcacacatattccctaggcagcattaaggcccaggtatattgagtagtccaaaccaaaaaactatattcgagtatcagtttaaattcttccaagccctaaaaattcttacgtagtttctcacctaaaactaatggcttgtgccaagaactgaaactaagctattgatttttttttaagaagtcttaatctatacataagaaattacatacctggccaggtgcagtagttcaggcctgtaatcctaacaaacactctgggaggccaaggtgggcagactgcttgagctcaggagttcattaccagtctgggcaacatgataaaaccgtgtctttacaaaaaaaaaaaattttaaattagccgggcatggtggtgtgaatctgtagtcccagctacttaggaggttgcgatgggagaatcacctgagcccagaggtccagtctgcagtgagccatgatcacaccacagcactccagctggggtgacagagtgagaccctatctcaaaaagaaaag

SEQ ID NO: 1629 - DNA, 954 bp, Homo sapiens
tccgggccggaccctccctcctcccaccacgtgtcctccccgctccctcccgaggggccgcgcgcacgggaggacggagaggcggaaaggatggcgctgtgacagccgggccggagccctcgcgtccccaccccgcgccctggccgctgggcccggcggtgagtgcgcgcgggcgggggcggcggcggcgcggcccctcccccgggtcccgggcggctgggccgcggcagaggcgggggcgccgaggctgcgccgccgccgccgccgcctttgttgcgggcccgccggggaggcgggcggcgccggctctcgccgcccggcagagatggagtccacagcctaccctctcaatttgagcctgaaagaagaggaagaggaagaagagattcagagccgggaactagaggacggcccggcagacatgcagaaagtacgaatctgctctgagggcggatgggtaccggccctatttgatgaggtggccatatatttttccgatgaggaatgggaagttttgacggagcaacaaaaggccctctaccgggaagtcatgaggatgaattatgaaactgtcctgtccctggaattcccattccctaagccagacatgatcacccgtttggaaggggaggaggagtctcagaattctgacgagtggcagctccaaggaggcacctctgcagaaaatgaagaatctgacgtaaagcctccagactggccaaacccaatgaatgctacctcccagtttcctcagcctcagcactttgacagctttggcctccgtctgcctcgggatatcacagagctgcccgagtggagtgaggggtaccccttctacatggccatgggcttcccagggtatgacctctcggctgatgacatagctgggaagtttcagttcagccggggcatgcgccgcagttacgacgcagggttcaagctgatggtagtgga

SEQ ID NO: 1630 - DNA, 2168 bp, Homo sapiens
agctccgggccggaccctccctcctcccaccacgtgtcctccccgctccctcccgaggggccgcgcgcacgggaggacggagaggcggaaaggatggcgctgtgacagccgggccggagccctcgcgtccccaccccgcgccctggccgctgggcccggcgagatggagtccacagcctaccctctcaatttgagcctgaaagaagaggaagaggaagaagagattcagagccgggaactagaggacggcccggcagacatgcagaaagtacgaatctgctctgagggcggatggaattcccattccctaagccagacatgatcacccgtttggaaggggaggaggagtctcagaattctgacgagtggcagctccaaggaggcacctctgcagaaaatgaagaatctgacgtaaagcctccagactggccaaacccaatgaatgctacctcccagtttcctcagcctcagcactttgacagctttggcctccgtctgcctcgggatatcacagagctgcccgagtggagtgaggggtaccccttctacatggccatgggcttcccagggtatgacctctcggctgatgacatagctgggaagtttcagttcagccggggcatgcgccgcagttacgacgcagggttcaagctgatggtagtggaatatgctgagagtaccaacaactgccaggctgccaagcagtttggagtattggaaaaaaacgttcgagactggcgcaaagtgaagccacagcttcaaaacgcccacgccatgcggcgggcattccgaggccccaagaatgggaggtttgctctggtggaccagcgtgtggccgaatatgtcagatacatgcaggccaaaggggaccccatcacccgggaggcgatgcagctgaaagctctcgaaatcgcccaggaaatgaacattccagagaaagggttcaaggcaagcttgggttggtgtcgaagaatgatgagaaggtatgacctgtctctgaggcataaagtgcccgtgccccagcacctgccggaagacctgactgagaaactcgtcacttaccagcgcagtgtcctggctctgcgcagggcgcatgactatgaggtagctcagatggggaatgcagatgagacgcccatttgtttagaggtgccatcacgggtaactgttgataaccagggcgaaaagcctgtcttggtcaagacaccaggcagggaaaaactgaaaatcacagcaatgcttggtgtcttggctgatgggaggaagttaccaccgtacatcattttgaggggaacatatatccccccggggaagtttcccagtgggatggaaattcgctgccaccggtatgggtggatgactgaagacttgatgcaggactggttggaagtggtgtggagacggaggacaggagcagtgcccaagcagcgagggatgctgatcttgaatggcttccggggccatgccacagattccgtgaagaactccatggaaagcatgaacactgacatggtgatcatcccagggggtctgacctcacagcttcaggtgctggatgtcgtggtctacaagccactgaatgacagtgtgcgggcccagtactccaactggcttctggctgggaacctggcgctgagcccaaccgggaatgctaagaagccacccctgggcctctttctggagtgggtcatggtcgcgtggaatagcatctcaagtgagtccatcgtccaagggttcaagaagtgccatatctccagcaacttggaggaggaagacgatgtcctgtgggaaatcgagagtgagttgccaggaggaggagaaccaccaaaagattgtgacaccgaaagcatggctgagagcaactgaagggaaagggaaaggtaaccactcaggagtagatactcagtgcctttgctgacatgtctgtgttctacaaacaccttctctccattatttttctgtttttaagttcccttagagcctacagtgcagtagtgtagatcaggggtccccaacccccaggtcacggaccatactggtccatggcctgtcaggaactgggctgcacagcaggaggtgagcggcaggtgagcaagcattaccacctgagctccgcccgctgtcacagcagcggcattagattctcataggagcacaaaccctgttgt

SEQ ID NO: 1631 - DNA, 4263 bp, Homo sapiens
ctgagacctgcgagaggcaggctgggaagcggcgccatattggcgtcggccgcgctgtattgtcataaatagagccggttttgtggtgttttcactactcggttggatgcctcagccatagtaagtgggaaagtgagcgagcaagcgagctactagcgaccggaggaaagtgaacagggggagaagggaacagcaagaacaggactccagagcgataaacactcgctggagagggagacgcaggaagcgatgaaagagatgtctgcaaacaccgtgctggacagccagcgtcaacaaaagcattatggaattacctccccaattagtttggcatctcctaaagaaattgatcatatttacacacagaaattaattgacgccatgaaaccatttggagtgtttgaagatgaggaagaattgaaccacaggctggtggttcttggtaaattgaacaatttagtaaaagaatggatttctgatgtcagcgagagtaagaacctcccaccttctgttgtggctactgttggtggtaaaattttcacatttggatcctataggcttggagtacacaccaaaggagctgacattgatgcactttgtgtagctccaagacatgtggaaagatctgatttttttcagtctttttttgaaaaattgaaacatcaagatggcattagaaacttaagagctgtagaagatgcctttgtacctgttataaaatttgaatttgatggtattgaaattgatctagtctttgcaagactggcaatacaaaccatatcagataatttagatctaagagacgactctcgcctgagaagccttgatataaggtgtattcgcagcttaaatggttgtagagttactgatgaaattttgcatttagtgccaaataaagaaacttttagactcaccctaagagctgtcaaattatgggcaaaacgacgtggtatttattccaacatgctaggattccttggtggtgtctcctgggcaatgctagttgcaagaacttgccaattgtatccaaatgcagcagcatctactttagttcataagttctttttagttttttccaagtgggaatggccaaatcctgtgctgctgaagcaaccagaagaaagcaatttgaatttgcctgtctgggatcctcgggtaaatccatcagataggtatcatctcatgcccataatcacccctgcctacccacaacagaattctacgtataatgtgtccacatcaactcgaacagtaatggtagaagaatttaaacaaggtcttgcagtcacagatgaaattcttcaaggaaagtcagattggtccaaactacttgagccaccgaatttctttcaaaagtatagacattatatagtattgactgccagcgcatcaacagaagaaaaccatctagagtgggttggattagtagaatctaaaatccgtgtacttgttggaaacttggaacggaatgaatttattactcttgcccatgtgaatccccagtcattcccagggaataaggaacatcataaagacaacaattacgtatcaatgtggttccttgggataatttttcggagagtagaaaatgcagaaagtgtcaacatagacttgacatatgatatacagtcatttactgatacagtgtacagacaggcaaacaatataaatatgctaaaggagggaatgaaaattgaagcaactcatgtaaagaaaaaacaacttcaccactaccttcctgcagaaattcttcaaaagaagaaaaagcaaagtctctctgatgtcaatcgaagctcgggcggacttcaatccaaaagattgtctctggatagcagttgtctggatagctccagagacactgataatggaacaccttttaattctccagcgtccaagtctgatagcccttctgtaggagaaacagaaaggaatagtgctgagcctgctgctgtaattgtggagaagccactgagtgtaccaccagcccaaggactttccattccagtgattggcgcaaaagttgactctacagtaaaaactgtatcaccccccactgtgtgtaccattcctaccgtagtaggacgaaatgtcattcctagaatcacaacacctcacaaccctgcccagggacaaccgcatctgaatggaatgtcaaatataactaagactgttacacctaagagatcccattccccatccatagatgggactcctaagaggttgaaagacgtagaaaagtttattcgacttgaatcaacatttaaggacccccgcactgctgaagaaagaaaaagaaaatcagtggatgccattggaggagaatctatgcctattccaactattgatacatcacgcaaaaagagactacccagtaaagaactaccagattcatcatctccagttccagcaaacaacatccgtgtcatcaaaaattccattcgactgacccttaatcggtaaaagcagtgcctcctcacttaagtgaacaagcaatcatttagtggcatagatgcagccacttgttttttaaatagaagtggctgtcatacgtgaaataaggtgaaagtgacagccttcagtctaataaccttgaagtggtttttgaactgtcaaactttgacctgtagatgctgtagcattctctcactgattgctacatacacttctctgaggatcacctgctgtcaaattgccatctacagtattacagctttgcatttgggggttttactgccttaactttcaatgcttgttatgggaaccagttcttagccacttggacactgataacaagtcctgaactccttttttgttttgttttttgtgtttttctttttttgtcttatgttgtaatcattgtatagagctaaaaaaattgaaaacaaacaaaaaaattgtcttgtattttccaaatgttaatacatttactttagcattgaagccactttgaaacctgagataaatgaatgtgaggtatcttttctgctttcctcatttgtgtagatgtactgtctgttctgttgatttaaattatttttttccagattggcacatgaaatatttaaacttttttgtgtgcctttctgtccaaatgttgcatagttaccagggaagattagtccagtgattacataagagttgggcaccataaattctctatattttgcctcccatggaggcctttgaaatgcatctttattaaaaatcaaaatataaccaggatactgaaagtcagtatatgaatggtaaaattgttacatatcctatttcatgccattcttgttagttgactggtattttttactgaggagcaactcattccagcatcaacaataagataacctttaagtatggcacacttgtatttttgaggtgtaaaattaacttggcatgataattcctgatcattatttaccccacaacttcaaatagtttcttcacggactaggcatgcagaaataagcagtggattttattgaaacctaaaggcattttgaatgacattgttaccaaccattaattggctcaggacctttgtaatttttatttaactatatgagttgtctttttttacgctgcttttttcaatgcatttcttaatattttttaagtttcatgaatgcatgctcagtttattaaaatccataaccatgtaattcttgtaatatgttgattcagtgttttgtaaatgaagtcgtatgtattttcagagtatttttgtatgtactgtaagataccatcttttcaaagagaaacgtttaaaacctttattgtctctccttagtctaattttttaaatatggattatgcttgaattactatatttaaaatgaaaatgtatagattacacagccaggaatgctagtatctaccaccttctttagatttcactcagcatttagtaggtccagtaggaaaaacccaaaatggtacattgagtagtgtggggaagacacctcgtgtattataggactcacgggatgccatctagcaagtggagaaatagcagtccattttctcttgcaagccctttaccattgagttgaaattcttgaattgccagagagccgtatcctccaggtcccactcctgttcattgccccttaggtctccaaaatgtaaattctaatgtttaccttgtaccatggaaaacatgaaaagagtcttagaagtaaagaacaacaaggaaaaaaatgtttgttctattattccctttttatatagcagcaaaagataagaataaaatcacataaccaagttgaa

SEQ ID NO: 1632 - DNA, 4177 bp, Homo sapiens
aggctgggaagcggcgccatattggcgtcggccgcgctgtattgtcataaatagagccggttttgtggtgttttcactactcggttggatgcctcagccatagtaagtgggaaagtgagcgagcaagcgagctactagcgaccggaggaaagtgaacagggggagaagggaacagcaagaacaggactccagagcgataaacactcgctggagagggagacgcaggaagcgatgaaagagatgtctgcaaacaccgtgctggacagccagcgtcaacaaaagcattatggaattacctccccaattagtttggcatctcctaaagaaattgatcatatttacacacagaaattaattgacgccatgaaaccatttggagtgtttgaagatgaggaagaattgaaccacaggctggtggttcttggtaaattgaacaatttagtaaaagaatggatttctgatgtcagcgagagtaagaacctcccaccttctgttgtggctactgttggtggtaaaattttcacatttggatcctataggcttggagtacacaccaaaggagctgacattgatgcactttgtgtagctccaagacatgtggaaagatctgatttttttcagtctttttttgaaaaattgaaacatcaagatggcattagaaacttaagagctgtagaagatgcctttgtacctgttataaaatttgaatttgatggtattgaaattgatctagtctttgcaagactggcaatacaaaccatatcagataatttagatctaagagacgactctcgcctgagaagccttgatataaggtgtattcgcagcttaaatggttgtagagttactgatgaaattttgcatttagtgccaaataaagaaacttttagactcaccctaagagctgtcaaattatgggcaaaacgacgtggtatttattccaacatgctaggattccttggtggtgtctcctgggcaatgctagttgcaagaacttgccaattgtatccaaatgcagcagcatctactttagttcataagttctttttagttttttccaagtgggaatggccaaatcctgtgctgctgaagcaaccagaagaaagcaatttgaatttgcctgtctgggatcctcgggtaaatccatcagataggtatcatctcatgcccataatcacccctgcctacccacaacagaattctacgtataatgtgtccacatcaactcgaacagtaatggtagaagaatttaaacaaggtcttgcagtcacagatgaaattcttcaaggaaagtcagattggtccaaactacttgagccaccgaatttctttcaaaagtatagacattatatagtattgactgccagcgcatcaacagaagaaaaccatctagagtgggttggattagtagaatctaaaatccgtgtacttgttggaaacttggaacggaatgaatttattactcttgcccatgtgaatccccagtcattcccagggaataaggaacatcataaagacaacaattacgtatcaatgtggttccttgggataatttttcggagagtagaaaatgcagaaagtgtcaacatagacttgacatatgatatacagtcatttactgatacagtgtacagacaggcaaacaatataaatatgctaaaggagggaatgaaaattgaagcaactcatgtaaagaaaaaacaacttcaccactaccttcctgcagaaattcttcaaaagaagaaaaagcaaagtctctctgatgtcaatcgaagctcgggcggacttcaatccaaaagattgtctctggatagcagttgtctggatagctccagagacactgataatggaacaccttttaattctccagcgtccaagtctgatagcccttctgtaggagaaacagaaaggaatagtgctgagcctgctgctgtaattgtggagaagccactgagtgtaccaccagcccaaggactttccattccagtgattggcgcaaaagttgactctacagtaaaaactgtatcaccccccactgtgtgtaccattcctaccgtagtaggacgaaatgtcattcctagaatcacaacacctcacaaccctgcccagggacaaccgcatctgaatggaatgtcaaatataactaagactgttacacctaagagatcccattccccatccatagatgggactcctaagaggttgaaagacgtagaaaaggatgccattggaggagaatctatgcctattccaactattgatacatcacgcaaaaagagactacccagtaaagaactaccagattcatcatctccagttccagcaaacaacatccgtgtcatcaaaaattccattcgactgacccttaatcggtaaaagcagtgcctcctcacttaagtgaacaagcaatcatttagtggcatagatgcagccacttgttttttaaatagaagtggctgtcatacgtgaaataaggtgaaagtgacagccttcagtctaataaccttgaagtggtttttgaactgtcaaactttgacctgtagatgctgtagcattctctcactgattgctacatacacttctctgaggatcacctgctgtcaaattgccatctacagtattacagctttgcatttgggggttttactgccttaactttcaatgcttgttatgggaaccagttcttagccacttggacactgataacaagtcctgaactccttttttgttttgttttttgtgtttttctttttttgtcttatgttgtaatcattgtatagagctaaaaaaattgaaaacaaacaaaaaaattgtcttgtattttccaaatgttaatacatttactttagcattgaagccactttgaaacctgagataaatgaatgtgaggtatcttttctgctttcctcatttgtgtagatgtactgtctgttctgttgatttaaattatttttttccagattggcacatgaaatatttaaacttttttgtgtgcctttctgtccaaatgttgcatagttaccagggaagattagtccagtgattacataagagttgggcaccataaattctctatattttgcctcccatggaggcctttgaaatgcatctttattaaaaatcaaaatataaccaggatactgaaagtcagtatatgaatggtaaaattgttacatatcctatttcatgccattcttgttagttgactggtattttttactgaggagcaactcattccagcatcaacaataagataacctttaagtatggcacacttgtatttttgaggtgtaaaattaacttggcatgataattcctgatcattatttaccccacaacttcaaatagtttcttcacggactaggcatgcagaaataagcagtggattttattgaaacctaaaggcattttgaatgacattgttaccaaccattaattggctcaggacctttgtaatttttatttaactatatgagttgtctttttttacgctgcttttttcaatgcatttcttaatattttttaagtttcatgaatgcatgctcagtttattaaaatccataaccatgtaattcttgtaatatgttgattcagtgttttgtaaatgaagtcgtatgtattttcagagtatttttgtatgtactgtaagataccatcttttcaaagagaaacgtttaaaacctttattgtctctccttagtctaattttttaaatatggattatgcttgaattactatatttaaaatgaaaatgtatagattacacagccaggaatgctagtatctaccaccttctttagatttcactcagcatttagtaggtccagtaggaaaaacccaaaatggtacattgagtagtgtggggaagacacctcgtgtattataggactcacgggatgccatctagcaagtggagaaatagcagtccattttctcttgcaagccctttaccattgagttgaaattcttgaattgccagagagccgtatcctccaggtcccactcctgttcattgccccttaggtctccaaaatgtaaattctaatgtttaccttgtaccatggaaaacatgaaaagagtcttagaagtaaagaacaacaaggaaaaaaatgtttgttctattattccctttttatatagcagcaaaagataagaataaaatcacataaccaagttg

SEQ ID NO: 1633 - DNA, 6074 bp, Homo sapiens
cgaacagtaatggtagaagaatttaaacaaggtcttgcagtcacagatgaaattcttcaaggaaagtcagattggtccaaactacttgagccaccgaatttctttcaaaagtatagacattatatagtattgactgccagcgcatcaacagaagaaaaccatctagagtgggttggattagtagaatctaaaatccgtgtacttgttggaaacttggaacggaatgaatttattactcttgcccatgtgaatccccagtcattcccagggaataaggaacatcataaagacaacaattacgtatcaatgtggttccttgggataatttttcggagagtagaaaatgcagaaagtgtcaacatagacttgacatatgatatacagtcatttactgatacagtgtacagacaggcaaacaatataaatatgctaaaggagggaatgaaaattgaagcaactcatgtaaagaaaaaacaacttcaccactaccttcctgcagaaattcttcaaaagaagaaaaagcaaagtctctctgatgtcaatcgaagctcgggcggacttcaatccaaaagattgtctctggatagcagttgtctggatagctccagagacactgataatggaacaccttttaattctccagcgtccaagtctgatagcccttctgtaggagaaacagaaaggaatagtgctgagcctgctgctgtaattgtggagaagccactgagtgtaccaccagcccaaggactttccattccagtgattggcgcaaaagttgactctacagtaaaaactgtatcaccccccactgtgtgtaccattcctaccgtagtaggacgaaatgtcattcctagaatcacaacacctcacaaccctgcccagggacaaccgcatctgaatggaatgtcaaatataactaagactgttacacctaagagatcccattccccatccatagatgggactcctaagaggttgaaagacgtagaaaaggatgccattggaggagaatctatgcctattccaactattgatacatcacgcaaaaagagactacccagtaaagaactaccagattcatcatctccagttccagcaaacaacatccgtgtcatcaaaaattccattcgactgacccttaatcggtaaaagcagtgcctcctcacttaagtgaacaagcaatcatttagtggcatagatgcagccacttgttttttaaatagaagtggctgtcatacgtgaaataaggtgaaagtgacagccttcagtctaataaccttgaagtggtttttgaactgtcaaactttgacctgtagatgctgtagcattctctcactgattgctacatacacttctctgaggatcacctgctgtcaaattgccatctacagtattacagctttgcatttgggggttttactgccttaactttcaatgcttgttatgggaaccagttcttagccacttggacactgataacaagtcctgaactccttttttgttttgttttttgtgtttttctttttttgtcttatgttgtaatcattgtatagagctaaaaaaattgaaaacaaacaaaaaaattgtcttgtattttccaaatgttaatacatttactttagcattgaagccactttgaaacctgagataaatgaatgtgaggtatcttttctgctttcctcatttgtgtagatgtactgtctgttctgttgatttaaattatttttttccagattggcacatgaaatatttaaacttttttgtgtgcctttctgtccaaatgttgcatagttaccagggaagattagtccagtgattacataagagttgggcaccataaattctctatattttgcctcccatggaggcctttgaaatgcatctttattaaaaatcaaaatataaccaggatactgaaagtcagtatatgaatggtaaaattgttacatatcctatttcatgccattcttgttagttgactggtattttttactgaggagcaactcattccagcatcaacaataagataacctttaagtatggcacacttgtatttttgaggtgtaaaattaacttggcatgataattcctgatcattatttaccccacaacttcaaatagtttcttcacggactaggcatgcagaaataagcagtggattttattgaaacctaaaggcattttgaatgacattgttaccaaccattaattggctcaggacctttgtaatttttatttaactatatgagttgtctttttttacgctgcttttttcaatgcatttcttaatattttttaagtttcatgaatgcatgctcagtttattaaaatccataaccatgtaattcttgtaatatgttgattcagtgttttgtaaatgaagtcgtatgtattttcagagtatttttgtatgtactgtaagataccatcttttcaaagagaaacgtttaaaacctttattgtctctccttagtctaattttttaaatatggattatgcttgaattactatatttaaaatgaaaatgtatagattacacagccaggaatgctagtatctaccaccttctttagatttcactcagcatttagtaggtccagtaggaaaaacccaaaatggtacattgagtagtgtggggaagacacctcgtgtattataggactcacgggatgccatctagcaagtggagaaatagcagtccattttctcttgcaagccctttaccattgagttgaaattcttgaattgccagagagccgtatcctccaggtcccactcctgttcattgccccttaggtctccaaaatgtaaattctaatgtttaccttgtaccatggaaaacatgaaaagagtcttagaagtaaagaacaacaaggaaaaaaatgtttgttctattattccctttttatatagcagcaaaagataagaataaaatcacataaccaagttgaagcttccttggcaaagctgttgtcttagctgactctttccctttattcagatgttttgggattgttctacaaatagtctatttgagcaaaaatgaatgattatgaaagaaccgaagaattatcacctgacttcaacttttgaaagctttagtaaggaatttgattaaattttatatactggatgtgtatgcatttctgcatttcatatcttttgcttttaaatcagccttcaaagtatctttaggaattccttctgtatccatgtttaccccattatgtaaatagatctttggagtgactagtggagtttttctttaataaggaagcaacaagtctaaccttgtactataggataggcatttattttagattaaggagcccattcaacatgtcaatgagtcaacattagagtcctcaaagatagcattcttcaacctgtttggtaactgaggagttgataaaatacttttgagatggtggggtttgtcagaaataaaatattttctatcctgaccagtaggtagaactttgagtacatttcgttaacttggtgggaagcttccattgtactagttccaagtaaaaaaggagaaagtatgatctgggattttgtgttatgatgagaggcactaagtacatgtgtttgttttgttttgttttgttttgttttgttttgtttgagacagagttttgctcttgttgcccaggctggagtgcagtagcccaatctcggctcactgcaaccttcacctcccgagttcaagctattctcttgcctcagcctcccaagtagctgggattacaggcacccaccacctcgcccagctaatttttgtatttttagtacagacagcgtttcaccatgttggccaggctggtctcgaacttgtgacctcaggtgatccacctgcctcggcgtcccaaagtgctgggattacaggcgtgaaccaccgcacccggccgtgtttgttttcaagtgtgaaaaaatacctagaagtatattttatgaagtcaaataatctgttcttcagtatatagacacatgttcattttcacaagggcattacattttaatttgctcatttttcagtagctctggagaatatgtatgaaaggaaaacaattacctgctagcttaaaccttagggacttaaccaattcaagatagaggtacatggcttaaaactttgtaaaactgggacaggagaattattatttttttattttttatttttttatgaagacaagagtttcactctgtcacccagtctggagcacagtggcatgatctcacctcactgcaacctctgcctcccgggttcaagtgattctcttgcctcagcctcccaagtagctggaattacaggcctgtgccatgcccagctaattttcgtattttcagtagaaatgggatttcaccatgttggccagggtggtcttgaactcctcacctcaagtgatctggctgcttcggccaccctaagtgctgggattacaggcataagctactgtgcccagccaggagaatgaattttaaaaatctatgttagtgtttaaaatgagtgctttgttttaaagcagcaatttagtagcattattaaaatgcttacttcactatagtagcaattaggtaaagatgggcaatatcaaaatgggctaaacttattttccactatgttccacacctttgaaataggaattcctaacttgagaatcatgaacccttagggaatcctttataattgtgtataagaagttctagtttacatgcatttttcttggggaaagtgcatagtttagatcagcttctcgaagtggcaaaagtatgggagttagggttaggaaccaccaggattgaataatcctggaatattatataattttctacttttgattttgctgtggtatatttctgaaaatgtgctgtggctcctaactagtaaaatgggctggtgagggactctggaattctgaatttctaagtttataacctaaaatgaaactgtaaagtcctcggtatttagaaaaatgcttaatctcagatttacagatggcctcatgataacttagattcgttaacagggtcaaactttagttcaacaaatttcaacccaatattatcacagtacaatagcttagaatgatcattagaaatggtagaaaatagaataaatcattaaagatcccaaaatgttgagttctgtagcatgaaaactctcttgctcctccatgtttgtagttcaggccagaacaaactaaacagaccaataaatataaaagtgatagtttagggaaaaaaaaaaactttgtataaataaaattgtatgtgtgttcaaataactacctattaaatcatccaaagcttagaatttaaattggtcatagtagcaaatagtgcagatgatggaagaaaaccagtctcaataatggttttttttttccaattgcataaggtcacgtcatcccccaaattgtctattttttcttttctttttttttaagatggagtctcgctccgtcacccaggctggaatgcagtggcgcaatcttggctcattgcaacctccacctcccaggtgcaagcgattctcctacctcagcctcccaagtagctgggactacaggcgcccgccaccatgtgggcctggctaatttttgtagagatggggtttcaacatgttggccaggctggtctcaaactcctgacctccagtgatgcacccgcctcggcctcccaaagttctgggattacaggcgtgagccaccgtgcccagcccctattttttctgaaataatttttcggatatacttttatatttgaaattagttgaacataagatgatcatcaagcttgctataagttttaagctattgctacatttgaacaaagacccacgtacttatcttagaaagtacttaggatatctttgagattaatggtgctacatcactctacagtactatgtaaaatgaatggagctgctgttcctttctagctagctgtttgtgtagttcatattaatttaccctgccttttatttggattgtctgatttcttagttgtacacatgaacctcattatttgcctggaataagtaatcaaataaaattgctttgataaat

SEQ ID NO: 1634 - DNA, 1792 bp, Homo sapiens
tgaggtctccattggaatctctcccttctcgtatctccagttgcatttgatgttaatacctcatagcaaatttatccctttttaagtacccagagccggcggtgtagagctctcgagcgagcaccccgcgtagtccccaagtgcgggactgggcctatgctactacaggcgctcgctgcctaagcctgtctgtgtgtggcagtgtcctagtcgtcctcccctcctccttcggcatctgctctgcattagtctgtcccaggcctccgcaggcgccgatgattaaatcatcatcattaaccagggcctgccccccccatccccggcagcaggggggagaatgggggaataagatcactaccaagtccctgggggtctctcactccccatcccccggcaccctctccgagactctgcaaagcccaagaaactccctccgtgaagccgggagaagacccgccatctggacgaagctccgctacgcggacgccgacagggcggcattacgaggagaggacccaggaggggcttcttcagcagggtcgtcgtcacagaagaccgacgaccctgagcgggtagcgggcacagactgccaggcctttgggggtaggagggggcagtctttcgcaggctccgaaagttagtcttgaggtcgcgtagggcctattatgatgatttctacaggaggttgaagagataagacccttccctgtgctcccccccccccactccttaattacggattgagcaggggaggggccggtggggctcaggtgagcacacagggagaaagggacgtgggcggggccttacagagggtgagcgaatccgaaaagacctagaacctcgttgctgggagacaagtcccgccctgcaggcggcaccggaagtggccggctgggatcagcctttaagatggcgtctcctcaggggggccagattgcgatcgcgatgaggcttcggaaccagctccagtcagtgtacaagatggacccgctacggaacgaggaggaggttcgagtgaagatcaaagacttgaatgaacacattgtttgctgcctatgcgccggctacttcgtggatgccaccaccatcacagagtgtcttcatactttctgcaagagttgtattgtgaagtacctccaaactagcaagtactgccccatgtgcaacattaagatccacgagacacagccactgctcaacctcaaactggaccgggtcatgcaggacatcgtgtataagctggtgcctggcttgcaagacagtgaagagaaacggattcgggaattctaccagtcccgaggtttggaccgggtcacccagcccactggggaagagccagcactgagcaacctcggcctccccttcagcagctttgaccactctaaagcccactactatcgctatgatgagcagttgaacctgtgcctggagcggctgagttctggcaaagacaagaataaaagcgtcctgcagaacaagtatgtccgatgttctgttagagctgaggtacgccatctccggagggtcctgtgtcaccgcttgatgctaaaccctcagcatgtgcagctcctttttgacaatgaagttctccctgatcacatgacaatgaagcagatatggctctcccgctggttcggcaagccatcccctttgcttttacaatacagtgtgaaagagaagaggaggtaggggccaagcccccaccccatcccactccccttccctccccagatatttatgtgaaatgaactgcagctttattttttgaaataaaaacttttaaaaagca

SEQ ID NO: 1635 - DNA, 2604 bp, Homo sapiens
tctcccctcccgccgcccgggcgagcgacacggctgcggcccccctcccctcccttccctccctccctcccatccccccctccccgagacccaccggaccccgaacccagatggccgaaacgggctccccgtcttaacgatttggcgtctccctcgaccaccacctctttgtgcagcagcccccgggcagaccctgttccgagggcaacgctccccagtccccccacccccgaccccggaatcatgcatcggactacacggatcaaaatcacagagctgaacccccacctcatgtgtgccctctgcggggggtacttcatcgacgccaccactatcgtggagtgcctgcattccttctgcaaaacctgcatcgtgcgctacctggagaccaacaaatactgccccatgtgtgacgtgcaggtccataaaacccggccgctgctgagcatcaggtctgacaaaacacttcaagacattgtctacaaattggtccctgggctttttaaagatgagatgaaacggcggcgggatttctatgcagcgtaccccctgacggaggtccccaacggctccaatgaggaccgcggcgaggtcttggagcaggagaagggggctctgagtgatgatgagattgtcagcctctccatcgaattctacgaaggtgccagggaccgggacgagaagaagggccccctggagaatggggatggggacaaagagaaaacaggggtgcgcttcctgcgatgcccagcagccatgaccgtcatgcatcttgccaagtttctccgcaacaagatggatgtgcccagcaagtacaaggtggaggttctgtacgaggacgagccactgaaggaatactacaccctcatggacatcgcctacatctacccctggcggcggaacgggcctctccccctcaagtaccgtgtccagccagcctgcaagcggctcaccctagccacggtgcccaccccctccgagggcaccaacaccagcggggcgtccgagtgtgagtcagtcagcgacaaggctcccagccctgccaccctgccagccacctcctcctccctgcccagcccagccaccccatcccatggctctcccagttcccatgggcctccagccacccaccctacctcccccactcccccttcgacagccagtggggccaccacagctgccaacgggggtagcttgaactgcctgcagacaccatcctccaccagcagggggcgcaagatgactgtcaacggcgctcccgtgccccccttaacttgaggccagggaccctctcccttcttccagccaagcctctccactccttccactttttctgggcccttttttccacctcttctactttccccagctcttcccaccttgggggtggggggcgggttttataaataaatatatatatatatgtacataggaaaaaccaaatatacatacttattttctatggaccaaccagattaatttaaatgccacaggaaacaaactttatgtgtgtgtgtatgtgtggaaaatggtgttcattttttttggggggggtcttgtgtaatttgctgtttttgggggtgcctggagatgaactggatgggccactggagtctcaataaagctctgcaccatcctcgctgtttcccaaggcaggtggtgtgttgggggccccttcagacccaaagctttaggcatgattccaactggctgcatataggagtcagttagaatcgtttctttctctccccgtttctctccccatcttggctgctgtcctgcctctgaccagtggccgccccccacgttgttgaatgtccagaaattgctaagaacagtgccttttacaaatgcagtttatccctggttctgaggagcaagtgcagggtggaggtggcacctgcatcacctcctcctcttgcagtggaaactttgtgcaaagaatagatagttctgcctctttttttttttttcctgtgtgtgtggcctttgcatcatttatcttgtggaaaagaagattcaggccctgagaggtctcagctcttggaggagggctaaggctttagcattgtgaagcgctgcacccccaccaaccttaccctcaccggggaaccctcactagcaggactggtggtggagtctcacctggggcctagagtggaagtgggggtgggttaacctcacacaagcacagatcccagactttgccagaggcaaacagccttccaattgcccctccacccccagctgaggcccggtcacctggtcaggacagagcaactgcatctaaaagcacaagaagacagaaacctgtaagctctgaccccacccccaccccttgagaggtcagcggaccacctccttagggacagaccctggcaggtcgctgcccaccgagatttcctcaagtgtgcatagatctgagaggagtcgggagtcgagactcgagattccatcatagcgtaggtgtgtggggttgggagccccctgatgggcttgtctgtgtttgcaccttgtcctgtgtctgaggtcctgtgactgtaccctcctttgccctgggacatctgtatctcttggctttgtaataaatgctgcatactttct

SEQ ID NO: 1636 - DNA, 5685 bp, Homo sapiens
gcccagacgcacaccgcgcatgctccgagcgcggcgcccccgacgcggcgctcggctcggctcgggcatttccgcctctttgttttaaactccggacgggcttttttctcctcctcttgggggggacccagagggagcggcgccccctcccccctccggcgcggaccccgcgtgcgccttgctcgcccgcagccccgagaccgcaggcgtcacaatgtagcagggaccccaggcgtcgtgctcagaaaatggaaaaagagccagggccggaaggagggtgcagaagcgagtccgcgtgcggagccaggaggcagcgtcgcgtgggagtgctggcctgaagcctccatgccccggcagagggacggacacgcggacgtctagcggagaagccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgtgtttcagcctcagttggttgcaccgttagcccctctcctcccggatggtcatgtttttgtcacattagagaataaacagccacacacacatttttttttttcctttaaaacagtaacttggaaatatgaaaaggccagaaggaggagcaagggctgttttctggagtggttgaggtgttgtcctgcagttgtcattgtcttctccaccgggctgttcccatttatttcctgtggaactgaatccctcctccctccactccttgggagcccaggtggtccttggccaccattcaggctttccaagaagccaaccaccttggagattttttttcttgaatttcgctgttttcttctgcttcctttagataaaaagcagctcaagagaccttatcttagggatgagaaaaacatgcatattaattccatctgagtgattgtcagtgtaaggccttttaaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatatatttgtaactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgcctcgggccacgctgtggggccacctcagtcctgcctgggtcctggtgccttggaccccacgtgcttgtggccaggctgcccctgggcagggccatgtggcctcagaccacaagagcggagctgccctggcccaagcactgcagctgcctgcacccccgggcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccctgcaggaacgcgccgaggtctccctcaccctccaggtgtccttcgcacccaacagtgcgtctgaggaacgagctgcagtttgagcgttcccctgagatgtgcgtagcctccgtgtaaatgtccactcccatggcttaattgcctatcagacgcattttcccagacgaaagcaatgttgggttggggaagacagtgcagccacccagcctttaccagcagcgtacggcagacgaaggcagtcgaggtgtggaggtgatcacgaagatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagcttaagtgaaagtgtttctggctggaaatgtattacataaatcatttgtatgagcatgagagatgacttgctcatgggatgagcaatgctgtgggtattggatggaccactcaggcagcctggccgcacacacacacatgcatgctacatatgtgtacgctcagaccacatgcctgcacatatgtccacacaccagcccacggctcccttcctcaccccagccctccccactcccaggttaaccaatgtctcgatttgcttcaggcggcatttgtaaactgtcaccctgcttgcaaaccctcatttaaattggtccagcatttgctaccagagtttaggccacaaactttgtaaagctcagtttgtctccttgcagaaagaggttgctgcagtttggagctggttatgccaaggaaaatacggctaaaaaagaacttactgattcccataggtgtgtcaactgacaaatgaatgttccatctccctacgacaatttgctgcccctccccaaaaaaagcactatggccaaaatttcagtttttaaaggttaagtaaa

SEQ ID NO: 1637 - DNA, 589 bp, Homo sapiens
cttgccgcggggtgggagcccagacgcacaccgcgcatgctccgagcgcggcgcccccgacgcggcgctcggctcggctcgggcatttccgcctctttgttttaaactccggacgggcttttttctcctcctcttgggggggacccagagggagcggcgccccctcccccctccggcgcggaccccgcgtgcgccttgctcgcccgcagccccgagaccgcaggcgtcacaatgtagcagggaccccaggcgtcgtgctcagaaaatggaaaaagagccagggccggaaggagggtgcagaagcgagtccgcgtgcggagccaggaggcagcgtcgcgtgggagtgctggcctgaagcctccatgccccggcagagggacggacacgcggacgtctagcggagccccgcagggaggaggagaaggggaggatttgactttggaagtctctgtgaccagaagccaaagatgttgaccaggaagatcaagctgtgggacatcaacgcccacatcacctgccgcctgtgcagcgggtacctcatcgacgccaccacggtgaccgagtgtctgcacaccttctgcaggagctg

SEQ ID NO: 1638 - DNA, 582 bp, Homo sapiens
atgctccgagcgcggcgcccccgacgcggcgctcggctcggctcgggcatttccgcctctttgttttaaactccggacgggcttttttctcctcctcttgggggggacccagagggagcggcgccccctcccccctccggcgcggaccccgcgtgcgccttgctcgcccgcagccccgagaccgcaggcgtcacaatgtagcagggaccccaggcgtcgtgctcaggtgccgtttctgtgctagaaaatggaaaaagagccagggccggaaggagggtgcagaagcgagtccgcgtgcggagccaggaggcagcgtcgcgtgggagtgctggcctgaagcctccatgccccggcagagggacggacacgcggacgtctagcggagaagccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagcca

SEQ ID NO: 1639 - DNA, 639 bp, Homo sapiens
agatgcgggcacaggagggagcttcccacactgttcaggtcaccagagcctgcgcttctgtggttggttttgatgaggactcgtatttcagctcctgtctctccttgtcagaggccgtgtgaggcgtcacaatgtagcagggaccccaggcgtcgtgctcagaaaatggaaaaagagccagggccggaaggagggtgcagaagcgagtccgcgtgcggagccaggaggcagcgtcgcgtgggagtgctggcctgaagcctccatgccccggcagagggacggacacgcggacgtctagcggagaagccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaag

SEQ ID NO: 1640 - DNA, 1652 bp, Homo sapiens
atgctccgagcgcggcgcccccgacgcggcgctcggctcggctcgggcatttccgcctctttgttttaaactccggacgggcttttttctcctcctcttgggggggacccagagggagcggcgccccctcccccctccggcgcggaccccgcgtgcgccttgctcgcccgcagccccgagaccgcaggcgtcacaatgtagcagggaccccaggcgtcgtgctcaggtgccgtttctgtgctagaaaatggaaaaagagccagggccggaaggagggtgcagaagcgagtccgcgtgcggagccaggaggcagcgtcgcgtgggagtgctggcctgaagcctccatgccccggcagagggacggacacgcggacgtctagcggagaagccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaa

SEQ ID NO: 1641 - DNA, 1725 bp, Homo sapiens
cggcagagggacggacacgcggacgtctagcggagaagccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctc

SEQ ID NO: 1642 - DNA, 3609 bp, Homo sapiens
ttgctcgcccgcagccccgagaccgcaggcgtcacaatgtagcagggaccccaggcgtcgtgctcagaaaatggaaaaagagccagggccggaaggagggtgcagaagcgagtccgcgtgcggagccaggaggcagcgtcgcgtgggagtgctggcctgaagcctccatgccccggcagagggacggacacgcggacgtctagcggaggctcccgtgtcctcagtatgcatcaggtctcccgaacctcacagccccgcagggaggaggagaaggggaggatttgactttggaagtctctgtgaccagaagccaaagatgttgaccaggaagatcaagctgtgggacatcaacgcccacatcacctgccgcctgtgcagcgggtacctcatcgacgccaccacggtgaccgagtgtctgcacacctctcaagcccgacaaaagcaggaaccaggaccaggggcagagacgatcttgaagataagtcagaaaagtcatttcacgctaaaggtcctgtgggtggtgtcagagcagatgaggcctcgcttaggagagcgaaacacaggagagaccccacattcctcccacggagcagcaaggccagtagccgctgtgacagtgctcactgctggcagtttccaaatctccagaggagttccttagatccttcaaaggggaaccttccagtgtgttcttcacacctgatgtgcgtcctcacacctgatgagtctgtgctttggtgttagaggactcacacctggggctggacctgagtgtttttctaagtgtggctaccgctgacgggcaggtgccatccatcaggctgaggctcggctcttatgctaacctgaggccccatggctggcggccctgctggtgtggacgaccgctgtgtgcgtctcttgatggctggggagcattttgtttaaacaggatctttaaaatgaagtgtacgcttataatacaagtgatgcttgtgtatttctcactttaggaaataaaatatttgccaatttgatagaattttgactttaacgttaatcgtatttttagatattggttagcatattttatgttaggttattttcatttgattttatctagttgtacgtagaagatactgtcatcttttaggacaaagtattgtaaaattatctgttttagcccatgttctgatgacccacagctctgtcacctttgagcatcatctccccattctaagtttttttcccacttaattcctaaccctgcctctttgaggaagcccattgacggggcaattaaaaccttctcattgctcctgagaccagaacggcaagatgtttcctttcagaagctgagagccacaaggaggacagcagtgagcatctgcacagaaacgagctcagagacgcccgtgttcagtggagcacgccgatggggtgggcgccctggctctagacgctctcctaacacacctgtgctttgatgacagtctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgtgtttcagcctcagttggttgcaccgttagcccctctcctcccggatggtcatgtttttgtcacattagagaataaacagccacacacacatttttttttttcctttaaaacagtaacttggaaatatgaaaaggccagaaggaggagcaagggctgttttctggagtggttgaggtgttgtcctgcagttgtcattgtcttctccaccgggctgttcccatttatttcctgtggaactgaatccctcctccctccactccttgggagcccaggtggtccttggccaccattcaggctttccaagaagccaaccaccttggagattttttttcttgaatttcgctgttttcttctgcttcctttagataaaaagcagctcaagagaccttatcttagggatgagaaaaacatgcatattaattccatctgagtgattgtcagtgtaaggccttttaaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctc

SEQ ID NO: 1643 - DNA, 5174 bp, Homo sapiens
cccgccgcggaggccgagcgagcccccagcccagcctggcgactggggaccccggcacatgaggtggacgcccccggggaagacttgggtgcacagccaggcgagaaggtcttgagtcagacagagcaccagccttggggaccctggaccactatcatggagactgagagcgagcagaactccaattccaccaatgggagttctagctcagggggcagctctcggccccagatagctcaaatgtcactttatgaacgacaagcagtgcaggctctgcaagcactgcagcggcagcccaatgcagctcagtatttccaccagttcatgctccagcagcagctcagtaatgcccagctgcatagcctggctgccgtccagcaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggccacagctgggaaacctattgcaggtaaaccgaaccctgggtcggaatgtgcctctagcctcccaactcatcctgatgcctaatggggcggtggctgcagtccagcaggaggtgccatctgctcagtctcctggagttcatgcagatgcagatcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggtggaggcagtgggaatagcatcccagggtccatgggtccaggtggaggtgggcaggcacatggtggtttgggtcagttgccttcctcaggaatgggtggtgggagctgtcccagaaagggtacaggagtggtgcagcccttgcctgcagcccaaacagtgactgtgagccagggcagccagacagaggcagaaagtgcagcagccaagaaggcagaagcagatgggagtggccagcagaatgtgggcatgaacctgacacggacagccacacctgcgcccagccagacacttattagctcagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccaccctcactgcccctcagccaccacaggtcccacctactcagcaggtcccaccttcccagtcccagcagcaagcccaaaccctggtcgttcagcccatgcttcagtcttcacccttgtctcttccacctgatgcagcccctaagccaccaattcccatccaatccaaaccacctgtagcacctatcaagccgcctcagttaggggccgctaagatgtcagctgcccagcaaccaccaccccatatccctgtgcaagttgtaggcactcgacagccaggtacagcccaggcacaggctttggggttggcacagctggcagctgctgtacctacttcccgggggatgccaggtacagtgcagtctggtcaggcccatttggcctcctcgccaccttcatcccaggctcctggtgcactgcaggagtgccctcccacattggcccctgggatgacccttgctcctgtgcaggggacagcacatgtggtaaagggtggggctaccacctcctcacctgttgtagcccaggtccctgctgccttctatatgcagtctgtgcacttgccgggtaaaccccagacattggctgtcaaacgcaaggctgactctgaggaggagagagatgatgtctccacattgggttcaatgcttcctgccaaggcatctccagtagcagaaagcccaaaagtcatggacgagaagagcagtcttggagaaaaagctgaatcagtggctaatgtgaatgctaatactccaagcagtgaactagtagccttgacccccgccccttcagtaccgcctcctacactagccatggtgtctagacaaatgggtgactcaaaacccccacaggccatcgtgaagccccagattctcacccacatcattgaaggctttgttatccaggaaggagcagaacctttcccggtgggttgttctcagttactgaaggagtctgagaagccactacagactggccttccgacagggctgactgagaatcagtcaggtggccctttgggagtggacagcccatctgctgagttagataagaaggcgaatctcctgaagtgcgagtactgtgggaagtacgcccccgcagagcagtttcgtggctctaagaggttctgctccatgacttgcgctaagaggtacaatgtgagctgtagccatcagttccggctgaagaggaaaaaaatgaaagagtttcaagaagccaactatgctcgcgttcgcaggcgtggaccccgccgcagctcctctgacattgcccgtgccaagattcagggcaagtgccaccggggtcaagaagactctagccggggttcagataattccagttatgatgaagcactctctccaacatctcctgggcctttatcagtaagagctgggcatggagaacgtgacctggggaatcccaatacagctccacctacaccggaattacatggcatcaaccctgtgttcctgtccagtaatcccagccgttggagtgtagaggaggtgtacgagtttattgcttctctccaaggctgccaagagattgcagaggaatttcgctcacaggagattgatggacaggcccttttattacttaaagaagaacatcttatgagtgccatgaacatcaagctgggccctgccctcaagatctgcgccaagataaatgtcctcaaggagacctaaggtggccctcttgcacaaaccagcctaaggcagacactctccactgtccaggttataacctggtaccagcagactttgcagggaagaaagagttgttccaatcatgtaaccttctgtaggggattactgagacagggaagagaagtgcaagaattggttgctggtgctacatggcggcagctttgacattttctctgggttctactttattttttaaaatctttacagttctcaccatttcacgtaccttaatccaatctttataaaagaggcagtctagagaactaggactgctcagccttatcctggagtggagcatttagcccaggtcttaattctccaagaggaggaatacatagtatggtaaggcaaggaactgggtggaatgtcaggttgcctgcccaatgggagaggtagggtttttctagcttgtgtgacagaagtagcaaaatctggtcctcccccctcccagtgtagctgtggctcagagttttttctttttgttgtcacttactcccttgtgattgaattttttctcctgcatccatggcaggatccccagccagtatagagacttggttggcatcttctgctgcagggactaaaagtatttgactggggcacatgtggctgttgtcattctttctgcatcccactgttcccctccaatttatgttattttctaccctgtttttcagttccatctctgctctgtcctatagctttataaaaccagagtgtgtggggctgaggtcaggagtataagtacctgccttaggcactattccttatataacaaaaatattaaatatttttttcctcagtaaaaggatgaaaattggtttcagttgtcttactctattccagtctttgcccactttcacacaaatgacaaggccaatatgttttgtttgttttttaatcattaagagtttttgtacaaaaggtgatggttttttttcttcattttaaaacaccagggtgtgggggagggatgcaaacaaataacaaaaaagatgcttttgtaacattattttccctgtttagaaagaaaaaaatcactccaatagtattgaaaagtccaaagatgaaatagtttcattttcttttcctaaggcttataaaaggccccctgcctgttgattccatccctcttttgtgtccagtggagccatgttactcttcagtggcccaggggttcactattaaagaaagatcagtccaggtttctgggcacatggcctaaacaggaagatggaagcatcagaggattaaaaacctttccccacagaaatgtgggcaagaagacacttccctgagccagcagaagggacaggtgcagcagcattccacacccagcgcagaggacagcagagccctcgatgtcccacttctgcttccgttccctttctagaagattgaaaaaaaggtcaaaaccacatgcctgtggagaaagtgcgacatgtttagaaatactggtagggaaccaggagtaagaaaagctttaccagcttttactacaaatggatgaaagacatcaggatcccaccaccgcaaggtaaagtgacttcccttttctggaacccctgtggcacaggagtaccaattttcctttccaacgaactggatttctggataggcattttggctgtatgtggacagataagaccacagtccttagcccaatcccagctatacagtcaccccaatttccacaaatgatgtgatggtaccgtataatcctgtaattgggaaatttcacatttttcctgtcctaatctcagaggtgggagaagcaagtctagaacatctccaggctcagactaaacgagagtacttggactgcaaccaagtaatcactgcaaagtagttccaagcagcaagaaataccagattctcatggaggctactatagggtacagaataacaacatgaaagcaatcaaccctgtataaataatgtttcttggcattttttttttaattaaagaaatccagtgtctc

SEQ ID NO: 1644 - DNA, 3864 bp, Homo sapiens
caggaatcctggttttggtggcagtttcccttgattttattgagacttttaagttggtccctttacatttttatttctagttcacaatccaaaaaaaattattaatcagaattcaggtttgggaagacgaggggtcatacggtttgtattttcacatgtgaatgtaggaattatgttctctatacctagcaaaggggtctcgtgtctctgagtccagtgaactaaatccagtaatctataaaactgtgccgtgctgcctctaatccttacccactttttttcttcacatgctgataatgaggattcatgggtcttgagtcagacagagcaccagccttggggaccctggaccactatcatggagactgagagcgagcagaactccaattccaccaatgggagttctagctcagggggcagctctcggccccagatagctcaaatgtcactttatgaacgacaagcagtgcaggctctgcaagcactgcagcggcagcccaatgcagctcagtatttccaccagttcatgctccagcagcagctcagtaatgcccagctgcatagcctggctgccgtccagcaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggccacagctgggaaacctattgcagtccagcaggaggtgccatctgctcagtctcctggagttcatgcagatgcagatcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggtggaggcagtgggaatagcatcccagggtccatgggtccaggtggaggtgggcaggcacatggtggtttgggtcagttgccttcctcaggaatgggtggtgggagctgtcccagaaagggtacaggagtggtgcagcccttgcctgcagcccaaacagtgactgtgagccagggcagccagacagaggcagaaagtgcagcagccaagaaggcagaagcagatgggagtggccagcagaatgtgggcatgaacctgacacggacagccacacctgcgcccagccagacacttattagctcagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccaccctcactgcccctcagccaccacaggtcccacctactcagcagggtaaaccccagacattggctgtcaaacgcaaggctgactctgaggaggagagagatgatgtctccacattgggttcaatgcttcctgccaaggcatctccagtagcagaaagcccaaaagtcatggacgagaagagcagtcttggagaaaaagctgaatcagtggctaatgtgaatgctaatactccaagcagtgaactagtagccttgacccccgccccttcagtaccgcctcctacactagccatggtgtctagacaaatgggtgactcaaaacccccacaggccatcgtgaagccccagattctcacccacatcattgaaggctttgttatccaggaaggagcagaacctttcccggtgggttgttctcagttactgaaggagtctgagaagccactacagactggccttccgacagggctgactgagaatcagtcaggtggccctttgggagtggacagcccatctgctgagttagataagaaggcgaatctcctgaagtgcgagtactgtgggaagtacgcccccgcagagcagtttcgtggctctaagaggttctgctccatgacttgcgctaagaggtacaatgtgagctgtagccatcagttccggctgaagaggaaaaaaatgaaagagtttcaagaagccaactatgctcgcgttcgcaggcgtggaccccgccgcagctcctctgacattgcccgtgccaagattcagggcaagtgccaccggggtcaagaagactctagccggggttcagataattccagttatgatgaagcactctctccaacatctcctgggcctttatcagtaagagctgggcatggagaacgtgacctggggaatcccaatacagctccacctacaccggaattacatggcatcaaccctgtgttcctgtccagtaatcccagccgttggagtgtagaggaggtgtacgagtttattgcttctctccaaggctgccaagagattgcagaggaatttcgctcacaggagattgatggacaggcccttttattacttaaagaagaacatcttatgagtgccatgaacatcaagctgggccctgccctcaagatctgcgccaagataaatgtcctcaaggagacctaaggtggccctcttgcacaaaccagcctaaggcagacactctccactgtccaggttataacctggtaccagcagactttgcagggaagaaagagttgttccaatcataggcagtctagagaactaggactgctcagccttatcctggagtggagcatttagcccaggtcttaattctccaagaggaggaatacatagtatggcttataaaaggccccctgcctgttgattccatccctcttttgtgtccagtggagccatgttactcttcagtggcccaggggttcactattaaagaaagatcagtccaggtttctgggcacatggcctaaacaggaagatggaagcatcagaggattaaaaacctttccccacagaaatgtgggcaagaagacacttccctgagccagcagaagggacaggtgcagcagcattccacacccagcgcagaggacagcagagccctcgatgtcccacttctgcttccgttccctttctagaagattgaaaaaaaggtcaaaaccacatgcctgtggagaaagtgcgacatgtttagaaatactggtagggaaccaggagtaagaaaagctttaccagcttttactacaaatggatgaaagacatcaggatcccaccaccgcaaggtaaagtgacttcccttttctggaacccctgtggcacaggagtaccaattttcctttccaacgaactggatttctggataggcattttggctgtatgtggacagataagaccacagtccttagcccaatcccagctatacagtcaccccaatttccacaaatgatgtgatggtaccgtataatcctgtaattgggaaatttcacatttttcctgtcctaatctcagaggtgggagaagcaagtctagaacatctccaggctcagactaaacgagagtacttggactgcaaccaagtaatcactgcaaagtagttccaagcagcaagaaataccagattctcatggaggctactatagggtacagaataacaacatgaaagcaatcaaccctgtataaataatgtttcttggcattttttttttaattaaagaaatccagtgtctc

SEQ ID NO: 1645 - DNA, 618 bp, Homo sapiens
ctcctaatgggttagctgtttctgcagcattctttcccgccttcttggagttgaggtcttgagtcagacagagcaccagccttggggaccctggaccactatcatggagactgagagcgagcagaactccaattccaccaatgggagttctagctcagggggcagctctcggccccagatagctcaaatgtcactttatgaacgacaagcagtgcaggctctgcaagcactgcagcggcagcccaatgcagctcagtatttccaccagttcatgctccagcagcagctcagtaatgcccagctgcatagcctggctgccgtccagcaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggccacagctgggaaacctattgcaggtaaaccgaaccctgggtcggaatgtgcctctagc

SEQ ID NO: 1646 - DNA, 4292 bp, Homo sapiens
cgggcaggaagtgacaggcccggagcgagccccggaggcctggctgagccgcggccgggcccgcacccggagcggcgggaggggcggggagccgcggtcgcgccgggcgcctcccaccccgccctcggcgcccccgcccctccaggaaggggaggaggcgaggggagcccgccgcggaggccgagcgagcccccagcccagcctggcgactggggaccccggcacatgaggtggacgcccccggggaagacttgggtgcacagccaggcgagaaggattcatgggtcttgagtcagacagagcaccagccttggggaccctggaccactatcatggagactgagagcgagcagaactccaattccaccaatgggagttctagctcagggggcagctctcggccccagatagctcaaatgtcactttatgaacgacaagcagtgcaggctctgcaagcactgcagcggcagcccaatgcagctcagtatttccaccagttcatgctccagcagcagctcagtaatgcccagctgcatagcctggctgccgtccagcaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggccacagctgggaaacctattgcaggtaaaccgaaccctgggtcggaatgtgcctctagcctcccaactcatcctgatgcctaatggggcggtggctgcagtccagcaggaggtgccatctgctcagtctcctggagttcatgcagatgcagatcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggtggaggcagtgggaatagcatcccagggtccatgggtccaggtggaggtgggcaggcacatggtggtttgggtcagttgccttcctcaggaatgggtggtgggagctgtcccagaaagggtacaggagtggtgcagcccttgcctgcagcccaaacagtgactgtgagccagggcagccagacagaggcagaaagtgcagcagccaagaaggcagaagcagatgggagtggccagcagaatgtgggcatgaacctgacacggacagccacacctgcgcccagccagacacttattagctcagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccaccctcactgcccctcagccaccacaggtcccacctactcagcaggtcccaccttcccagtcccagcagcaagcccaaaccctggtcgttcagcccatgcttcagtcttcacccttgtctcttccacctgatgcagcccctaagccaccaattcccatccaatccaaaccacctgtagcacctatcaagccgcctcagttaggggccgctaagatgtcagctgcccagcaaccaccaccccatatccctgtgcaagttgtaggcactcgacagccaggtacagcccaggcacaggctttggggttggcacagctggcagctgctgtacctacttcccgggggatgccaggtacagtgcagtctggtcaggcccatttggcctcctcgccaccttcatcccaggctcctggtgcactgcaggagtgccctcccacattggcccctgggatgacccttgctcctgtgcaggggacagcacatgtggtaaagggtggggctaccacctcctcacctgttgtagcccaggtccctgctgccttctatatgcagtctgtgcacttgccgggtaaaccccagacattggctgtcaaacgcaaggctgactctgaggaggagagagatgatgtctccacattgggttcaatgcttcctgccaaggcatctccagtagcagaaagcccaaaagtcatggacgagaagagcagtcttggagaaaaagctgaatcagtggctaatgtgaatgctaatactccaagcagtgaactagtagccttgacccccgccccttcagtaccgcctcctacactagccatggtgtctagacaaatgggtgactcaaaacccccacaggccatcgtgaagccccagattctcacccacatcattgaaggctttgttatccaggaaggagcagaacctttcccggtgggttgttctcagttactgaaggagtctgagaagccactacagactggccttccgacagggctgactgagaatcagtcaggtggccctttgggagtggacagcccatctgctgagttagataagaaggcgaatctcctgaagtgcgagtactgtgggaagtacgcccccgcagagcagtttcgtggctctaagaggttctgctccatgacttgcgctaagaggtacaatgtgagctgtagccatcagttccggctgaagaggaaaaaaatgaaagagtttcaagaagccaactatgctcgcgttcgcaggcgtggaccccgccgcagctcctctgacattgcccgtgccaagattcagggcaagtgccaccggggtcaagaagactctagccggggttcagataattccagttatgatgaagcactctctccaacatctcctgggcctttatcagtaagagctgggcatggagaacgtgacctggggaatcccaatacagctccacctacaccggaattacatggcatcaaccctgtgttcctgtccagtaatcccagccgttggagtgtagaggaggtgtacgagtttattgcttctctccaaggctgccaagagattgcagaggaatttcgctcacaggagattgatggacaggcccttttattacttaaagaagaacatcttatgagtgccatgaacatcaagctgggccctgccctcaagatctgcgccaagataaatgtcctcaaggagacctaaggtggccctcttgcacaaaccagcctaaggcagacactctccactgtccaggttataacctggtaccagcagactttgcagggaagaaagagttgttccaatcatgtaaccttctgtaggggattactgagacagggaagagaagtgcaagaattggttgctggtgctacatggcggcagctttgacattttctctgggttctactttattttttaaaatctttacagttctcaccatttcacgtaccttaatccaatctttataaaagaggcagtctagagaactaggactgctcagccttatcctggagtggagcatttagcccaggtcttaattctccaagaggaggaatacatagtatggtaaggcaaggaactgggtggaatgtcaggttgcctgcccaatgggagaggtagggtttttctagcttgtgtgacagaagtagcaaaatctggtcctcccccctcccagtgtagctgtggctcagagttttttctttttgttgtcacttactcccttgtgattgaattttttctcctgcatccatggcaggatccccagccagtatagagacttggttggcatcttctgctgcagggactaaaagtatttgactggggcacatgtggctgttgtcattctttctgcatcccactgttcccctccaatttatgttattttctaccctgtttttcagttccatctctgctctgtcctatagctttataaaaccagagtgtgtggggctgaggtcaggagtataagtacctgccttaggcactattccttatataacaaaaatattaaatatttttttcctcagtaaaaggatgaaaattggtttcagttgtcttactctattccagtctttgcccactttcacacaaatgacaaggccaatatgttttgtttgttttttaatcattaagagtttttgtacaaaa

SEQ ID NO: 1647 - DNA, 3626 bp, Homo sapiens
gcccccagcccagcctggcgactggggaccccggcacatgaggtggacgcccccggggaagacttgggtgcacagccaggcgagaaggtcttgagtcagacagagcaccagccttggggaccctggaccactatcatggagactgagagcgagcagaactccaattccaccaatgggagttctagctcagggggcagctctcggccccagatagctcaaatgtcactttatgaacgacaagcagtgcaggctctgcaagcactgcagcggcagcccaatgcagctcagtatttccaccagttcatgctccagcagcagctcagtaatgcccagctgcatagcctggctgccgtccagcaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggccacagctgggaaacctattgcaggtaaaccgaaccctgggtcggaatgtgcctctagcctcccaactcatcctgatgcctaatggggcggtggctgcagtccagcaggaggtgccatctgctcagtctcctggagttcatgcagatgcagatcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggtggaggcagtgggaatagcatcccagggtccatgggtccaggtggaggtgggcaggcacatggtggtttgggtcagttgccttcctcaggaatgggtggtgggagctgtcccagaaagggtacaggagtggtgcagcccttgcctgcagcccaaacagtgactgtgagccagggcagccagacagaggcagaaagtgcagcagccaagaaggcagaagcagatgggagtggccagcagaatgtgggcatgaacctgacacggacagccacacctgcgcccagccagacacttattagctcagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccaccctcactgcccctcagccaccacaggtcccacctactcagcaggtcccaccttcccagtcccagcagcaagcccaaaccctggtcgttcagcccatgcttcagtcttcacccttgtctcttccacctgatgcagcccctaagccaccaattcccatccaatccaaaccacctgtagcacctatcaagccgcctcagttaggggccgctaagatgtcagctgcccagcaaccaccaccccatatccctgtgcaagttgtaggcactcgacagccaggtacagcccaggcacaggctttggggttggcacagctggcagctgctgtacctacttcccgggggatgccaggtacagtgcagtctggtcaggcccatttggcctcctcgccaccttcatcccaggctcctggtgcactgcaggagtgccctcccacattggcccctgggatgacccttgctcctgtgcaggggacagcacatgtggtaaagggtggggctaccacctcctcacctgttgtagcccaggtccctgctgccttctatatgcagtctgtgcacttgccgggtaaaccccagacattggctgtcaaacgcaaggctgactctgaggaggagagagatgatgtctccacattgggttcaatgcttcctgccaaggcatctccagtagcagaaagcccaaaagtcatggacgagaagagcagtcttggagaaaaagctgaatcagtggctaatgtgaatgctaatactccaagcagtgaactagtagccttgacccccgccccttcagtaccgcctcctacactagccatggtgtctagacaaatgggtgactcaaaacccccacaggccatcgtgaagccccagattctcacccacatcattgaaggctttgttatccaggaaggagcagaacctttcccggtgggttgttctcagttactgaaggagtctgagaagccactacagactggccttccgacagggctgactgagaatcagtcaggtggccctttgggagtggacagcccatctgctgagttagataagaaggcgaatctcctgaagtgcgagtactgtgggaagtacgcccccgcagagcagtttcgtggctctaagaggttctgctccatgacttgcgctaagaggtacaatgtgagctgtagccatcagttccggctgaagaggaaaaaaatgaaagagtttcaagaagccaactatgctcgcgttcgcaggcgtggaccccgccgcagctcctctgacattgcccgtgccaagattcagggcaagtgccaccggggtcaagaagactctagccggggttcagataattccagttatgatgaagcactctctccaacatctcctgggcctttatcagtaagagctgggcatggagaacgtgacctggggaatcccaatacagctccacctacaccggaattacatggcatcaaccctgtgttcctgtccagtaatcccagccgttggagtgtagaggaggtgtacgagtttattgcttctctccaaggctgccaagagattgcagaggaatttcgctcacaggagattgatggacaggcccttttattacttaaagaagaacatcttatgagtgccatgaacatcaagctgggccctgccctcaagatctgcgccaagataaatgtcctcaaggagacctaaggtggccctcttgcacaaaccagcctaaggcagacactctccactgtccaggttataacctggtaccagcagactttgcagggaagaaagagttgttccaatcatgtaaccttctgtaggggattactgagacagggaagagaagtgcaagaattggttgctggtgctacatggcggcagctttgacattttctctgggttctactttattttttaaaatctttacagttctcaccatttcacgtaccttaatccaatctttataaaagaggcagtctagagaactaggactgctcagccttatcctggagtggagcatttagcccaggtcttaattctccaagaggaggaatacatagtatggtaaggcaaggaactgggtggaatgtcaggttgcctgcccaatgggagaggtagggtttttctagcttgtgtgacagaagtagcaaaatctggtcctcccccctcccagtgta

SEQ ID NO: 1648 - DNA, 3870 bp, Homo sapiens
catctgcctgcccttctgccatccgagcgccctgactgcgccacactgcaggccatggagaatgagctgccagtcccacatacatctagcagtgcctgtgccaccagcagtaccagcggggccagtagcagcagtggctgcaacaacagcagcagtggtggaagtggccgccccaccgggccccagatttctgtgtacagtggtattccagaccggcagaccgtgcaggtgatccagcaggccctgcacagacagcccagcacggccgctcagtacctgcagcagatgtacgccgcccagcagcagcacctcatgctgcagaccgcggcgctccagcagcagcacctcagcagcgcccagctccagagcctggcagccgtacagcaggcaagcctggtatccaatagacaaggaagcacttcaggcagcaatgtgtctgcgcaggccccggcccagtcatcttcgatcaacctggcagcctccccagcagcagcccagctcctcaaccgggcccagagtgtgaactctgcagcagcctcaggcatcgctcagcaggctgtgctcttgggcaacacgtcttccccagccctgactgcaagccaagcacagatgtatctgagggcacagatgctcatcttcacgcccacggccaccgtcgctactgtgcagcctgagctcggcactggctcccccgcccggccccccacccccgcccaggtacagaacttgaccctccgaacacagcagacaccagcggcagcagcctcgggccccacccccactcagcctgtcctgcccagcttggccctgaaacccacgccgggcggtagccagcctctgcctaccccagcacagagcagaaatactgctcaggcttcccctgcaggtgccaagcctggcatagctgacagtgtgatggagccacacaagaaaggagatggcaacagcagtgtgccagggagcatggaaggccgggctgggctcagccggacggttcctgctgtggctgcccaccccctcattgcaccagcctatgctcagctgcagccacaccagctcctcccacagccatcctcaaagcacctgcagccccaatttgtgatccagcagcagccacagccacaacagcagcagccgccgccccagcagtcacggcctgtgctccaagctgagccccacccccagctcgcctcagtctctccaagcgtggccctccagcccagctcagaggcccatgccatgccactaggcccggttacacccgccctgccactccagtgtcccactgccaacctgcacaagcctggcggcagtcagcagtgtcaccctcccacacctgatactgggcctcagaatggacatcccgagggcgtgccccacacccctcaacgcaggttccagcacacttcagctgtcatcttacaactgcagcctgcttcaccaccccagcagtgtgtccctgatgactggaaagaagtggcaccaggggagaaaagtgtgcctgagacgcggtctggcccatcaccacatcagcaggctattgtcactgccatgcctggtggcctgcctgtacccacgagccctaacatccagccgtccccagctcacgagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccagggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccaaagggctgagcctcctggcctgcctgcccgcccaccctgggagtcccagtggtgaggctcagagaactgctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 1649 - DNA, 2544 bp, Homo sapiens
tgtctccgcggcggctgcagccctcgagcgcccgccgcgcgcgcgcgccaaccccggccgccgcccgcgctcccgccccggcctcgcgcccccgtcccggcctcgcgccccggccgccctttgttgacgccggccaggccgtgcggtcggatgcgccgcggcagccccgggccccggctcggaggctcccggggagagaggcggcccgcccgggcccgggaccccgcgcgagtcggccccggcgaggggctgcgtaggcccgcccggccaggcccagccgggccctggacagagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagctttcccggtgggacgctcgtctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcggccagcaaagccagtctgccaccacttaccaaggataccaagaagcagccaacaggcactgtgcccctttcggttactgctgctttgcctaacacacagccaggaagactccagccgttgctcagataactcaagctatgaggaacccttgtcacccatctcagccagctcatctacttccgccggcgacaaggccagcgggacctggagctccccgacatgcatatgcgggacctggtgggcatgggacaccacttcctgccaagtgagccaccaagtgaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccagggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccaaagggctgagcctcctggcctgcctgcccgcccaccctgggagtcccagtggtgaggctcagagaactgctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 1650 - DNA, 2613 bp, Homo sapiens
catctgcctgcccttctgccatccgagcgccctgactgcgccacactgcaggccatggagaatgagctgccagtcccacatacatctagcagtgcctgtgccaccagcagtaccagcggggccagtagcagcagtggctgcaacaacagcagcagtggtggaagtggccgccccaccgggccccagatttctgtgtacagtggtattccagaccggcagaccgtgcaggtgatccagcaggccctgcacagacagcccagcacggccgctcagtacctgcagcagatgtacgccgcccagcagcagcacctcatgctgcagaccgcggcgctccagcagcagcacctcagcagcgcccagctccagagcctggcagccgtacagcaggcaagcctggtatccaatagacaaggaagcacttcaggcagcaatgtgtctgcgcaggccccggcccagtcatcttcgatcaacctggcagcctccccagcagcagcccagctcctcaaccgggcccagagtgtgaactctgcagcagcctcaggcatcgctcagcaggctgtgctcttgggcaacacgtcttccccagccctgactgcaagccaagcacagatgtatctgagggcacagatgctcatcttcacgcccacggccaccgtcgctactgtgcagcctgagctcggcactggctcccccgcccggccccccacccccgcccaggtacagaacttgaccctccgaacacagcagacaccagcggcagcagcctcgggccccacccccactcagcctgtcctgcccagcttggccctgaaacccacgccgggcggtagccagcctctgcctaccccagcacagagcagaaatactgctcaggcttcccctgcaggtgccaagcctggcatagctgacagtgtgatggagccacacaagaaaggagatggcaacagcagtgtgccagggagcatggaaggccgggctgggctcagccggacggttcctgctgtggctgcccaccccctcattgcaccagcctatgctcagctgcagccacaccagctcctcccacagccatcctcaaagcacctgcagccccaatttgtgatccagcagcagccacagccacaacagcagcagccgccgccccagcagtcacggcctgtgctccaagctgagccccacccccagctcgcctcagtctctccaagcgtggccctccagcccagctcagaggcccatgccatgccactaggcccggttacacccgccctgccactccagtgtcccactgccaacctgcacaagcctggcggcagtcagcagtgtcaccctcccacacctgatactgggcctcagaatggacatcccgagggcgtgccccacacccctcaacgcaggttccagcacacttcagctgtcatcttacaactgcagcctgcttcaccaccccagcagtgtgtccctgatgactggaaagaagtggcaccaggggagaaaagtgtgcctgagacgcggtctggcccatcaccacatcagcaggctattgtcactgccatgcctggtggcctgcctgtacccacgagccctaacatccagccgtccccagctcacgagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggcctccccagcagcttccctaaaggccatgagacttctatatacagtctctcaaagcaccttagacactcacgctttccacagagtccttctggctcctgcctgtggccagttctgaggccacgcccacatctatag

SEQ ID NO: 1651 - DNA, 2550 bp, Homo sapiens
gcggctgcagccctcgagcgcccgccgcgcgcgcgcgcgcaaccccggccgccgcccgcgctcccgccccggcctcgcgcccccgtcccggcctcgcgccccggccgccctttgttgacgccggccaggccggtgcggtcggatgcgccgcggcagccccgggccccggctcggaggctcccggcggagaggaggcggcccgcccgggcccgggaccccgcgcgagtcggcgcccggccgaggggctgcgtaggccccgcccggccaggcccagccgggccctggacagagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccagggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccaaagggctgagcctcctggcctgcctgcccgcccaccctgggagtcccagtggtgaggctcagagaactgctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 1652 - DNA, 2799 bp, Homo sapiens
tcaaagcacctgcagccccaatttgtgatccagcagcagccacagccacaacagcagcagccgccgccccagcagtcacggcctgtgctccaagctgagccccacccccagctcgcctcagtctctccaagcgtggccctccagcccagctcagaggcccatgccatgccactaggcccggttacacccgccctgccactccagtgtcccactgccaacctgcacaagcctggcggcagtcagcagtgtcaccctcccacacctgatactgggcctcagaatggacatcccgagggcgtgccccacacccctcaacgcaggttccagcacacttcagctgtcatcttacaactgcagcctgcttcaccagtgccccagcagtgtgtccctgatgactggaaagaagtggcaccaggggagaaaagtgtgcctgagacgcggtctggcccatcaccacatcagcaggctattgtcactgccatgcctggtggcctgcctgtacccacgagccctaacatccagccgtccccagctcacgagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccagggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccaaagggctgagcctcctggcctgcctgcccgcccaccctgggagtcccagtggtgaggctcagagaactgctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctg

SEQ ID NO: 1653 - DNA, 3360 bp, Homo sapiens
cccgtcagtgactcgctttctccggggaccgacccccctcctgcggagaggcccgcgccgcggcagcccgtggtcttgcgcggcctgcgcctgctccgcttgtcccgcagagtgcggtgagacccgggcgtcgggcctgaccggggcgcccgctccccagccgcggcgtgacagcgcagccgctggcactttcggcccagagtcaagcgtggcgtggggggcaccagcagagggaaccgggggttgctggaactgggaggagagaacagtcgtctaaaggaaaagcgggccccaaggttggagaaggagggatgccctagaaaggcgctggtcccttgttttctgtgctgagtgatgacctgacacccatgggaaaaggtcgctgctggacacctggatcgggtctgtcatacacggaggaagcggctgttctaccatctgcctgcccttctgccatccgagcgccctgactgcgccacactgcaggccatggagaatgagctgccagtcccacatacatctagcagtgcctgtgccaccagcagtaccagcggggccagtagcagcagtggctgcaacaacagcagcagtggtggaagtggccgccccaccgggccccagatttctgtgtacagtggtattccagaccggcagaccgtgcaggtgatccagcaggccctgcacagacagcccagcacggccgctcagtacctgcagcagatgtacgccgcccagcagcagcacctcatgctgcagaccgcggcgctccagcagcagcacctcagcagcgcccagctccagagcctggcagccgtacagcaggcaagcctggtatccaatagacaaggaagcacttcaggcagcaatgtgtctgcgcaggccccggcccagtcatcttcgatcaacctggcagcctccccagcagcagcccagctcctcaaccgggcccagagtgtgaactctgcagcagcctcaggcatcgctcagcaggctgtgctcttgggcaacacgtcttccccagccctgactgcaagccaagcacagatgtatctgagggcacagatgctcatcttcacgcccacggccaccgtcgctactgtgcagcctgagctcggcactggctcccccgcccggccccccacccccgcccaggtacagaacttgaccctccgaacacagcagacaccagcggcagcagcctcgggccccacccccactcagcctgtcctgcccagcttggccctgaaacccacgccgggcggtagccagcctctgcctaccccagcacagagcagaaatactgctcaggcttcccctgcaggtgccaagcctggcatagctgacagtgtgatggagccacacaagaaaggagatggcaacagcagtgtgccagggagcatggaaggccgggctgggctcagccggacggttcctgctgtggctgcccaccccctcattgcaccagcctatgctcagctgcagccacaccagctcctcccacagccatcctcaaagcacctgcagccccaatttgtgatccagcagcagccacagccacaacagcagcagccgccgccccagcagtcacggcctgtgctccaagctgagccccacccccagctcgcctcagtctctccaagcgtggccctccagcccagctcagaggcccatgccatgccactaggcccggttacacccgccctgccactccagtgtcccactgccaacctgcacaagcctggcggcagtcagcagtgtcaccctcccacacctgatactgggcctcagaatggacatcccgagggcgtgccccacacccctcaacgcaggttccagcacacttcagctgtcatcttacaactgcagcctgcttcaccagtgccccagcagtgtgtccctgatgactggaaagaagtggcaccaggggagaaaagtgtgcctgagacgcggtctggcccatcaccacatcagcaggctattgtcactgccatgcctggtggcctgcctgtacccacgagccctaacatccagccgtccccagctcacgagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccct

SEQ ID NO: 1654 - DNA, 3786 bp, Homo sapiens
catctgcctgcccttctgccatccgagcgccctgactgcgccacactgcaggccatggagaatgagctgccagtcccacatacatctagcagtgcctgtgccaccagcagtaccagcggggccagtagcagcagtggctgcaacaacagcagcagtggtggaagtggccgccccaccgggccccagatttctgtgtacagtggtattccagaccggcagaccgtgcaggtgatccagcaggccctgcacagacagcccagcacggccgctcagtacctgcagcagatgtacgccgcccagcagcagcacctcatgctgcagaccgcggcgctccagcagcagcacctcagcagcgcccagctccagagcctggcagccgtacagcaggcaagcctggtatccaatagacaaggaagcacttcaggcagcaatgtgtctgcgcaggccccggcccagtcatcttcgatcaacctggcagcctccccagcagcagcccagctcctcaaccgggcccagagtgtgaactctgcagcagcctcaggcatcgctcagcaggctgtgctcttgggcaacacgtcttccccagccctgactgcaagccaagcacagatgtatctgagggcacagatggtacagaacttgaccctccgaacacagcagacaccagcggcagcagcctcgggccccacccccactcagcctgtcctgcccagcttggccctgaaacccacgccgggcggtagccagcctctgcctaccccagcacagagcagaaatactgctcaggcttcccctgcaggtgccaagcctggcatagctgacagtgtgatggagccacacaagaaaggagatggcaacagcagtgtgccagggagcatggaaggccgggctgggctcagccggacggttcctgctgtggctgcccaccccctcattgcaccagcctatgctcagctgcagccacaccagctcctcccacagccatcctcaaagcacctgcagccccaatttgtgatccagcagcagccacagccacaacagcagcagccgccgccccagcagtcacggcctgtgctccaagctgagccccacccccagctcgcctcagtctctccaagcgtggccctccagcccagctcagaggcccatgccatgccactaggcccggttacacccgccctgccactccagtgtcccactgccaacctgcacaagcctggcggcagtcagcagtgtcaccctcccacacctgatactgggcctcagaatggacatcccgagggcgtgccccacacccctcaacgcaggttccagcacacttcagctgtcatcttacaactgcagcctgcttcaccaccccagcagtgtgtccctgatgactggaaagaagtggcaccaggggagaaaagtgtgcctgagacgcggtctggcccatcaccacatcagcaggctattgtcactgccatgcctggtggcctgcctgtacccacgagccctaacatccagccgtccccagctcacgagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtgggacgctcgtccctgctggtggggaatctcaagaagaagtatgcacaggggttcctgcctgagaaacttccacagcaggatcacaccaccaccactgactcggagatggaggagccctatctgcaagaatccaaagaggagggtgctcccctcaaactcaagtgtgagctctgtggccgggtggactttgcctataagttcaagcgttccaagcgcttctgttccatggcttgtgcaaagaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggctgccaggagatagcagaggaattccgtgcccaggaaatcgacgggcaagccctgctgctgctcaaggaggaccacctgatgagcgccatgaacatcaagctggggcccgccctgaagatctacgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccagggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctcccccctacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccccgcactgtgaagttcccctgaccgccctcctggttcacaaagagcattaagaaagctgcggtggtctgagcaacatagcccaaagggctgagcctcctggcctgcctgcccgcccaccctgggagtcccagtggtgaggctcagagaactgctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctgtct

SEQ ID NO: 1655 - DNA, 2427 bp, Homo sapiens
tggaggagagaagatggcggaagcggagtgagtgactagatgatttaaggaccatagtacagctatggatactgaaccaaacccgggaacatcttctgtgtcaacaacaaccagcagtaccaccaccaccaccatcaccacttcctcctctcgaatgcagcagccacagatctctgtctacagtggttcagaccgacatgctgtacaggcattgcatcggccccccagctcagctgctcagtaccttcagcaaatgtatgcagcccaacaacagcacttgatgctgcatactgcagctcttcagcagcagcatttaagcagctcccagcttcagagccttgctgctgttcaggcaagtttgtccagtggaagaccatctacatctcccacaggaagtgtcacacagcagtcaagtatgtcccaaacgtctatcaacctctccacttctcctacacctgcacagttaataagccgttcccaggcttccagttctaccagcggcagtattacccaacagactatgttactagggagtacttcccctaccctaacggcaagccaagctcaaatgtatctccgagctcaaatggtaagatatgagctaccaaattttttcagtgtttaaggacttgagagatcaaaatgtttcttgatttgatacaataagaggtatttttaatatttaagaaatgtttaattgtgtgtgtgtgcatgcgggcgtgccttcagctcttgtacatttatgtcatgaaagattctacttttaattaataggtcttcttggtatcaaatagtaattattacattgagaagctaatagagattcagtaacgtaagagtgattattttttaatatcaaattcattgaaaacctttttttcatattttaatatctgtgaaatttggatgcattttataactgatggcatcttggtacttacagtggtccataaaatcattgcctgtttttgtcaacttagatttggtgaaatagagatgttaaaaaaactttgttgttaaagttataatttgtatcctaggattttctgaattctatattggagttccggatagtctcccagatgattcttaactttggtttttcccatctcaaattctgcaaggttatttgtgttcttgtgttcattttgatattttatgaatataggaatgttaatttggttattctgtatttgagtatctacagattttctaatttaattgttgagcttctttaaggaatatagaaattggttgacatgtattttatttgatgtctttacaagaagctagacaaaagcattgtccctaatatatatttatattcttttttgtccagtggactgaatatatatctggatctccagtttttgttgttgttgttgttgttgttgttattgttttttgaggtgaagtctcactctgtcacccaggctagagtgcagtggcacgatctctgctcactgcaacctctgcctcccgggttcaagtgattctcccacctcagcctcccaagtagctgggattacaggtgcccgccaccacacccagctaatttttgtatttttagtagagacggggtttcaccatcttggcctggctggtctcaaactcctgaccttgtgatccacctgcctcacctcccagaatgctgggattacagacatgaaccaccacacctggcttggatcttcagttttctatctaaaattgcaaagtttccaatcatttaactcatactatgctttaaaattaggttgaaccatttgagatggttgctatttggctatttttgaactctaaaattagcagtttcatacgggtcaaactaaattgaatatcttctttttaggtttagtcctttcagggtgttggtactggaaattaccttttcaggaaagttataccatttgtcccttggtgtctgtggtggattgttgccaggccctaccctctctgtcccctagaatacccaaatctgaggatgctcaaggcatagtatttgcatataacctatgtatatcctcccatatactttacatcgtctttacatatatttagtataatataaacatcatttaaataactgttatactatattgtttagggaataataacaagagaaaaatttgtacatgttcaatgcagatgcagctattttttttaaatgaatattgttttgatctatagttgaatgacgaagcacagagccttccataggtatggagggctcatcattgtactttgttgttgaatttacttagatttagtgtaccaaagaactgaagtttaaaaggtcacttaattggtcgtttaattttctaatttttttggatccgcatttggttgaacattttaatttagatagcaagaggaactgaataacccttgatacaattttgaaataaagtatttacacattctttg

SEQ ID NO: 1656 - DNA, 772 bp, Homo sapiens
gcagcccatgttagtgatggaggagagaagatggcggaagcggaatttaaggaccatagtacagctatggatactgaaccaaacccgggaacatcttctgtgtcaacaacaaccagcagtaccaccaccaccaccatcaccacttcctcctctcgaatgcagcagccacagatctctgtctacagtggttcagaccgacatgctgtacaggtaattcaacaggcattgcatcggccccccagctcagctgctcagtaccttcagcaaatgtatgcagcccaacaacagcacttgatgctgcatactgcagctcttcagcagcagcatttaagcagctcccagcttcagagccttgctgctgttcaggcaagtttgtccagtggaagaccatctacatctcccacaggaagtgtcacacagcagtcaagtatgtcccaaacgtctatcaacctctccacttctcctacacctgcacagttaataagccgttcccaggcttccagttctaccagcggcagtattacccaacagactatgttactagggagtacttcccctaccctaacggcaagccaagctcaaatgtatctccgagctcaaatgctgattttcacacccgctaccactgtggctgctgtacagtctgacattcctgttgtctcgtcgtcatcgtcatcttcctgtcagtctgcagctactcaggttcagaatttaacattacgcagccagaagttgggtgtattatctagctcacagaatggtccaccaaaaa

SEQ ID NO: 1657 - DNA, 1075 bp, Homo sapiens
gcgcagcccatgttagtgatggaggagagaagatggcggaagcggaatttaaggaccatagtacagctatggatactgaaccaaacccgggaacatcttctgtgtcaacaacaaccagcagtaccaccaccaccaccatcaccacttcctcctctcgaatgcagcagccacagatctctgtctacagtggttcagaccgacatgctgtacaggcattgcatcggccccccagctcagctgctcagtaccttcagcaaatgtatgcagcccaacaacagcacttgatgctgcatactgcagctcttcagcagcagcatttaagcagctcccagcttcagagccttgctgctgttcaggcaagtttgtccagtggaagaccatctacatctcccacaggaagtgtcacacagcagtcaagtatgtcccaaacgtctgtaagttccctaaatttttttttcctggatttaaaattttaaagaattgttttccaaaagtaaactgttgttatttatgaagctgttattataatttgttgcatgctgtttaaagtaacaattgcccagaaatagaaatgataaaattcaagaattcagaactaatgttaaacttatgaaaatctgagtcttaaaaaaatctttttgtattatttcttgtatatccatttgcactgatcatgttcagatcttatgtggtttcagctttctgtgtgtattgaaagcctaaaatatacaatgcagggatattggccatgaatttactgtgatatacaatagtatgtcatgtccttggtagacatctaagcatttctaactttgtgcaattcacattttagaaattatactttcagcttacatgagttatttgggttcaatttgcaagtatccattcaagatagggtaatttattttgagaaaggagtaaaagaaagctgattcgctatattgcacatatatattgggaaattgtgccaagtttcccaggtaaaataaatttatgggcatggtaatacttgtttagcttttaattttggtataattttaaactgcaataataataaaaaaatttctgtatctac

SEQ ID NO: 1658 - DNA, 913 bp, Homo sapiens
gtcgttggaatcgtaagcctgataatcaaagtcttgggcatcgtggccgtcgtccaagtggccctgatggggcagcgagagaacatatccttaggcagcttccaattacttatccatctgcagaagaagacttggcttctcatgaagattctgtgccatctgctatgacaactcgtctgcgcaggcagagcgagcgggaaagagaacgtgagcttcgggatgtgagaattcggaaaatgcctgagaacagtgacttgctaccagttgcacaaacagagccatctatatggacagttgatgatgtctgggccttcatccattctttgcctggctgccaggatatcgcagatgaattcagagcacaggagattgatggacaggcccttctcttgctgaaagaagaccatctcatgagtgcaatgaatatcaagctaggcccagccctgaagatctgtgcacgcatcaactctctgaaggaatcttaacaggaacatgaagccttgataaaacagcagttttacttttctcacaaaaacttgtaagatctgatcatagagaggtggacatatgattgaagtcaggttgaacagtcattccccgggactgtatatttgaagaagttaggagatgctttaagtaagtgtaattaattatgaaagccctgagctgctggcagccagaacacccactttgtggacacaaaatggaaaccgacaactcagagagattctcctagtagtttactaagtaagttcttgccaatatccagcttgttcttagaatggctcaggttgagtttgtattacctgctactcaaagaattcttgactgactctccaggagcatttcccaacttgtctttatagatgcttaattaattaattttagctaattaaagagacttgtgtgctca

SEQ ID NO: 1659 - DNA, 5030 bp, Homo sapiens
agtgatggaggagagaagatggcggaagcggagtgagtgactagatgatttaaggaccatagtacagctatggatactgaaccaaacccgggaacatcttctgtgtcaacaacaaccagcagtaccaccaccaccaccatcaccacttcctcctctcgaatgcagcagccacagatctctgtctacagtggttcagaccgacatgctgtacaggtaattcaacaggcattgcatcggccccccagctcagctgctcagtaccttcagcaaatgtatgcagcccaacaacagcacttgatgctgcatactgcagctcttcagcagcagcatttaagcagctcccagcttcagagccttgctgctgttcaggcaagtttgtccagtggaagaccatctacatctcccacaggaagtgtcacacagcagtcaagtatgtcccaaacgtctatcaacctctccacttctcctacacctgcacagttaataagccgttcccaggcttccagttctaccagcggcagtattacccaacagactatgttactagggagtacttcccctaccctaacggcaagccaagctcaaatgtatctccgagctcaaatgctgattttcacacccgctaccactgtggctgctgtacagtctgacattcctgttgtctcgtcgtcatcgtcatcttcctgtcagtctgcagctactcaggttcagaatttaacattacgcagccagaagttgggtgtattatctagctcacagaatggtccaccaaaaagcactagtcaaactcagtcattgacaatttgtcataacaaaacaacagtgaccagttctaaaatcagccaacgagatccttctccagaaagtaataagaaaggagagagcccaagcctggaatcacgaagcacagctgtcacccggacatcaagtattcaccagttaatagcaccagcttcatattctccaattcagcctcattctctaataaaacatcagcagattcctcttcattcaccaccttccaaagtttcccatcatcagctgatattacaacagcagcaacagcaaattcagccaatcacacttcagaattcaactcaagacccacccccatcccagcactgtataccactccagaaccatggccttcctccagctcccagtaatgcccagtcacagcattgttcaccgattcagagtcatccctctcctttaacagtgtctcctaatcagtcacagtcagcacagcagtctgtagtggtgtctcctccaccacctcattcaccaagtcagtctcctactataattattcatccacaagcacttattcagccacaccctcttgtgtcatcagctctccagccagggccaaatttgcagcagtccactgctaatcaggtgcaagctacagcacagttgaatcttccatcccatcttccacttccagcttcccctgttgtacacattggcccagttcagcagtctgccttggtatccccaggccagcagattgtctctccatcacaccagcaatattcatccctgcagtcctctccaatcccaattgcaagtcctccacagatgtcgacatctcctccagctcagattccaccactgcccttgcagtctatgcagtctttacaagtgcagcctgaaattctgtcccagggccaggttttggtgcagaatgctttggtgtcagaagaggaacttccagctgcagaagctttggtccagttgccatttcagactcttcctcctccacagactgttgcggtaaacctacaagtgcaaccaccagcacctgttgatccaccagtggtttatcaggtagaagatgtgtgtgaagaagaaatgccagaagagtcagatgaatgtgtccggatggatagaaccccaccaccacccactttgtctccagcagctataacagtggggagaggagaagatttgacttctgaacatcctttgttagagcaagtggaattacctgctgtggcatcagtcagtgcttcagtaattaaatctccatcagatccctcacatgtttctgttccaccacctccattgttacttccagctgccaccacaaggagtaacagtacatctatgcacagtagcattcccagtatagagaacaaacctccacaggctattgttaaaccacagatcctaacccatgttattgaaggctttgtgattcaggagggattggagccatttcctgtgagtcgttcctctttgctaatagaacagcctgtgaaaaaacggcctcttttggataatcaggtgataaattcagtgtgtgttcagccagagctacagaataatacaaaacatgcggataattcatctgacacagagatggaagacatgattgctgaagagacattagaagaaatggacagtgagttgctcaagtgtgaattctgtgggaaaatgggatatgctaatgaatttttgcggtcaaaacgattctgcactatgtcatgtgccaaaaggtacaatgttagctgttctaaaaaatttgcacttagtcgttggaatcgtaagcctgataatcaaagtcttgggcatcgtggccgtcgtccaagtggccctgatggggcagcgagagaacatatccttaggcagcttccaattacttatccatctgcagaagaagacttggcttctcatgaagattctgtgccatctgctatgacaactcgtctgcgcaggcagagcgagcgggaaagagaacgtgagcttcgggatgtgagaattcggaaaatgcctgagaacagtgacttgctaccagttgcacaaacagagccatctatatggacagttgatgatgtctgggccttcatccattctttgcctggctgccaggatatcgcagatgaattcagagcacaggagattgatggacaggcccttctcttgctgaaagaagaccatctcatgagtgcaatgaatatcaagctaggcccagccctgaagatctgtgcacgcatcaactctctgaaggaatcttaacaggaacatgaagccttgataaaacagcagttttacttttctcacaaaaacttgtaaggtaaaggcctaacttggtctagaatatgacacttattgtggtggatagccaagcacattgggatctccacatcaaatactgacatttcttctacaggtataataattcatcatgcattttcataattaataaacattggtaaaattaattttacaggttacatgaaacattgaaagacttgttacagagggccatgatatttttcaaagaaatgtgttatactagataatttttttaaaggtgatgtttatcattaatataaagaatccttttaaaagtaatttaatgatttacatttctcctcttttgattcaattttcttatacattttttctaccctattagttttctaaaggttgtcatgagaggtatattatggaataatttagtagtccagtgacagaatcgtatgaaatcagtgtacattttaaaaaacatgtcttttagacatatgctttatctataaaaaaggaattgtgttctagtatgaacaatactgatctggaagtgagaagagttagtttctattccaaacttgaccaagaatttggtttgactgagaacgttttcctctcagtttttgtacatttatttagagcagtggttctcagtggaggtcagttttgatcgccaggggacatctggcaatgttgagacattttggttgtcacagcttgggggtgggttcaggggagggttgctactggtgtctagtagttagaagccagagatgtttctaaacatcttataatgcacaggacagcacccctccactgtaaagaattattggttcaaaaatatcggtactgccaaggttgagaaactctgatatagaaggagtgataaatattgttttcacccaaaggaatacttttaaaggatgaagcttactaaacatatatgatggaagtattattcagataacattaatattctgctgaataattttttctagtttaatcatactagaaaaagaaaaaaaatctacaaattgtcctataaaataaggacaaacatgcaaataatttaactctcagaaagtactaattcattctgattatctttcatacctctgtgctcctctgcactgacgaagacataatatgattatacctatgaactagtgcacagccttttctggcaagaaaatagtttgtagcagatacgtggttgctctttggatttttttctattgttgaacatgctgggactagctagaatgcacattcctacttcctttaccaaacgtttgcatgcttcctgcaaagcacttaccaagtgatttctcttgaaccatcggatataattttgtatgtacatgtttgaggaaaaaaatgtaaagcaaaaccttttactgaacagtgttctatagaattatgacactaaaacaaaattgtttgtggaagccctgaaagctttatagtcctggacatcaaaaattttatttgagatgatgaatgttttgttttcatcttttcttatattaccacaattgagatattttagtaattgaaggaacatacacagatatttggcagaagtcgagtaaggaggggaaaaaaagagtccgtgagtttcagtcattttcactgctcttttcaaaaagattgtgttgagctggtagaagactaaagatgtcactgaagacatcacagatactatatttatcttttggctttgtgtacattagagaatgttgattatttttatacaaaaatacagcgggtaatttttttaatctttagatgcctcttgtttgaatgtatgctttgtggaattctttgtgtagtaatgttttaaaaaaagatgtttactgatagttacatgtaggattagaatatgtaatataatataaggctcatgttccagacctacgatagcttgtagtctatgttacgtatttctttatatcacatttttaatcattggattaaagtatcaaggaaagcta

SEQ ID NO: 1660 - DNA, 3359 bp, Homo sapiens
gcgcagcccatgttagtgatggaggagagaagatggcggaagcggaatttaaggaccatagtacagctatggatactgaaccaaacccgggaacatcttctgtgtcaacaacaaccagcagtaccaccaccaccaccatcaccacttcctcctctcgaatgcagcagccacagatctctgtctacagtggttcagaccgacatgctgtacaggtaattcaacaggcattgcatcggccccccagctcagctgctcagtaccttcagcaaatgtatgcagcccaacaacagcacttgatgctgcatactgcagctcttcagcagcagcatttaagcagctcccagcttcagagccttgctgctgttcaggcaagtttgtccagtggaagaccatctacatctcccacaggaagtgtcacacagcagtcaagtatgtcccaaacgtctatcaacctctccacttctcctacacctgcacagttaataagccgttcccaggcttccagttctaccagcggcagtattacccaacagactatgttactagggagtacttcccctaccctaacggcaagccaagctcaaatgtatctccgagctcaaatgctgattttcacacccgctaccactgtggctgctgtacagtctgacattcctgttgtctcgtcgtcatcgtcatcttcctgtcagtctgcagctactcaggttcagaatttaacattacgcagccagaagttgggtgtattatctagctcacagaatggtccaccaaaaagcactagtcaaactcagtcattgacaatttgtcataacaaaacaacagtgaccagttctaaaatcagccaacgagatccttctccagaaagtaataagaaaggagagagcccaagcctggaatcacgaagcacagctgtcacccggacatcaagtattcaccagttaatagcaccagcttcatattctccaattcagcctcattctctaataaaacatcagcagattcctcttcattcaccaccttccaaagtttcccatcatcagctgatattacaacagcagcaacagcaaattcagccaatcacacttcagaattcaactcaagacccacccccatcccagcactgtataccactccagaaccatggccttcctccagctcccagtaatgcccagtcacagcattgttcaccgattcagagtcatccctctcctttaacagtgtctcctaatcagtcacagtcagcacagcagtctgtagtggtgtctcctccaccacctcattcaccaagtcagtctcctactataattattcatccacaagcacttattcagccacaccctcttgtgtcatcagctctccagccagggccaaatttgcagcagtccactgctaatcaggtgcaagctacagcacagttgaatcttccatcccatcttccacttccagcttcccctgttgtacacattggcccagttcagcagtctgccttggtatccccaggccagcagattgtctctccatcacaccagcaatattcatccctgcagtcctctccaatcccaattgcaagtcctccacagatgtcgacatctcctccagctcagattccaccactgcccttgcagtctatgcagtctttacaagtgcagcctgaaattctgtcccagggccaggttttggtgcagaatgctttggtgtcagaagaggaacttccagctgcagaagctttggtccagttgccatttcagactcttcctcctccacagactgttgcggtaaacctacaagtgcaaccaccagcacctgttgatccaccagtggtttatcaggtagaagatgtgtgtgaagaagaaatgccagaagagtcagatgaatgtgtccggatggatagaaccccaccaccacccactttgtctccagcagctataacagtggggagaggagaagatttgacttctgaacatcctttgttagagcaagtggaattacctgctgtggcatcagtcagtgcttcagtaattaaatctccatcagatccctcacatgtttctgttccaccacctccattgttacttccagctgccaccacaaggagtaacagtacatctatgcacagtagcattcccagtatagagaacaaacctccacaggctattgttaaaccacagatcctaacccatgttattgaaggctttgtgattcaggagggattggagccatttcctgtgagtcgttcctctttgctaatagaacagcctgtgaaaaaacggcctcttttggataatcaggtgataaattcagtgtgtgttcagccagagctacagaataatacaaaacatgcggataattcatctgacacagagatggaagacatgattgctgaagagacattagaagaaatggacagtgagttgctcaagtgtgaattctgtgggaaaatgggatatgctaatgaatttttgcggtcaaaacgattctgcactatgtcatgtgccaaaaggtacaatgttagctgttctaaaaaatttgcacttagtcgttggaatcgtaagcctgataatcaaagtcttgggcatcgtggccgtcgtccaagtggccctgatggggcagcgagagaacatatccttaggcagcttccaattacttatccatctgcagaagaagacttggcttctcatgaagattctgtgccatctgctatgacaactcgtctgcgcaggcagagcgagcgggaaagagaacgtgagcttcgggatgtgagaattcggaaaatgcctgagaacagtgacttgctaccagttgcacaaacagagccatctatatggacagttgatgatgtctgggccttcatccattctttgcctggctgccaggatatcgcagatgaattcagagcacaggagattgatggacaggcccttctcttgctgaaagaagaccatctcatgagtgcaatgaatatcaagctaggcccagccctgaagatctgtgcacgcatcaactctctgaaggaatcttaacaggaacatgaagccttgataaaacagcagttttacttttctcacaaaaacttgtaaggtaaaggcctaacttggtctagaatatgacacttattgtggtggatagccaagcacattgggatctccacatcaaatactgacatttcttctacaggtataataattcatcatgcattttcataattaataaacattggtaaaattaattttacaggttacatgaaacattgaaagacttgttacagagggccatgatatttttcaaagaaatgtgttatactagataatttttttaaaggtgatgtttatcattaatataaagaatccttttaaaagtaa

SEQ ID NO: 1661 - DNA, 2087 bp, Homo sapiens
agtgatggaggagagaagatggcggaagcggaatttaaggaccatagtacagctatggatactgaaccaaacccgggaacatcttctgtgtcaacaacaaccagcagtaccaccaccaccaccatcaccacttcctcctctcgaatgcagcagccacagatctctgtctacagtggttcagaccgacatgctgtacaggtaattcaacaggcattgcatcggccccccagctcagctgctcagtaccttcagcaaatgtatgcagcccaacaacagcacttgatgctgcatactgcagctcttcagcagcagcatttaagcagctcccagcttcagagccttgctgctgttcaggcaagtttgtccagtggaagaccatctacatctcccacaggaagtgtcacacagcagtcaagtatgtcccaaacgtctgtaagttccctaaatttttttttcctggatttaaaattttaaagaattgttttccaaaagtaaactgttgttatttatgaagctgttattataatttgttgcatgctgtttaaagtaacaattgcccagaaatagaaatgataaaattcaagaattcagaactaatgttaaacttatgaaaatctgagtcttaaaaaaatctttttgtattatttcttgtatatccatttgcactgatcatgttcagatcttatgtggtttcagctttctgtgtgtattgaaagcctaaaatatacaatgcagggatattggccatgaatttactgtgatatacaatagtatgtcatgtccttggtagacatctaagcatttctaactttgtgcaattcacattttagaaattatactttcagcttacatgagttatttgggttcaatttgcaagtatccattcaagatagggtaatttattttgagaaaggagtaaaagaaagctgattcgctatattgcacatatatattgggaaattgtgccaagtttcccaggtaaaataaatttatgggcatggtaatacttgtttagcttttaattttggtataattttaaactgcaataataataaaaaaatttctgtatctactctactcagattaatcaattattgcatattgccccattactttatcattcattcttttccactacatgtatacatatttttttctgagtcatttgtaagttgagatatgttcctttattcctaaatactttgatgtgtatttcctaagaacaaggctattgttttttgaagccacagaaaaattactaaattcaggaaatataacattgatacagtgcagttcattttcacatttcatcatttgtctcaggtttcccaacctcatcactatggacattatgagccagataattctttgttgtcaggggctatcgtgtaatttataggatgtttagcagcatccctggctactagatgccggcagcttgtggtctttctccttcctctagtgtgacaactataggtgtttcctggtggggggcaaactgcctgtagttgagaacctaataatgtcctttctagatattttttcctggtccagaatggtaatactttgatacttcataaaattggctccaatacaatatagtttgtaggttgttaaggaattgaaggttaaggaattgtgctctatttcttcagctaagggtatggtctttgctaactacatgctgtggtcagcatatagctgtggttttttttgttgtttggtttttttttctggctgttgatctgactttttttttttggcgtgggaatgtcctggagtgtgaacaagattagtttaaaaagttccctatgacttgaagatgttagattaaatgaaaaacttaaataatgtaacctagctcttaagcattaatactggagtttttgtcattgacatcagatgtctttaatacaatggtaattaaggaaaggagtggtaaatattttgtgggctactgaaggaaattatatagacaaattctttattctgtgaaatactggaataacaataggatgtatttgtatagatatgttattttgaatttttttccttcatgttattaaaaggtatctttttaaactgtc

SEQ ID NO: 1662 - DNA, 3744 bp, Homo sapiens
gcagctgctgactggcgggccgccaggcgcgtgcgtagagacgcccacacgcccgctgatgcgcacgcgccctgggccgcgcgtgcgcgcgtggggttccggaatgagccggggaaagcaaggggaaggtttggggttggctcccggtttcgcgcatgcgtgcactgcacaaaccatttggcgggtttttccggccactcagttctgccaccgtcactgagaagctcagcggtagcttttgggaagcaggacgttctcaccaggagagcgtcctctcgagatttctgctccctccattcagggcgtttgggagccaccccttcattttttaaaaaaagtatttctctgtgaccgacggccggggccttctgacggtctgaggtcttgcttgggccagtcacctcctgtcacggtccgcggaggggggaaggataagagggcgaggagctcatcgctcgccacccccgtgggcttcttgggcgcaggtcggagctgggtgggccggctccccggcccctggcttgggcgaccatgtccgcatccgcccagcagctggcggaggagctgcagatcttcggcctagactgcgaggaggctctaattgagaaattggtagagctttgtgttcagtatggacagaatgaggagggaatggtaggcgagcttatagccttctgcaccagcacacataaagttggccttacctcagagatcctgaactcttttgagcatgagtttctgagcaaaagattatcgaaagccaggcatagtacctgcaaggacagtggccatgcaggagctagagacattgtttccattcaagagctaattgaagtggaagaagaagaggaaatcctcttgaactcttacaccacaccttcaaagggttctcagaagcgagctatctctaccccagaaacccccctaacaaaaaggagtgtgtcaactcgtagcccccatcagctactctcaccgtcaagtttctctccaagtgctactccctcccagaaatacaactcacgaagtaaccgaggagaagtggttacctccttcggcttagcacagggagtatcttggtctgggagaggaggagctggaaacatcagcctgaaggtcttgggatgtccagaggcactaactgggagctacaaatccatgtttcagaagctcccagacattcgagaagttctgacctgtaagatagaagaacttggcagcgaactcaaggaacattacaagattgaagctttcactcctttgctagccccagcacaggagcctgtcactctgctgggccagattggctgtgatagcaacgggaagctgaacaacaagtcagtgattctcgagggagaccgggaacattcctcgggtgctcaaattccagtggatttatctgagcttaaggaatattctctgtttcctggacaggttgtaattatggaaggaatcaacaccactggtaggaaacttgttgccaccaaactctacgagggtgtgccacttccattttatcagcccactgaagaggatgcagactttgagcaaagcatggtcctggttgcctgtggaccatacaccacatctgacagcatcacgtatgaccccctgcttgacctgattgctgtcatcaaccatgaccggccagatgtctgcatcctgtttggccctttcctggatgctaagcatgaacaggtggagaattgtctactgacaagtccatttgaagacattttcaagcagtgtctacgaacaattattgaaggcacaagaagctccggctcccaccttgtctttgtcccgtcattgagagatgtgcaccatgagcctgtgtacccccagccgcctttcagctactccgatctgtctcgagaggacaaaaagcaagtacagtttgtgtccgagccctgcagcctctccataaacggagtgatcttcggcttgacatccacagatctgcttttccacctgggggccgaggagatcagtagttcttccggaacttcagacagattcagccgaatactcaagcacatcttgacccagaggagctactacccactctacccgccccaagaagacatggccattgactatgagtcgttctatgtttacgcacagctgcctgtcaccccagatgtcctcatcatcccgtcagagctgaggtacttcgtgaaggatgtcctcggctgtgtctgtgtgaaccctgggcgccttaccaaagggcaggtgggaggcaccttcgcccgactctaccttaggaggccggcagcggacggggcagagaggcagagcccatgcattgctgtgcaggtcgtcaggatctgaggcttctgtcctctgctgttctctgctgtgtgggcccttaaagtcttagccaagagccaagacatagccctgtgacaaggtgaacagttgggtgggaaaggagagaggagccagccagggaggggcagctgcagtgaccaggcccagcagggaggacttgtgcagccgggcctgcctctgagtggtgcctctcctggaaggaagctcttgcttctcagtccatgctccgtgtccagaagtaagccagctgtggatcccgcccactcagaaaaggcgagaaggctttgtgattttctacatgaatcaaacacagaaacaacttttggagaaattaaattctgagtgtgacttctgagtttgacctttcttctattttcttttatttatttattttgtttttagacggagtctcgatctgtcgcccaggctggagtgcagtggtgagatctcggctcactgcaagctctgccgcccgggttcatgccattctcctgcctcagcctcctgagtagctgggactacaggcacccaccaccacgcctggctaattttttgtatttttagtggagatggggtttcaccatgttagccaggatggtctcgatctcctgaccttgtgatctgtccgcctcagcctcccaaagtgctgggattacaggcgtgagccaccgcgcccggcccctttcttctattttctttatcctggtagtagacaaagaatgttgcctatttgacctatgtccagagaaggcagagtgtcagtcacactgggtttctatccagccccagtcctgtccagtgggtaactctcagccccactcctcatcccccaaaggccccagtgacctctatgctgcagaggtgcactgggtgggccctagagctgggctgcagagcaagcaactggctgcatgcctgggcctccctgcgcagttcctcacatgcatgctgtggtcccagcctgacctctccatctggagggggccgcctcgctgggctgttccaaagctggagtcctggtggcagctgctttgccaagtcgcgcagtagccagggcttgcctgcagcccagaacactcagacagggtcaggccttccagggttcacagcacgtcccatgcccctatgtcctggcatctggggaaaagctgtcactggccagacgtggagtggcttcctgccctaagctggcaggctgtcctgcctcacatgccagagccaagaccggcaaaccccagctgtcagggcagggaagtgggcaagggggcagcaagctgctggtgtctatgccttgactccgagataaatagatgacctaacagtggccaacttttgcctctcacctttctgacggtgaaatggaatcgagccccagacctgaccagggtacagtaaaaggtcttcctttaaacacaa

SEQ ID NO: 1663 - DNA, 2073 bp, Homo sapiens
agttctgccaccgtcactgagaagctcagcggtagcttttgggaagcaggacgttctcaccaggagagcgtcctctcgagatttctgctccctccattcagggcgtttgggagccaccccttcattttttaaaaaaagtatttctctgtgaccgacggccggggccttctgacggtctgaggtcttgcttgggccagtcacctcctgtcacggtccgcggaggggggaaggataagagggcgaggagctcatcgctcgccacccccgtgggcttcttgggcgcaggtcggagctgggtgggccggctccccggcccctggcttgggcgaccatgtccgcatccgcccagcagctggcggaggagctgcagatcttcggcctagactgcgaggaggctctaattgagaaattttctgagcaaaagattatcgaaagccaggcatagtacctgcaaggacagtggccatgcaggagctagagacattgtttccattcaagagctaattgaagtggaagaagaagaggaaatcctcttgaactcttacaccacaccttcaaagggttctcagaagcgagctatctctaccccagaaacccccctaacaaaaaggagtgtgtcaactcgtagcccccatcagctactctcaccgtcaagtttctctccaagtgctactccctcccagaaatacaactcacgaagtaaccgaggagaagtggttacctccttcggcttagcacagggagtatcttggtctgggagaggaggagctggaaacatcagcctgaaggtcttgggatgtccagaggcactaactgggagctacaaatccatgtttcagaagctcccagacattcgagaagttctgacctgtaagatagaagaacttggcagcgaactcaaggaacattacaagattgaagctttcactcctttgctagccccagcacaggagcctgtcactctgctgggccagattggctgtgatagcaacgggaagctgaacaacaagtcagtgattctcgagggagaccgggaacattcctcgggtgctcaaattccagtggatttatctgagcttaaggaatattctctgtttcctggacaggttgtaattatggaaggaatcaacaccactggtaggaaacttgttgccaccaaactctacgagggtgtgccacttccattttatcagcccactgaagaggatgcagactttgagcaaagcatggtcctggttgcctgtggaccatacaccacatctgacagcatcacgtatgaccccctgcttgacctgattgctgtcatcaaccatgaccggccagatgtctgcatcctgtttggccctttcctggatgctaagcatgaacaggtggagaattgtctactgacaagtccatttgaagacattttcaagcagtgtctacgaacaattattgaaggcacaagaagctccggctcccaccttgtctttgtcccgtcattgagagatgtgcaccatgagcctgtgtacccccagccgcctttcagctactccgatctgtctcgagaggacaaaaagcaagtacagtttgtgtccgagccctgcagcctctccataaacggagtgatcttcggcttgacatccacagatctgcttttccacctgggggccgaggagatcagtagttcttccggaacttcagacagattcagccgaatactcaagcacatcttgacccagaggagctactacccactctacccgccccaagaagacatggccattgactatgagtcgttctatgtttacgcacagctgcctgtcaccccagatgtcctcatcatcccgtcagagctgaggtacttcgtgaaggtaggtttgaactctgctttttcccagaaacaccagaacccagtctttgactttcccttctagaccacccggcactcacccctcatgggtcagctgatggggatggggcctctagcaccctgccctgtggccttgtttctttggggaggtggtgggaccagaaaacaaacaactctgtcagtaaaatgcttgagtaaacagtgtcctctcctccctcccc

SEQ ID NO: 1664 - DNA, 2631 bp, Homo sapiens
ccgcccgcccacccgcttccgtcagcctcactggggcttccttccgtctcgctcggagtttccctctgcgttcgctccgcgctgctggaggctgtcgtcccaatgctccccaaacggcggcgagcgcgggtcgggtcccctagcggcgatgccgcttcctccacgccgccctcgacgcgcttcccgggagtcgccatctacctggtcgagcctcgcatgggtcgcagccgccgggccttcctcacaggcctggcgcgctccaaaggcttccgcgtccttgacgcctgcagctccgaagcgacacatgttgtgatggaagagacctcagcagaggaggccgtcagctggcaggagcgcaggatggcagctgctcccccgggttgcacccccccagctctgctggacataagctggttaacagagagcctgggagctgggcagcctgtacctgtggagtgccggcaccgcctggaggtggctgggccaaggaaggggcctctgagcccagcatggatgcctgcctatgcctgccagcgccctacgcccctcacacaccacaacactggcctctccgaggctctggagatactggccgaggcagcaggctttgaaggcagtgagggccgcctcctcaccttctgcagagcagcctcggtgctcaaggcccttcccagccctgtcacaaccctgagccagctgcaggggcttccccactttggagaacactcctctagggttgtccaggagctgctggagcatggagtgtgtgaggaggtggagagagttcggcgctcagagaggtaccagaccatgaagctcttcacccagatcttcggggtcggtgtgaagactgctgaccggtggtaccgggaaggactgcgaaccttagatgacctccgagagcagccccagaaactaacccaacagcagaaagcggggctccagcaccaccaggacctgagcaccccagtcctgcggtccgatgtagatgccctgcagcaggtggtggaggaagctgtggggcaggccctgcctggggccaccgtcacgctgaccggcggcttccgcagggggaagttgcagggccatgacgtggacttcctcatcacccaccccaaggagggtcaggaggcggggctgctgcctagagtgatgtgccgcctgcaggaccagggcctcatcctgtaccaccagcaccagcacagctgctgtgagtcccctacccgcctggcccaacagagccacatggacgcttttgagagaagtttctgcattttccgcctaccacaacctccaggggctgctgtggggggatccacgaggccctgcccatcctggaaggccgtgagagtggacttggtagttgcacccgtcagccagttccctttcgccctgctcggttggactggctccaagcttttccagcgggagctgcgccgcttcagccggaaggagaagggcctgtggctgaacagccatgggctgtttgacccggagcagaagacatttttccaagcggcttcagaggaagacatcttcagacacctgggccttgagtaccttcctccagagcagagaaacgcctgagcctgcctgtgtcccccacttccactcaggaaattgggctgcccccaacctggccactgaatgtctccaggcagatatgctgccccctgacccccaccttcacccctccccgccaaggcctggctcttccggaggtcaattgtgcctgcaggatcagttgagcccctgctggtgtgctgcagggtgtgatgaggtgggagccctcagtgccagcctcatcactgtgtgaccctgggtctgctcttagcctccccatggctcacgttcctgccctggatgggatgtgagtggggcccacatcgtggagctgtggtggggcctgcagtcatgaatggcaagtggtccctgatgtgcagtgtctcattagttgcactgcagttaactgtggctcctgcagggcaccctgcccagaatgcccagaagagaaccatgcatacctgcactgcatttgagagccatgagctggaggctgtggttcgtgccagcaaggagcctactgtctggtgtgctgtaggcatctggagagggagagggcctgggtaggagctgggaggaagataattttcaactatggggcttcagtactgcagcgccccgagccaggctctgtgcttctgcctttaaggcctgttctcagcacaatgtctcaaaaataggtcatatcctgccactcccgtcgcagagccctttaatggttccaaaccctaagtccacacatagcccctggctctggcatctctccagccccactggccccgagctgcttgactcaccggcttcctatttgatgcacccaggcccccttgtggccaactccctccccttctcactgaggcagaagcactgaggtgggctggacatgggtgccctccacgtccctcatatccccaggcacactctggcctcaggttttgccctggccatgtcatctacctggagtgggccctccccttcttcaggccttgaatcaaaagccactttgttaggcgaggatttcccagaccactcatcacattaaaaaatattttgaaaacatgcagtaaa

SEQ ID NO: 1665 - DNA, 2444 bp, Homo sapiens
ccgcgctgctggaggctgtcgtcccaatgctccccaaacggcggcgagcgcgggtcgggtcccctagcggcgatgccgcttcctccacgccgccctcgacgcgcttcccgggagtcgccatctacctggtcgagcctcgcatgggtcgcagccgccgggccttcctcacaggcctggcgcgctccaaaggcttccgcgtccttgacgcctgcagctccgaagcgacacatgttgtgatggaagagacctcagcagaggaggccgtcagctggcaggagcgcaggatggcagctgctcccccgggttgcacccccccagctctgctggacataagctggttaacagagagcctgggagctgggcagcctgtacctgtggagtgccggcaccgcctggaggtggctgggccaaggaaggggcctctgagcccagcatggatgcctgcctatgcctgccagcgccctacgcccctcacacaccacaacactggcctctccgaggctctggagatactggccgaggcagcaggctttgaaggcagtgagggccgcctcctcaccttctgcagagcagcctcggtgctcaaggcccttcccagccctgtcacaaccctgagccagctgcaggggcttccccactttggagaacactcctctagggttgtccaggagctgctggagcatggagtgtgtgaggaggtggagagagttcggcgctcagagaggtaccagaccatgaagctcttcacccagatcttcggggtcggtgtgaagactgctgaccggtggtaccgggaaggactgcgaaccttagatgacctccgagagcagccccagaaactaacccaacagcagaaagcggcaccaccaggacctgagcaccccagtcctgcggtccgatgtagatgccctgcagcaggtggtggaggaagctgtggggcaggccctgcctggggccaccgtcacgctgaccggcggcttccgcagggcctcatcctgtaccaccagcaccagcacagctgctgtgagtcccctacccgcctggcccaacagagccacatggacgcttttgagagaagtttctgcattttccgcctaccacaacctccaggggctgctgtggggggatccacgaggccctgcccatcctggaaggccgtgagagtggacttggtagttgcacccgtcagccagttccctttcgccctgctcggttggactggctccaagcttttccagcgggagctgcgccgcttcagccggaaggagaagggcctgtggctgaacagccatgggctgtttgacccggagcagaagacatttttccaagcggcttcagaggaagacatcttcagacacctgggccttgagtaccttcctccagagcagagaaacgcctgagcctgcctgtgtcccccacttccactcaggaaattgggctgcccccaacctggccactgaatgtctccaggcagatatgctgccccctgacccccaccttcacccctccccgccaaggcctggctcttccggaggtcaattgtgcctgcaggatcagttgagcccctgctggtgtgctgcagggtgtgatgaggtgggagccctcagtgccagcctcatcactgtgtgaccctgggtctgctcttagcctccccatggctcacgttcctgccctggatgggatgtgagtggggcccacatcgtggagctgtggtggggcctgcagtcatgaatggcaagtggtccctgatgtgcagtgtctcattagttgcactgcagttaactgtggctcctgcagggcaccctgcccagaatgcccagaagagaaccatgcatacctgcactgcatttgagagccatgagctggaggctgtggttcgtgccagcaaggagcctactgtctggtgtgctgtaggcatctggagagggagagggcctgggtaggagctgggaggaagataattttcaactatggggcttcagtactgcagcgccccgagccaggctctgtgcttctgcctttaaggcctgttctcagcacaatgtctcaaaaataggtcatatcctgccactcccgtcgcagagccctttaatggttccaaaccctaagtccacacatagcccctggctctggcatctctccagccccactggccccgagctgcttgactcaccggcttcctatttgatgcacccaggcccccttgtggccaactccctccccttctcactgaggcagaagcactgaggtgggctggacatgggtgccctccacgtccctcatatccccaggcacactctggcctcaggttttgccctggccatgtcatctacctggagtgggccctccccttcttcaggccttgaatcaaaagccactttgttaggcgaggatttcccagaccactcatcacattaaaaaatattttgaaaacatgcagtaaa

SEQ ID NO: 1666 - DNA, 2380 bp, Homo sapiens
gagtttccctctgcgttcgctccgcgctgctggaggctgtcgtcccaatgctccccaaacggcggcgagcgcgggtcgggtcccctagcggcgatgccgcttcctccacgccgccctcgacgcgcttcccgggagtcgccatctacctggtcgagcctcgcatgggtcgcagccgccgggccttcctcacaggcctggcgcgctccaaaggcttccgcgtccttgacgcctgcagctccgaagcgacacatgttgtgatggaagagacctcagcagaggaggccgtcagctggcaggagcgcaggatggcagctgctcccccgggttgcacccccccagctctgctggacataagctggttaacagagagcctgggagctgggcagcctgtacctgtggagtgccggcaccgcctggaggtggctgggccaaggaaggggcctctgagcccagcatggatgcctgcctatgcctgccagcgccctacgcccctcacacaccacaacactggcctctccgaggctctggagatactggccgaggcagcaggctttgaaggcagtgagggccgcctcctcaccttctgcagagcagcctcggtgctcaaggcccttcccagccctgtcacaaccctgagccagctgcaggggcttccccactttggagaacactcctctagggttgtccaggagctgctggagcatggagtgtgtgaggaggtggagagagttcggcgctcagagagggctccagcaccaccaggacctgagcaccccagtcctgcggtccgatgtagatgccctgcagcaggtggtggaggaagctgtggggcaggccctgcctggggccaccgtcacgctgaccggcggcttccgcagggcctcatcctgtaccaccagcaccagcacagctgctgtgagtcccctacccgcctggcccaacagagccacatggacgcttttgagagaagtttctgcattttccgcctaccacaacctccaggggctgctgtggggggatccacgaggccctgcccatcctggaaggccgtgagagtggacttggtagttgcacccgtcagccagttccctttcgccctgctcggttggactggctccaagcttttccagcgggagctgcgccgcttcagccggaaggagaagggcctgtggctgaacagccatgggctgtttgacccggagcagggaagcagcagtggcaagactcctaggtcacggaagtcctgcttctgttgcagaagacatttttccaagcggcttcagaggaagacatcttcagacacctgggccttgagtaccttcctccagagcagagaaacgcctgagcctgcctgtgtcccccacttccactcaggaaattgggctgcccccaacctggccactgaatgtctccaggcagatatgctgccccctgacccccaccttcacccctccccgccaaggcctggctcttccggaggtcaattgtgcctgcaggatcagttgagcccctgctggtgtgctgcagggtgtgatgaggtgggagccctcagtgccagcctcatcactgtgtgaccctgggtctgctcttagcctccccatggctcacgttcctgccctggatgggatgtgagtggggcccacatcgtggagctgtggtggggcctgcagtcatgaatggcaagtggtccctgatgtgcagtgtctcattagttgcactgcagttaactgtggctcctgcagggcaccctgcccagaatgcccagaagagaaccatgcatacctgcactgcatttgagagccatgagctggaggctgtggttcgtgccagcaaggagcctactgtctggtgtgctgtaggcatctggagagggagagggcctgggtaggagctgggaggaagataattttcaactatggggcttcagtactgcagcgccccgagccaggctctgtgcttctgcctttaaggcctgttctcagcacaatgtctcaaaaataggtcatatcctgccactcccgtcgcagagccctttaatggttccaaaccctaagtccacacatagcccctggctctggcatctctccagccccactggccccgagctgcttgactcaccggcttcctatttgatgcacccaggcccccttgtggccaactccctccccttctcactgaggcagaagcactgaggtgggctggacatgggtgccctccacgtccctcatatccccaggcacactctggcctcaggttttgccctggccatgtcatctacctggagtgggccctccccttcttcaggccttgaatcaaaagccactttgttaggcgaggatttcccagaccactcatcacattaaaaaatattttgaaaaca

SEQ ID NO: 1667 - DNA, 550 bp, Homo sapiens
actggggcttccttccgtctcgctcggagtttccctctgcgttcgctccgcgctgctggaggctgtcgtcccaatgctccccaaacggcggcgagcgcgggtcgggtcccctagcggcgatgccgcttcctccacgccgccctcgacgcgcttcccgggagtcgccatctacctggtcgagcctcgcatgggtcgcagccgccgggccttcctcacaggcctggcgcgctccaaaggcttccgcgtccttgacgcctgcagctccgaagcgacacatgttgtgatggaagagacctcagcagaggaggccgtcagctggcaggagcgcaggatggcagctgctcccccgggttgcacccccccagctctgctggacataagctggttaacagagagcctgggagctgggcagcctgtacctgtggagtgccggcaccgcctggaggaggctctggagatactggccgaggcagcaggctttgaaggcagtgagggccgcctcctcaccttctgcagagcagcctcggtgctcaaggcccttcccagccct

SEQ ID NO: 1668 - DNA, 2561 bp, Homo sapiens
ctcactggggcttccttccgtctcgctcggagtttccctctgcgttcgctccgcgctgctggaggctgtcgtcccaatgctccccaaacggcggcgagcgcgggtcgggtcccctagcggcgatgccgcttcctccacgccgccctcgacgcgcttcccgggagtcgccatctacctggtcgagcctcgcatgggtcgcagccgccgggccttcctcacaggcctggcgcgctccaaaggcttccgcgtccttgacgcctgcagctccgaagcgacacatgttgtgatggaagagacctcagcagaggaggccgtcagctggcaggagcgcaggatggcagctgctcccccgggttgcacccccccagctctgctggacataagctggttaacagagagcctgggagctgggcagcctgtacctgtggagtgccggcaccgcctggaggtggctgggccaaggaaggggcctctgagcccagcatggatgcctgcctatgcctgccagcgccctacgcccctcacacaccacaacactggcctctccgaggctctggagatactggccgaggcagcaggctttgaaggcagtgagggccgcctcctcaccttctgcagagcagcctcggtgctcaaggcccttcccagccctgtcacaaccctgagccagctgcaggggcttccccactttggagaacactcctctagggttgtccaggagctgctggagcatggagtgtgtgaggaggtggagagagttcggcgctcagagagctcttcacccagatcttcggggtcggtgtgaagactgctgaccggtggtaccgggaaggactgcgaaccttagatgacctccgagagcagccccagaaactaacccaacagcagaaagcggggctccagcaccaccaggacctgagcaccccagtcctgcggtccgatgtagatgccctgcagcaggtggtggaggaagctgtggggcaggccctgcctggggccaccgtcacgctgaccggcggcttccgcagggccatgacgtggacttcctcatcacccaccccaaggagggtcaggaggcggggctgctgcctagagtgatgtgccgcctgcaggaccagggcctcatcctgtaccaccagcaccagcacagctgctgtgagtcccctacccgcctggcccaacagagccacatggacgcttttgagagaagtttctgcattttccgcctaccacaacctccaggggctgctgtggggggatccacgaggccctgcccatcctggaaggccgtgagagtggacttggtagttgcacccgtcagccagttccctttcgccctgctcggttggactggctccaagcttttccagcgggagctgcgccgcttcagccggaaggagaagggcctgtggctgaacagccatgggctgtttgacccggagcagaagacatttttccaagcggcttcagaggaagacatcttcagacacctgggccttgagtaccttcctccagagcagagaaacgcctgagcctgcctgtgtcccccacttccactcaggaaattgggctgcccccaacctggccactgaatgtctccaggcagatatgctgccccctgacccccaccttcacccctccccgccaaggcctggctcttccggaggtcaattgtgcctgcaggatcagttgagcccctgctggtgtgctgcagggtgtgatgaggtgggagccctcagtgccagcctcatcactgtgtgaccctgggtctgctcttagcctccccatggctcacgttcctgccctggatgggatgtgagtggggcccacatcgtggagctgtggtggggcctgcagtcatgaatggcaagtggtccctgatgtgcagtgtctcattagttgcactgcagttaactgtggctcctgcagggcaccctgcccagaatgcccagaagagaaccatgcatacctgcactgcatttgagagccatgagctggaggctgtggttcgtgccagcaaggagcctactgtctggtgtgctgtaggcatctggagagggagagggcctgggtaggagctgggaggaagataattttcaactatggggcttcagtactgcagcgccccgagccaggctctgtgcttctgcctttaaggcctgttctcagcacaatgtctcaaaaataggtcatatcctgccactcccgtcgcagagccctttaatggttccaaaccctaagtccacacatagcccctggctctggcatctctccagccccactggccccgagctgcttgactcaccggcttcctatttgatgcacccaggcccccttgtggccaactccctccccttctcactgaggcagaagcactgaggtgggctggacatgggtgccctccacgtccctcatatccccaggcacactctggcctcaggttttgccctggccatgtcatctacctggagtgggccctccccttcttcaggccttgaatcaaaagccactttgttaggcgaggatttcccagaccactcatcacattaaaaaatattttg

SEQ ID NO: 1669 - DNA, 3218 bp, Homo sapiens
actggggcttccttccgtctcgctcggagtttccctctgcgttcgctccgcgctgctggaggctgtcgtcccaatgctccccaaacggcggcgagcgcgggtcgggtcccctagcggcgatgccgcttcctccacgccgccctcgacgcgcttcccgggagtcgccatctacctggtcgagcctcgcatgggtcgcagccgccgggccttcctcacaggcctggcgcgctccaaaggcttccgcgtccttgacgcctgcagctccgaagcgacacatgttgtgatggaagagacctcagcagaggaggccgtcagctggcaggagcgcaggatggcagctgctcccccgggttgcacccccccagctctgctggacataagctggttaacagagagcctgggagctgggcagcctgtacctgtggagtgccggcaccgcctggaggtggctgggccaaggaaggggcctctgagcccagcatggatgcctgcctatgcctgccagcgccctacgcccctcacacaccacaacactggcctctccgaggctctggagatactggccgaggcagcaggctttgaaggcagtgagggccgcctcctcaccttctgcagagcagcctcggtgctcaaggcccttcccagccctgtcacaaccctgagccagctgcaggggcttccccactttggagaacactcctctagggttgtccaggagctgctggagcatggagtgtgtgaggaggtggagagagttcggcgctcagagaggtaccagaccatgaaggtgcgcagggcagggctcggacctaccccaggaatgtcctgccctgggaatgacaacacagtccacaccatgcacggggaggcaaacaggggcagctgacccagcccaggggtcagagaaggtcttgccgaggaagtggcagctaagctgatacctgatatgcacaaggcagccaagtggagacaggctggagtacagtggtgcgatcacagctcacggcagccttgacttcctgggctcaaaccatcctcccacctcagtctctggagtagctgggactacaggcatgtgccaccacaccagctcttcacccagatcttcggggtcggtgtgaagactgctgaccggtggtaccgggaaggactgcgaaccttagatgacctccgagagcagccccagaaactaacccaacagcagaaagcggggctccagcaccaccaggacctgagcaccccagtcctgcggtccgatgtagatgccctgcagcaggtggtggaggaagctgtggggcaggccctgcctggggccaccgtcacgctgaccggcggcttccgcaggtaagaaggcccgacgtgcccctctggcttggcttcagacccctccccagtgaagggacctgagtcggggaccctgaagcgggcccactcgttggaagggatgtggcctggggctggagtgagcaggccgtgtccctgagtcagagtcagactgacgccctcagggggaagttgcagggccatgacgtggacttcctcatcacccaccccaaggagggtcaggaggcggggctgctgcctagagtgatgtgccgcctgcaggaccaggtgagggcctccctgctccccaagagccaccgctggccaatgccactgcctcctgctctctccacaccaccggatggtctcagccacgcccgcctctccccacagggcctcatcctgtaccaccagcaccagcacagctgctgtgagtcccctacccgcctggcccaacagagccacatggacgcttttgagagaagtttctgcattttccgcctaccacaacctccaggggctgctgtggggggatccacgaggccctgcccatcctggaaggccgtgagagtggacttggtagttgcacccgtcagccagttccctttcgccctgctcggttggactggctccaagcttttccagcgggagctgcgccgcttcagccggaaggagaagggcctgtggctgaacagccatgggctgtttgacccggagcagggaagcagcagtggcaagactcctaggtcacggaagtcctgcttctgttgcagaagacatttttccaagcggcttcagaggaagacatcttcagacacctgggccttgagtaccttcctccagagcagagaaacgcctgagcctgcctgtgtcccccacttccactcaggaaattgggctgcccccaacctggccactgaatgtctccaggcagatatgctgccccctgacccccaccttcacccctccccgccaaggcctggctcttccggaggtcaattgtgcctgcaggatcagttgagcccctgctggtgtgctgcagggtgtgatgaggtgggagccctcagtgccagcctcatcactgtgtgaccctgggtctgctcttagcctccccatggctcacgttcctgccctggatgggatgtgagtggggcccacatcgtggagctgtggtggggcctgcagtcatgaatggcaagtggtccctgatgtgcagtgtctcattagttgcactgcagttaactgtggctcctgcagggcaccctgcccagaatgcccagaagagaaccatgcatacctgcactgcatttgagagccatgagctggaggctgtggttcgtgccagcaaggagcctactgtctggtgtgctgtaggcatctggagagggagagggcctgggtaggagctgggaggaagataattttcaactatggggcttcagtactgcagcgccccgagccaggctctgtgcttctgcctttaaggcctgttctcagcacaatgtctcaaaaataggtcatatcctgccactcccgtcgcagagccctttaatggttccaaaccctaagtccacacatagcccctggctctggcatctctccagccccactggccccgagctgcttgactcaccggcttcctatttgatgcacccaggcccccttgtggccaactccctccccttctcactgaggcagaagcactgaggtgggctggacatgggtgccctccacgtccctcatatccccaggcacactctggcctcaggttttgccctggccatgtcatctacctggagtgggccctccccttcttcaggccttgaatcaaaagccactttgttaggcgaggatttcccagaccactcatcacattaaaaaatattttgaaaaca

SEQ ID NO: 1670 - DNA, 6637 bp, Homo sapiens
attggctgaagcggaagaagacgaaagcaatcataaaatgggaggttgcaagctcatggtttgaaagacttcgtcacggaagctaaaagctctatacacccgatttgcctcggaggaattttcctaaatgattattttgatgtcttatatatctttgattgttttcaaaacaaaagagcgagcagagagtcgtacaactatttgttccccccccatgtagaagtgatctcatccacgtaaatgtcgttcctgcgaccgcttccgcgcgcaagcgcacgttgaatcgcgtggtgactccgggcttgaggttgaattaagaatagtcaggtggtgagtggaacgtctcttggggtgtcggaattcaaaacggacctggaggatgttgatctccaagaacatgccctggcggcggctgcagggcatttccttcgggatgtattcggctgaagagctcaagaaattaagtgttaaatccattacgaaccctcgatacctggacagcctggggaacccatcggcaaacggcctgtacgatttagctttgggccctgcagattccaaagaggtgtgctccacctgcgtgcaggacttcagcaactgttctgggcacctgggccacattgagctcccactcacagtgtataaccctctcctcttcgataagctgtacctgctgcttcggggctcttgtttaaactgccacatgctgacttgtccccgggccgtgattcacctcttactctgccagctgagggttctggaagtcggggccctacaagcagtctacgagcttgagagaattctgaacaggtttctggaagaaaatcccgatccctctgcctctgaaattcgggaggaattagaacaatacacaactgaaattgtgcagaacaacctcctggggtcccagggcgcacatgtaaagaacgtgtgtgagagcaagagcaagctcattgctctcttctggaaggcacatatgaatgctaagcgctgtccccactgcaagaccgggcgatccgttgtccgaaaggaacacaacagcaagttgactatcacgtttccagccatggtgcacaggacagctggccagaaggactctgagcccctgggaattgaggaagctcagataggaaaacgaggatacttaacacccaccagtgcccgcgaacacctttctgccctgtggaagaatgaaggattctttctgaactaccttttttcgggaatggatgatgatggtatggaatccagattcaatcccagtgtgttctttctagatttcttggtggtgccgccctcaaggtatcgcccagtcagtcgcctaggagaccagatgtttactaatggccagacggtgaacttgcaggctgtcatgaaggatgtagttctgattcgaaaacttctggcattgatggcccaagaacagaagttgccagaggaagtggccacacccactacagatgaggaaaaagactctttgattgctattgaccgatcctttttgagtacacttccaggccagtccctcatagacaaactttacaacatttggattcgccttcagagccacgtcaatattgtgtttgatagcgagatggacaaactaatgatggacaagtacccaggcattaggcagatcctggagaagaaagaaggcctgttccgaaaacacatgatgggaaagcgagtggactacgctgcgcgctcagtcatctgcccagacatgtacatcaacaccaacgaaattggaattcccatggtgtttgccacaaaactgacctacccacagccagttaccccatggaatgttcaggaacttaggcaagcggtcatcaacggccctaatgtgcacccaggagcctccatggtcatcaatgaggacggcagccgcacagccctgagcgctgtggacatgacccagcgagaggccgtggccaagcagcttctgaccccagccacgggggcacctaagccccaggggacaaaaattgtgtgccggcatgtgaagaatggggacattctgctactgaaccgacagcccacactgcacagaccctccatccaggcccaccgtgcccgcatcctgcctgaagagaaagtgctgcggctccactatgccaactgcaaggcctataatgccgactttgatggagacgagatgaatgcccatttcccccagagtgagctgggccgggccgaggcctacgtcctggcctgcactgatcagcagtaccttgttcccaaggatggccaaccattggcgggactgatccaggatcacatggtttcaggggcaagcatgactactcggggttgctttttcacccgggagcactatatggagctggtgtaccgaggactcacggacaaagtggggcgcgtgaagctcctttctccttccatcctgaagccctttccgctgtggacaggaaaacaggttgtgtcaacgctgctcataaatataatcccagaggaccacatcccactgaacttatctggaaaggcgaaaatcactgggaaagcctgggtgaaggaaactcctcgatccgttcctggctttaaccctgactcgatgtgcgagtcccaggtgatcatcagggaaggggagctgctctgcggagtgctggacaaggcgcactatgggagctccgcctacggcctggtccactgctgctatgagatctatggaggcgagaccagcggcaaggttctaacctgcctggcccgcctcttcaccgcctacctgcagctctacagaggcttcaccttgggcgtggaagacattttggtgaagccaaaggcagatgtcaagaggcaacgtatcattgaagaatccacccactgcgggccccaggctgtcagggctgcattaaacctgccagaagccgcatcatatgatgaggtccgaggaaaatggcaggatgcccatctgggcaaggaccagagggattttaacatgattgatctgaagttcaaggaggaagtgaaccattacagcaatgagattaacaaggcatgcatgccttttggcctacacagacagttcccagagaacagcctgcagatgatggtgcagtcgggagccaaaggttcaactgtgaacacgatgcagatctcgtgcctgctgggccagattgaactggaaggtcggagacccccgctgatggcgtctggcaagtcactgccctgctttgagccttatgagttcacccccagggctggtggctttgtcactggcaggttcctcaccggcatcaaacctcctgagttcttcttccactgcatggcaggacgagagggcctggtggacactgctgtgaaaaccagccgctcaggctatctccaaaggtgcatcatcaagcacctagaggggctggtcgtgcagtatgatctcacggtccgtgacagtgacggcagtgtggtgcagttcctgtatggggaggatggcctggacatccccaagacacagttcctgcagcccaagcagttccccttcctggccagcaactacgaggtgataatgaaatcacagcatctccatgaagttttatccagagcagatcccaaaaaagctctccaccacttcagagctatcaaaaaatggcaaagcaagcaccccaacaccctgctgagaagaggcgccttcttgagttattcccagaaaattcaggaagctgtgaaagccctgaaacttgagagtgaaaaccgcaatggccgcagccctgggactcaggagatgctgaggatgtggtatgagttggatgaggaaagccgaaggaaataccagaagaaggcggccgcttgtcctgaccccagtctgtctgtctggcgtcctgacatctactttgcatcagtgtcagaaacatttgaaacaaaggttgatgactacagtcaagagtgggcagctcaaacagagaagagttatgagaaatcagagctttctctcgacaggttgaggaccttgctgcagctgaagtggcagcgctcactgtgtgagccgggcgaggctgtgggcctgctggctgcccagagcatcggagagccctccacccagatgaccctcaacaccttccactttgcaggcagaggcgagatgaacgtcaccctgggcattccaaggttgcgggagattctcatggtggccagcgccaacatcaagacacccatgatgagcgtgcccgtgctcaacaccaagaaagccctgaagagagtgaaaagcctgaagaagcaactcaccagggtgtgcttgggggaggtgttgcagaaaattgacgtccaggagtccttctgtatggaagaaaaacagaacaaattccaggtgtaccagctgcggtttcagttcctgccacatgcatattaccagcaggagaagtgcctgagacccgaggacatcctgcgcttcatggaaacaagattctttaaacttctgatggaatccatcaaaaagaagaataataaagcatcagctttcaggaacgtaaacactcgaagagctacacagcgggatctggacaacgctggggagttggggaggagtcggggagagcaggagggtgatgaggaagaggaggggcacattgtggatgctgaagctgaggagggggacgccgatgcctctgatgccaaacgcaaggagaagcaggaggaggaggttgattatgagagtgaggaagaggaggagagggagggcgaggagaacgacgatgaagacatgcaggaggaacgaaatccccacagggaaggtgctcgaaagacccaagagcaagatgaagaggtgggcttaggcactgaggaggacccgtcccttcccgccctcctgacgcagccccggaaacccacccacagccaggagccccaggggcccgaggccatggagcgccgggtccaggctgtgcgtgagatccacccgttcatagatgactaccagtacgacaccgaggagagcctgtggtgccaggtgacagtgaagctccctctgatgaagatcaactttgacatgagctccctggtagtatctttggcccatggtgccgtcatctatgcgaccaagggcatcactcggtgcctcctgaatgaaacaaccaacaataagaacgagaaggagcttgtgctaaacacagaaggaatcaacctcccagagctattcaagtatgcagaggtcctggatctgcgccgcctctactccaacgacatccacgccatagccaacacgtatggcattgaggccgcgctgcgggtgatcgagaaggagatcaaggatgtgtttgccgtgtatggcatcgcggtcgaccctcgccatctctccctggttgctgattatatgtgcttcgagggtgtttacaagccactgaatcgctttgggatccggtcaaactcttccccgctacagcagatgacatttgaaaccagcttccagtttctgaagcaagccaccatgctgggatcccacgatgagctgaggtctccttctgcctgccttgtggtcgggaaggtcgtcaggggcgggacaggcctgttcgagctcaagcagcctctgagatagcagctaccccggcaccatctgcccagctccaaggacccttggtgagggcgtggcccagcctgccttctgcatgagaggaccaggagactggaatccagggcagttccaagtgacagtacagagcacagcagcgaccttgggcctgaaagcagtgggcctctgagctgggccagcttcacctggaaagtgacagagttgctcatccttgcccctccctgtctctggatttttatcaaggtttaccaagtcttctgagtccccctgagatggctggggcctcacctgtgctgcaggaggcctctgtggcataacccctaaggagaagtcctgattcacgattcactgagaagaccaaggggaagccatgctttgctgctggggaccccaggcacctccagagtagggaagcggggttcttttgctgtgagtggccagggacaacagacaagattcctgggggctcccgatgagcaggaacgtggagcctgctgcccaaggcctgctccttccggctgctccagcccctgggggcagagtccacaaagagtccccatcaagacttcttccctgagtcaagtacagcgtagcatagtcctccacccacccaacctctctgcctggccagggtcctggccctgccactgtgtggcgaggtgtccttctagaccacatcagccccaaggctgggagcagtcgctccagggccgcagcagttcactcccacacatagaacccaggtcactgctggggcgattgaacaggttgcctggcttttctctgctgtcagtttggtgtggaggcctatgttctgccccatacaccccacaggccctgcttatgggaaggaacacaggcctccagcccagaggactgtgccgccctgttcttggccgtccacgtttcctctccctctagcaccagcaatacatttccctggcatggacagaaaagacagagaggacttatacaaaggctttgtaaaaccagaggctagcttctatctttgtctactgttatttcagctcagggcgggtaattaacatcattggaactagctattaggaaagaaaaaaaacttggttttttttacaacaa

SEQ ID NO: 1671 - DNA, 6454 bp, Homo sapiens
attggctgaagcggaagaagacgaaagcaatcataaaatgggaggttgcaagctcatggtttgaaagacttcgtcacggaagctaaaagctctatacacccgatttgcctcggaggaattttcctaaatgattattttgatgtcttatatatctttgattgttttcaaaacaaaagagcgagcagagagtcgtacaactatttgttccccccccatgtagaagtgatctcatccacgtaaatgtcgttcctgcgaccgcttccgcgcgcaagcgcacgttgaatcgcgtggtgactccgggcttgaggttgaattaagaatagtcaggtggtgagtggaacgtctcttggggtgtcggaattcaaaacggacctggaggatgttgatctccaagaacatgccctggcggcggctgcagggcatttccttcgggatgtattcggctgaagagctcaagaaattaagtgttaaatccattacgaaccctcgatacctggacagcctggggaacccatcggcaaacggcctgtacgatttagctttgggccctgcagattccaaagaggtgtgctccacctgcgtgcaggacttcagcaactgttctgggcacctgggccacattgagctcccactcacagtgtataaccctctcctcttcgataagctgtacctgctgcttcggggctcttgtttaaactgccacatgctgacttgtccccgggccgtgattcacctcttactctgccagctgagggttctggaagtcggggccctacaagcagtctacgagcttgagagaattctgaacaggtttctggaagaaaatcccgatccctctgcctctgaaattcgggaggaattagaacaatacacaactgaaattgtgcagaacaacctcctggggtcccagggcgcacatgtaaagaacgtgtgtgagagcaagagcaagctcattgctctcttctggaaggcacatatgaatgctaagcgctgtccccactgcaagaccgggcgatccgttgtccgaaaggaacacaacagcaagttgactatcacgtttccagccatggtgcacaggacagctggccagaaggactctgagcccctgggaattgaggaagctcagataggaaaacgaggatacttaacacccaccagtgcccgcgaacacctttctgccctgtggaagaatgaaggattctttctgaactaccttttttcgggaatggatgatgatggtatggaatccagattcaatcccagtgtgttctttctagatttcttggtggtgccgccctcaaggtatcgcccagtcagtcgcctaggagaccagatgtttactaatggccagacggtgaacttgcaggctgtcatgaaggatgtagttctgattcgaaaacttctggcattgatggcccaagaacagaagttgccagaggaagtggccacacccactacagatgaggaaaaagactctttgattgctattgaccgatcctttttgagtacacttccaggccagtccctcatagacaaactttacaacatttggattcgccttcagagccacgtcaatattgtgtttgatagcgagatggacaaactaatgatggacaagtacccaggcattaggcagatcctggagaagaaagaaggcctgttccgaaaacacatgatgggaaagcgagtggactacgctgcgcgctcagtcatctgcccagacatgtacatcaacaccaacgaaattggaattcccatggtgtttgccacaaaactgacctacccacagccagttaccccatggaatgttcaggaacttaggcaagcggtcatcaacggccctaatgtgcacccaggagcctccatggtcatcaatgaggacggcagccgcacagccctgagcgctgtggacatgacccagcgagaggccgtggccaagcagcttctgaccccagccacgggggcacctaagccccaggggacaaaaattgtgtgccggcatgtgaagaatggggacattctgctactgaaccgacagcccacactgcacagaccctccatccaggcccaccgtgcccgcatcctgcctgaagagaaagtgctgcggctccactatgccaactgcaaggcctataatgccgactttgatggagacgagatgaatgcccatttcccccagagtgagctgggccgggccgaggcctacgtcctggcctgcactgatcagcagtaccttgttcccaaggatggccaaccattggcgggactgatccaggatcacatggtttcaggggcaagcatgactactcggggttgctttttcacccgggagcactatatggagctggtgtaccgaggactcacggacaaagtggggcgcgtgaagctcctttctccttccatcctgaagccctttccgctgtggacaggaaaacaggttgtgtcaacgctgctcataaatataatcccagaggaccacatcccactgaacttatctggaaaggcgaaaatcactgggaaagcctgggtgaaggaaactcctcgatccgttcctggctttaaccctgactcgatgtgcgagtcccaggtgatcatcagggaaggggagctgctctgcggagtgctggacaaggcgcactatgggagctccgcctacggcctggtccactgctgctatgagatctatggaggcgagaccagcggcaaggttctaacctgcctggcccgcctcttcaccgcctacctgcagctctacagaggcttcaccttgggcgtggaagacattttggtgaagccaaaggcagatgtcaagaggcaacgtatcattgaagaatccacccactgcgggccccaggctgtcagggctgcattaaacctgccagaagccgcatcatatgatgaggtccgaggaaaatggcaggatgcccatctgggcaaggaccagagggattttaacatgattgatctgaagttcaaggaggaagtgaaccattacagcaatgagattaacaaggcatgcatgccttttggcctacacagacagttcccagagaacagcctgcagatgatggtgcagtcgggagccaaaggttcaactgtgaacacgatgcagatctcgtgcctgctgggccagattgaactggaaggtcggagacccccgctgatggcgtctggcaagtcactgccctgctttgagccttatgagttcacccccagggctggtggctttgtcactggcaggttcctcaccggcatcaaacctcctgagttcttcttccactgcatggcaggacgagagggcctggtggacactgctgtgaaaaccagccgctcaggctatctccaaaggtgcatcatcaagcacctagaggggctggtcgtgcagtatgatctcacggtccgtgacagtgacggcagtgtggtgcagttcctgtatggggaggatggcctggacatccccaagacacagttcctgcagcccaagcagttccccttcctggccagcaactacgaggtgataatgaaatcacagcatctccatgaagttttatccagagcagatcccaaaaaagctctccaccacttcagagctatcaaaaaatggcaaagcaagcaccccaacaccctgctgagaagaggcgccttcttgagttattcccagaaaattcaggaagctgtgaaagccctgaaacttgagagtgaaaaccgcaatggccgcagccctgggactcaggagatgctgaggatgtggtatgagttggatgaggaaagccgaaggaaataccagaagaaggcggccgcttgtcctgaccccagtctgtctgtctggcgtcctgacatctactttgcatcagtgtcagaaacatttgaaacaaaggttgatgactacagtcaagagtgggcagctcaaacagagaagagttatgagaaatcagagctttctctcgacaggttgaggaccttgctgcagctgaagtggcagcgctcactgtgtgagccgggcgaggctgtgggcctgctggctgcccagagcatcggagagccctccacccagatgaccctcaacaccttccactttgcaggcagaggcgagatgaacgtcaccctgggcattccaaggttgcgggagattctcatggtggccagcgccaacatcaagacacccatgatgagcgtgcccgtgctcaacaccaagaaagccctgaagagagtgaaaagcctgaagaagcaactcaccagggtgtgcttgggggaggtgttgcagaaaattgacgtccaggagtccttctgtatggaagaaaaacagaacaaattccaggtgtaccagctgcggtttcagttcctgccacatgcatattaccagcaggagaagtgcctgagacccgaggacatcctgcgcttcatggaaacaagattctttaaacttctgatggaatccatcaaaaagaagaataataaagcatcagctttcaggaacgtaaacactcgaagagctacacagcgggatctggacaacgctggggagttggggaggagtcggggagagcaggagggtgatgaggaagaggaggggcacattgtggatgctgaagctgaggagggggacgccgatgcctctgatgccaaacgcaaggagaagcaggaggaggaggttgattatgagagtgaggaagaggaggagagggagggcgaggagaacgacgatgaagacatgcaggaggaacgaaatccccacagggaaggtgctcgaaagacccaagagcaagatgaagaggtgacagtgaagctccctctgatgaagatcaactttgacatgagctccctggtagtatctttggcccatggtgccgtcatctatgcgaccaagggcatcactcggtgcctcctgaatgaaacaaccaacaataagaacgagaaggagcttgtgctaaacacagaaggaatcaacctcccagagctattcaagtatgcagaggtcctggatctgcgccgcctctactccaacgacatccacgccatagccaacacgtatggcattgaggccgcgctgcgggtgatcgagaaggagatcaaggatgtgtttgccgtgtatggcatcgcggtcgaccctcgccatctctccctggttgctgattatatgtgcttcgagggtgtttacaagccactgaatcgctttgggatccggtcaaactcttccccgctacagcagatgacatttgaaaccagcttccagtttctgaagcaagccaccatgctgggatcccacgatgagctgaggtctccttctgcctgccttgtggtcgggaaggtcgtcaggggcgggacaggcctgttcgagctcaagcagcctctgagatagcagctaccccggcaccatctgcccagctccaaggacccttggtgagggcgtggcccagcctgccttctgcatgagaggaccaggagactggaatccagggcagttccaagtgacagtacagagcacagcagcgaccttgggcctgaaagcagtgggcctctgagctgggccagcttcacctggaaagtgacagagttgctcatccttgcccctccctgtctctggatttttatcaaggtttaccaagtcttctgagtccccctgagatggctggggcctcacctgtgctgcaggaggcctctgtggcataacccctaaggagaagtcctgattcacgattcactgagaagaccaaggggaagccatgctttgctgctggggaccccaggcacctccagagtagggaagcggggttcttttgctgtgagtggccagggacaacagacaagattcctgggggctcccgatgagcaggaacgtggagcctgctgcccaaggcctgctccttccggctgctccagcccctgggggcagagtccacaaagagtccccatcaagacttcttccctgagtcaagtacagcgtagcatagtcctccacccacccaacctctctgcctggccagggtcctggccctgccactgtgtggcgaggtgtccttctagaccacatcagccccaaggctgggagcagtcgctccagggccgcagcagttcactcccacacatagaacccaggtcactgctggggcgattgaacaggttgcctggcttttctctgctgtcagtttggtgtggaggcctatgttctgccccatacaccccacaggccctgcttatgggaaggaacacaggcctccagcccagaggactgtgccgccctgttcttggccgtccacgtttcctctccctctagcaccagcaatacatttccctggcatggacagaaaagacagagaggacttatacaaaggctttgtaaaaccagaggctagcttctatctttgtctactgttatttcagctcagggcgggtaattaacatcattggaactagctattaggaaagaaaaaaaacttggttttttttacaacaa

SEQ ID NO: 1672 - DNA, 4558 bp, Homo sapiens
agatgcgacgaggttagcggggcccgaccactccttggcttcccaggggtgagcctcgcgagttaggagttgggtagagagtcagcccggggcccggcatccgctttttcgttgaagcaacgactttggccggatgactccccagggtcggcatcagcgtgggactgggaacaggtgaagggaaacagaagagagcctgagaagaccgctctcctccgatcctaattgactgagccaatgagagccaaagaggtcacatgctcaactgggcggggagcgggtttccacctgcggcatctttcgcgagcggggagatgagtggggcggaatatgggagaaagggagggcccgccacgctctggctggacacggccttaatcggcccgttcactcgacgtttttggttctacgttgaccccgagaaaccgaaaccgcagggcctagggcgggtggaacgagagggaactacatttcccagcaggctgcggaaacgggactgcggccactacttccggcgtgtaccgagagactggcgtccggcgtgtaccgagagactggcgtccggtgtgcaggtggccacatggatcctggcagccggtggcggaacctgcccagcgggcctagcctaaagcacttgactgacccctcttatggaatcccgcgggaacagcaaaaggcagcgttgcaggagctgacgcgggcgcacgtggagtccttcaactacgctgtgcacgagggtctcggcctcgcggtgcaggctatacctccctttgaatttgctttcaaagatgagcgtatctcttttactattctggatgctgttatcagtccacctacagttccaaaagggaccatctgcaaagaggccaatgtttatccagcagaatgccggggccgaaggagtacctaccgtgggaagttgacagctgatatcaactgggcagtgaatggaatctcaaaaggaatcattaagcagtttcttggctatgttcccatcatggtgaaatccaagctttgcaacttacgtaaccttcccccacaagccctcattgagcaccatgaggaggcagaggaaatggggggctattttataatcaatggcattgaaaaagtcatccgaatgttgattatgcctcggagaaattttcccattgcaatgataagaccaaaatggaaaaccagagggcctggttatactcagtatggagtttcaatgcactgtgtgagggaagaacattccgctgtcaatatgaacctccactacttggaaaatggcactgttatgttgaactttatttaccgaaaagaactgttctttcttcctttgggatttgcacttaaggcacttgtcagcttttctgattatcagatctttcaggagctcatcaaaggaaaagaggatgattctttccttaggaactctgtttctcagatgttaaggattgtaatggaagagggttgttcgacacaaaaacaggtccttaactacctaggtgaatgcttcagagtaaaactcaatgttcctgactggtacccaaatgagcaagctgcggagttcctgtttaaccagtgcatctgtatccacttgaaatccaatactgaaaagttttatatgctttgtctcatgacgcgaaagctctttgctttagccaaaggagagtgcatggaggacaatcctgatagtttggtgaaccaggaagtcctcacaccgggtcagctcttccttatgttcctgaaggaaaaactggaaggttggttagtgtctattaaaatagcttttgataagaaggctcagaagaccagtgtttccatgaacactgacaatttgatgaggatttttacaatgggcatagaccttacaaaaccatttgaatacctttttgctactgggaatctgcgttctaaaacaggtcttggcctcctacaagattctggactttgtgttgtggctgacaagctgaacttcatacgctacctctcccatttccgctgcgtgcacagaggggctgattttgccaagatgaggaccaccacagtacgcaggctgctgccagagtcctggggcttcctttgtcccgtgcataccccagacggggagccctgtggcctgatgaaccacctaactgccgtatgtgaggttgtcacacagtttgtgtatacggcatctattccagctttactgtgcaacttgggggtcactcccattgatggagctccccaccgatcatacagtgagtgctaccctgtcctgctggacggtgtcatggttggctgggtggataaggatcttgctccaggcatcgcagattctcttcgtcattttaaggtgttgagagagaaaagaattcctccctggatggaagtggtccttatacccatgacaggaaaaccaagtctgtacccaggattgttcctttttaccactccttgtagactggtacggcctgtgcagaacttagcattgggcaaagaagagctaattggaactatggaacagatcttcatgaatgtcgctatctttgaggatgaagtttttgctggagttaccacacaccaggaactctttccacacagcctgctgagtgtgattgccaacttcatccctttctctgatcacaaccagagtccacggaacatgtaccaatgccagatgggtaagcaaactatgggctttccacttctcacttatcaagaccgatcggataacaaactgtatcgtcttcagactcctcagagtcccttggtgagaccctccatgtatgattattatgacatggataactatccaattgggaccaatgccatcgttgctgtgatttcttacactggctatgatatggaagatgccatgattgtgaataaggcctcttgggaacgaggctttgcccatggaagtgtctacaagtctgagttcatagacctctctgaaaaaattaaacaaggagatagtagcctggtgtttggcatcaaacctggtgacccacgcgttctgcagaagttagatgacgatggattgccgtttataggagcaaaactgcagtacggagatccgtattacagctacctcaacctcaacaccggggaaagttttgtgatgtactataagagtaaagaaaattgtgttgtggataacatcaaagtgtgcagtaatgacactgggagtggaaaattcaagtgtgtttgcatcactatgagagtgcctcggaacccaactatcggagataaatttgccagtcgccatgggcagaagggcattttaagcagattgtggccggctgaggacatgccttttactgagagtgggatggtcccagacattctgttcaatccccatggttttccatcccgcatgaccattgggatgttaattgagagtatggccgggaagtctgcagctttgcatggtctctgccatgatgctacacccttcatcttctcagaggagaactcggccttagaatactttggtgagatgttaaaggctgctggctacaatttctatggcaccgagaggttatatagtggcatcagtgggctagaactggaagcagacatcttcataggagtggtttattatcagcgcttacgccatatggtctcagacaaatttcaagtaaggacaactggagcccgagacagagtcaccaaccagcctattgggggaagaaatgtccagggtggaatccgttttggggagatggaacgggatgcgcttttagctcatggtacatcttttctccttcatgaccgcctcttcaactgctcagatcggtcggtagcccatgtgtgtgtgaagtgtggcagtttactctctccactgttggagaagccacccccttcttggtctgccatgcgcaacagaaaatacaactgtactctgtgtagtcgcagtgacactatcgatactgtttctgtgccttatgtttttcggtattttgtagctgaactggcagctatgaacatcaaagtgaaactggatgttgtttaacttgatgttgaccttttggattaagaggactatcagattaaagcaaaatgtaattttaattcaatgaagatatcattaccaggttactcttgagatttttcaacggtgttagaactctcaaccaagacctgaaaaccaagtatgcaaggtttctgaatctctctggtagattaactattgacaatgattttctgttatctttgttcaaaaagttcatgtcttctcaaaatatgaaatattgataaatggaagagcatacggtgacaagtctcctttccaaccccaggttccctacaccctgctctcagcaggcagtgagtgtcacacacctgttaatccatcttgagcaggacagtactatacaaatagaatgcaagctgtaatgtaattttatattttcttatagccacgttgaagtaaaaacaaacaggtacagtgttttttaccagctttatagaagtacagttgttacatatttaatgaatacaatttgatgggtctgactatatgcacacacctttgataccatcaccacaatcagggtaataaacatacctgtcatctccacaa

SEQ ID NO: 1673 - DNA, 3836 bp, Homo sapiens
gagactggcgtccggtgtgcaggtggccacatggatcctggcagccggtggcggaacctgcccagcgggcctagcctaaagcacttgactgacccctcttatggaatcccgcgggaacagcaaaaggcagcgttgcaggagctgacgcgggcgcacgtggagtccttcaactacgctgtgcacgagggtctcggcctcgcggtgcaggctgatatcaactgggcagtgaatggaatctcaaaaggaatcattaagcagtttcttggctatgttcccatcatggtgaaatccaagctttgcaacttacgtaaccttcccccacaagccctcattgagcaccatgaggaggcagaggaaatggggggctattttataatcaatggcattgaaaaagtcatccgaatgttgattatgcctcggagaaattttcccattgcaatgataagaccaaaatggaaaaccagagggcctggttatactcagtatggagtttcaatgcactgtgtgagggaagaacattccgctgtcaatatgaacctccactacttggaaaatggcactgttatgttgaactttatttaccgaaaagaactgttctttcttcctttgggatttgcacttaaggcacttgtcagcttttctgattatcagatctttcaggagctcatcaaaggaaaagaggatgattctttccttaggaactctgtttctcagatgttaaggattgtaatggaagagggttgttcgacacaaaaacaggtccttaactacctaggtgaatgcttcagagtaaaactcaatgttcctgactggtacccaaatgagcaagctgcggagttcctgtttaaccagtgcatctgtatccacttgaaatccaatactgaaaagttttatatgctttgtctcatgacgcgaaagctctttgctttagccaaaggagagtgcatggaggacaatcctgatagtttggtgaaccaggaagtcctcacaccgggtcagctcttccttatgttcctgaaggaaaaactggaaggttggttagtgtctattaaaatagcttttgataagaaggctcagaagaccagtgtttccatgaacactgacaatttgatgaggatttttacaatgggcatagaccttacaaaaccatttgaatacctttttgctactgggaatctgcgttctaaaacaggtcttggcctcctacaagattctggactttgtgttgtggctgacaagctgaacttcatacgctacctctcccatttccgctgcgtgcacagaggggctgattttgccaagatgaggaccaccacagtacgcaggctgctgccagagtcctggggcttcctttgtcccgtgcataccccagacggggagccctgtggcctgatgaaccacctaactgccgtatgtgaggttgtcacacagtttgtgtatacggcatctattccagctttactgtgcaacttgggggtcactcccattgatggagctccccaccgatcatacagtgagtgctaccctgtcctgctggacggtgtcatggttggctgggtggataaggatcttgctccaggcatcgcagattctcttcgtcattttaaggtgttgagagagaaaagaattcctccctggatggaagtggtccttatacccatgacaggaaaaccaagtctgtacccaggattgttcctttttaccactccttgtagactggtacggcctgtgcagaacttagcattgggcaaagaagagctaattggaactatggaacagatcttcatgaatgtcgctatctttgaggatgaagtttttgctggagttaccacacaccaggaactctttccacacagcctgctgagtgtgattgccaacttcatccctttctctgatcacaaccagagtccacggaacatgtaccaatgccagatgggtaagcaaactatgggctttccacttctcacttatcaagaccgatcggataacaaactgtatcgtcttcagactcctcagagtcccttggtgagaccctccatgtatgattattatgacatggataactatccaattgggaccaatgccatcgttgctgtgatttcttacactggctatgatatggaagatgccatgattgtgaataaggcctcttgggaacgaggctttgcccatggaagtgtctacaagtctgagttcatagacctctctgaaaaaattaaacaaggagatagtagcctggtgtttggcatcaaacctggtgacccacgcgttctgcagaagttagatgacgatggattgccgtttataggagcaaaactgcagtacggagatccgtattacagctacctcaacctcaacaccggggaaagttttgtgatgtactataagagtaaagaaaattgtgttgtggataacatcaaagtgtgcagtaatgacactgggagtggaaaattcaagtgtgtttgcatcactatgagagtgcctcggaacccaactatcggagataaatttgccagtcgccatgggcagaagggcattttaagcagattgtggccggctgaggacatgccttttactgagagtgggatggtcccagacattctgttcaatccccatggttttccatcccgcatgaccattgggatgttaattgagagtatggccgggaagtctgcagctttgcatggtctctgccatgatgctacacccttcatcttctcagaggagaactcggccttagaatactttggtgagatgttaaaggctgctggctacaatttctatggcaccgagaggttatatagtggcatcagtgggctagaactggaagcagacatcttcataggagtggtttattatcagcgcttacgccatatggtctcagacaaatttcaagtaaggacaactggagcccgagacagagtcaccaaccagcctattgggggaagaaatgtccagggtggaatccgttttggggagatggaacgggatgcgcttttagctcatggtacatcttttctccttcatgaccgcctcttcaactgctcagatcggtcggtagcccatgtgtgtgtgaagtgtggcagtttactctctccactgttggagaagccacccccttcttggtctgccatgcgcaacagaaaatacaactgtactctgtgtagtcgcagtgacactatcgatactgtttctgtgccttatgtttttcggtattttgtagctgaactggcagctatgaacatcaaagtgaaactggatgttgtttaacttgatgttgaccttttggattaagaggactatcagattaaagcaaaatgtaattttaattcaatgaagatatcattaccaggttactcttgagatttttcaacggtgttagaactctcaaccaagacctgaaaaccaagtatgcaaggtttctgaatctctctggtagattaactattgacaatgattttctgttatctttgttcaaaaagttcatgtcttctcaaaatatgaaatattgataaatggaagagcatacggtgacaagtctcctttccaaccccaggttccctacaccctgctctcagcaggcagtgagtgtcacacacctgttaatccatcttgagcaggacagtactatacaaatagaatgcaagctgtaatgtaattttatattttcttatagccacgttgaagtaaaaacaaacaggtacagtgttttttaccagctttatagaagtacagttgttacatatttaatgaatacaatttgatgggtctgactatatgcacacacctttgataccatcaccacaatcagggtaataaacatacctgtcatctcc

SEQ ID NO: 1674 - DNA, 572 bp, Homo sapiens
gactttggccggatgactccccagggtcggcatcagcgtgggactgggaacaggtgaagggaaacagaagagagcctgagaagaccgctctcctccgatcctaattgactgagccaatgagagccaaagaggctgcggaaacgggactgcggccactacttccggcgtgtaccgagagactggcgtccggcgtgtaccgagagactggcgtccggtgtgcaggtggccacatggatcctggcagccggtggcggaacctgcccagcgggcctagcctaaagcacttgactgacccctcttatggaatcccgcgggaacagcaaaaggcagcgttgcaggagctgacgcgggcgcacgtggagtccttcaactacgctgtgcacgagggtctcggcctcgcggtgcaggctatacctccctttgaatttgctttcaaagatgagcgtatctcttttactattctggatgctgttatcagtccacctacagttccaaaagggaccatctgcaaagaggccaatgtttatccagcagaatgccggggccgaaggagtacctaccgtgggaagttg

SEQ ID NO: 1675 - DNA, 555 bp, Homo sapiens
tttttcgttgaagcaacgactttggccggatgactccccagggtcggcatcagcgtgggactgggaacaggctgcggaaacgggactgcggccactacttccggcgtgtaccgagagactggcgtccggcgtgtaccgagagactggcgtccggtgtgcaggtggccacatggatcctggcagccggtggcggaacctgcccagcgggcctagcctaaagcacttgactgacccctcttatggaatcccgcgggaacagcaaaaggcagcgttgcaggagctgacgcgggcgcacgtggagtccttcaactacgctgtgcacgagggtctcggcctcgcggtgcaggctatacctccctttgaatttgctttcaaagatgagcgtatctcttttactattctggatgctgttatcagtccacctacagttccaaaagggaccatctgcaaagaggccaatgtttatccagcagaatgccggggccgaaggagtacctaccgtgggaagttgacagctgatatcaactgggcagtgaatggaatctcaaaaggaat

SEQ ID NO: 1676 - DNA, 2859 bp, Homo sapiens
cagatcttcatgaatgtcgctatctttgaggatgaagtttttgctggagttaccacacaccaggaactctttccacacagcctgctgagtgtgattgccaacttcatccctttctctgatcacaaccagagtccacggaacatgtaccaatgccagatgggtaagcaaactatgggctttccacttctcacttatcaagaccgatcggataacaaactgtatcgtcttcagactcctcagagtcccttggtgagaccctccatgtatgattattatgacatggataactatccaattgggaccaatgccatcgttgctgtgatttcttacactggctatgatatggaagatgccatgattgtgaataaggcctcttgggaacgaggctttgcccatggaagtgtctacaagtctgagttcatagacctctctgaaaaaattaaacaaggagatagtagcctggtgtttggcatcaaacctggtgacccacgcgttctgcagaagttagatgacgatggattgccgtttataggagcaaaactgcagtacggagatccgtattacagctacctcaacctcaacaccggggaaagttttgtgatgtactataagagtaaagaaaattgtgttgtggataacatcaaagtgtgcagtaatgacactgggagtggaaaattcaagtgtgtttgcatcactatgagagtgcctcggaacccaactatcggagataaatttgccagtcgccatgggcagaagggcattttaagcagattgtggccggctgaggacatgccttttactgagagtgggatggtcccagacattctgttcaatccccatggttttccatcccgcatgaccattgggatgttaattgagagtatggccgggaagtctgcagctttgcatggtctctgccatgatgctacacccttcatcttctcagaggagaactcggccttagaatactttggtgagatgttaaaggctgctggctacaatttctatggcaccgagaggttatatagtggcatcagtgggctagaactggaagcagacatcttcataggagtggtttattatcagcgcttacgccatatggtctcagacaaatttcaagtaaggacaactggagcccgagacagagtcaccaaccagcctattgggggaagaaatgtccagggtggaatccgttttggggagatggaacgggatgcgcttttagctcatggtacatcttttctccttcatgaccgcctcttcaactgctcagatcggtcggtagcccatgtgtgtgaagtgtggcagtttactctctccactgttggagaagccacccccttcttggtctgccatgcgcaacagaaaatacaactgtactctgtgtagtcgcagtgacactatcgatactgtttctgtgccttatgtttttcggtattttgtagctgaactggcagctatgaacatcaaagtgaaactggatgttgtttaacttgatgttgaccttttggattaagaggactatcagattaaagcaaaatgtaattttaattcaatgaagatatcattaccaggttactcttgagatttttcaacggtgttagaactctcaaccaagacctgaaaaccaagtatgcaaggtttctgaatctctctggtagattaactattgacaatgattttctgttatctttgttcaaaaagttcatgtcttctcaaaatatgaaatattgataaatggaagagcatacggtgacaagtctcctttccaaccccaggttccctacaccctgctctcagcaggcagtgagtgtcacacacctgttaatccatcttgagcaggacagtactatacaaatagaatgcaagctgtaatgtaattttatattttcttatagccacgttgaagtaaaaacaaacaggtacagtgttttttaccagctttatagaagtacagttgttacatatttaatgaatacaatttgatgggtctgactatatgcacacacctttgataccatcaccacaatcagggtaataaacatacctgtcatctccacaagtttcctcctgcccctttgttttttgctttttggttgctgttgagtttttgttttgtcttctgtggtaagaacacttaactcaagacctaccctcttaacaaatctttaagtgcacgatatagtattgttaattccaggcaccatgttgtacaacagatctttagaccttacttgtcttgcataactgaagctttatacctgttgaacaactctccatttccctggcccctagcaaccacccttctaccctgtttctatgagtttgactattacagatatctcatatagtgggatcatgcaatatttgtcctgtgactggcttatttcacttagcatagtgaaataagattcatccattttggaagccaggcatggtgctgtgcatctatagtccctgctatttgagaggctgaggtgggaggatcatttgagtgcaggagttcaaggacagcctgggtaatataggaagaccctgtcttgaagaccctgacctcaagtgatccacccacctcggcctccgaaagtgctaggattacaggtgtgagccactgtgcctggcctccggtgagtattttatatttagtctacacttccatacttggcttttttctgcttttatattgatctgctttcatagcagtgtgtagagtgccacttatgttttctttcttgtgtacagtattttattgtatggatttaccatcccctgtgtatttaagttgttccattctttggccattataacttttttctgcaaatattctggtgacttatctttggccattataaactgttg

SEQ ID NO: 1677 - DNA, 3143 bp, Homo sapiens
actggcgtccggcgtgtaccgagagactggcgtccggtgtgcaggtggccacatggatcctggcagccggtggcggaacctgcccagcgggcctagcctaaagcacttgactgacccctcttatggaatcccgcgggaacagcaaaaggcagcgttgcaggagctgacgcgggcgcacgtggagtccttcaactacgctgtgcacgagggtctcggcctcgcggtgcaggagtttcaatgcactgtgtgagggaagaacattccgctgtcaatatgaacctccactacttggaaaatggcactgttatgttgaactttatttaccgaaaagaactgttctttcttcctttgggatttgcacttaaggcacttgtcagcttttctgattatcagatctttcaggagctcatcaaaggaaaagaggatgattctttccttaggaactctgtttctcagatgttaaggattgtaatggaagagggttgttcgacacaaaaacaggtccttaactacctaggtgaatgcttcagagtaaaactcaatgttcctgactggtacccaaatgagcaagctgcggagttcctgtttaaccagtgcatctgtatccacttgaaatccaatactgaaaagttttatatgctttgtctcatgacgcgaaagctctttgctttagccaaaggagagtgcatggaggacaatcctgatagtttggtgaaccaggaagtcctcacaccgggtcagctcttccttatgttcctgaaggaaaaactggaaggttggttagtgtctattaaaatagcttttgataagaaggctcagaagaccagtgtttccatgaacactgacaatttgatgaggatttttacaatgggcatagaccttacaaaaccatttgaatacctttttgctactgggaatctgcgttctaaaacaggtcttggcctcctacaagattctggactttgtgttgtggctgacaagctgaacttcatacgctacctctcccatttccgctgcgtgcacagaggggctgattttgccaagatgaggaccaccacagtacgcaggctgctgccagagtcctggggcttcctttgtcccgtgcataccccagacggggagccctgtggcctgatgaaccacctaactgccgtatgtgaggttgtcacacagtttgtgtatacggcatctattccagctttactgtgcaacttgggggtcactcccattgatggagctccccaccgatcatacagtgagtgctaccctgtcctgctggacggtgtcatggttggctgggtggataaggatcttgctccaggcatcgcagattctcttcgtcattttaaggtgttgagagagaaaagaattcctccctggatggaagtggtccttatacccatgacaggaaaaccaagtctgtacccaggattgttcctttttaccactccttgtagactggtacggcctgtgcagaacttagcattgggcaaagaagagctaattggaactatggaacagatcttcatgaatgtcgctatctttgaggatgaagtttttgctggagttaccacacaccaggaactctttccacacagcctgctgagtgtgattgccaacttcatccctttctctgatcacaaccagagtccacggaacatgtaccaatgccagatgggtaagcaaactatgggctttccacttctcacttatcaagaccgatcggataacaaactgtatcgtcttcagactcctcagagtcccttggtgagaccctccatgtatgattattatgacatggataactatccaattgggaccaatgccatcgttgctgtgatttcttacactggctatgatatggaagatgccatgattgtgaataaggcctcttgggaacgaggctttgcccatggaagtgtctacaagtctgagttcatagacctctctgaaaaaattaaacaaggagatagtagcctggtgtttggcatcaaacctggtgacccacgcgttctgcagaagttagatgacgatggattgccgtttataggagcaaaactgcagtacggagatccgtattacagctacctcaacctcaacaccggggaaagttttgtgatgtactataagagtaaagaaaattgtgttgtggataacatcaaagtgtgcagtaatgacactgggagtggaaaattcaagtgtgtttgcatcactatgagagtgcctcggaacccaactatcggagataaatttgccagtcgccatgggcagaagggcattttaagcagattgtggccggctgaggacatgccttttactgagagtgggatggtcccagacattctgttcaatccccatggttttccatcccgcatgaccattgggatgttaattgagagtatggccgggaagtctgcagctttgcatggtctctgccatgatgctacacccttcatcttctcagaggagaactcggccttagaatactttggtgagatgttaaaggctgctggctacaatttctatggcaccgagaggttatatagtggcatcagtgggctagaactggaagcagacatcttcataggagtggtttattatcagcgcttacgccatatggtctcagacaaatttcaagtaaggacaactggagcccgagacagagtcaccaaccagcctattgggggaagaaatgtccagggtggaatccgttttggggagatggaacgggatgcgcttttagctcatggtacatcttttctccttcatgaccgcctcttcaactgctcagatcggtcggtagcccatgtgtgtgtgaagtgtggcagtttactctctccactgttggagaagccacccccttcttggtctgccatgcgcaacagaaaatacaactgtactctgtgtagtcgcagtgacactatcgatactgtttctgtgccttatgtttttcggtattttgtagctgaactggcagctatgaacatcaaagtgaaactggatgttgtttaacttgatgttgaccttttggattaagaggactatcagattaaagcaaaatgtaattttaattcaatgaagatatcattaccaggttactcttgagatttttcaacggtgttagaactctcaaccaagacctg

SEQ ID NO: 1678 - DNA, 4059 bp, Homo sapiens
gactttggccggatgactccccagggtcggcatcagcgtgggactgggaacaggtgaagggaaacagaagagagcctgagaagaccgctctcctccgatcctaattgactgagccaatgagagccaaagaggctgcggaaacgggactgcggccactacttccggcgtgtaccgagagactggcgtccggcgtgtaccgagagactggcgtccggtgtgcaggtggccacatggatcctggcagccggtggcggaacctgcccagcgggcctagcctaaagcacttgactgacccctcttatggaatcccgcgggaacagcaaaaggcagcgttgcaggagctgacgcgggcgcacgtggagtccttcaactacgctgtgcacgagggtctcggcctcgcggtgcaggctatacctccctttgaatttgctttcaaagatgagcgtatctcttttactattctggatgctgttatcagtccacctacagttccaaaagggaccatctgcaaagaggccaatgtttatccagcagaatgccggggccgaaggagtacctaccgtgggaagttgacagctgatatcaactgggcagtgaatggaatctcaaaaggaatcattaagcagtttcttggctatgttcccatcatggtgaaatccaagctttgcaacttacgtaaccttcccccacaagccctcattgagcaccatgaggaggcagaggaaatggggggctattttataatcaatggcattgaaaaagtcatccgaatgttgattatgcctcggagaaattttcccattgcaatgataagaccaaaatggaaaaccagagggcctggttatactcagtatggagtttcaatgcactgtgtgagggaagaacattccgctgtcaatatgaacctccactacttggaaaatggcactgttatgttgaactttatttaccgaaaagaactgttctttcttcctttgggatttgcacttaaggcacttgtcagcttttctgattatcagatctttcaggagctcatcaaaggaaaagaggatgattctttccttaggaactctgtttctcagatgttaaggattgtaatggaagagggttgttcgacacaaaaacaggtccttaactacctaggtgaatgcttcagagtaaaactcaatgttcctgactggtacccaaatgagcaagctgcggagttcctgtttaaccagtgcatctgtatccacttgaaatccaatactgaaaagttttatatgctttgtctcatgacgcgaaagctctttgctttagccaaaggagagtgcatggaggacaatcctgatagtttggtgaaccaggaagtcctcacaccgggtcagctcttccttatgttcctgaaggaaaaactggaaggttggttagtgtctattaaaatagcttttgataagaaggctcagaagaccagtgtttccatgaacactgacaatttgatgaggatttttacaatgggcatagaccttacaaaaccatttgaatacctttttgctactgggaatctgcgttctaaaacaggtcttggcctcctacaagattctggactttgtgttgtggctgacaagctgaacttcatacgctacctctcccatttccgctgcgtgcacagaggggctgattttgccaagatgaggaccaccacagtacgcaggctgctgccagagtcctggggcttcctttgtcccgtgcataccccagacggggagccctgtggcctgatgaaccacctaactgccgtatgtgaggttgtcacacagtttgtgtatacggcatctattccagctttactgtgcaacttgggggtcactcccattgatggagctccccaccgatcatacagtgagtgctaccctgtcctgctggacggtgtcatggttggctgggtggataaggatcttgctccaggcatcgcagattctcttcgtcattttaaggtgttgagagagaaaagaattcctccctggatggaagtggtccttatacccatgacaggaaaaccaagtctgtacccaggattgttcctttttaccactccttgtagactggtacggcctgtgcagaacttagcattgggcaaagaagagctaattggaactatggaacagatcttcatgaatgtcgctatctttgaggatgaagtttttgctggagttaccacacaccaggaactctttccacacagcctgctgagtgtgattgccaacttcatccctttctctgatcacaaccagagtccacggaacatgtaccaatgccagatgggtaagcaaactatgggctttccacttctcacttatcaagaccgatcggataacaaactgtatcgtcttcagactcctcagagtcccttggtgagaccctccatgtatgattattatgacatggataactatccaattgggaccaatgccatcgttgctgtgatttcttacactggctatgatatggaagatgccatgattgtgaataaggcctcttgggaacgaggctttgcccatggaagtgtctacaagtctgagttcatagacctctctgaaaaaattaaacaaggagatagtagcctggtgtttggcatcaaacctggtgacccacgcgttctgcagaagttagatgacgatggattgccgtttataggagcaaaactgcagtacggagatccgtattacagctacctcaacctcaacaccggggaaagttttgtgatgtactataagagtaaagaaaattgtgttgtggataacatcaaagtgtgcagtaatgacactgggagtggaaaattcaagtgtgtttgcatcactatgagagtgcctcggaacccaactatcggagataaatttgccagtcgccatgggcagaagggcattttaagcagattgtggccggctgaggacatgccttttactgagagtgggatggtcccagacattctgttcaatccccatggttttccatcccgcatgaccattgggatgttaattgagagtatggccgggaagtctgcagctttgcatggtctctgccatgatgctacacccttcatcttctcagaggagaactcggccttagaatactttggtgagatgttaaaggctgctggctacaatttctatggcaccgagaggttatatagtggcatcagtgggctagaactggaagcagacatcttcataggagtggtttattatcagcgcttacgccatatggtctcagacaaatttcaagtaaggacaactggagcccgagacagagtcaccaaccagcctattgggggaagaaatgtccagggtggaatccgttttggggagatggaacgggatgcgcttttagctcatggtacatcttttctccttcatgaccgcctcttcaactgctcagatcggtcggtagcccatgtgtgtgtgaagtgtggcagtttactctctccactgttggagaagccacccccttcttggtctgccatgcgcaacagaaaatacaactgtactctgtgtagtcgcagtgacactatcgatactgtttctgtgccttatgtttttcggtattttgtagctgaactggcagctatgaacatcaaagtgaaactggatgttgtttaacttgatgttgaccttttggattaagaggactatcagattaaagcaaaatgtaattttaattcaatgaagatatcattaccaggttactcttgagatttttcaacggtgttagaactctcaaccaagacctgaaaaccaagtatgcaaggtttctgaatctctctggtagattaactattgacaatgattttctgttatctttgttcaaaaagttcatgtcttctcaaaatatgaaatattgataaatggaagagcatacggtgacaagtctcctttccaaccccaggttccctacaccctgctctcagcaggcagtgagtgtcacacacctgttaatccatcttgagcaggacagtactatacaaatagaatgcaagctgtaatgtaattttatattttcttatagccacgttgaagtaaa

SEQ ID NO: 1679 - DNA, 3748 bp, Homo sapiens
cttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagcgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtg

SEQ ID NO: 1680 - DNA, 4108 bp, Homo sapiens
actgagaacctacttaaagctatggcaaaggcactggaggattgagctaggtgggcagaaaagagcagtgtcgttatttgtgcaacaacattgaaaaacaagcagaaataaaacattgacggaacggatacgaccgcagattgcgggagctgtcctctcaatcagcccggcagcggcggcccacaatttacgcgtgtgcaaccctaaccccggcccaagcttgacctacaatttgcgcaggcgcagatcctaactttggcgtccctgtgggcggcctttggtgtgagacgcgtggtattctgggaacgtcggagacggaagttacttcgtctttagctcctggcgctgctggcttctgggcggtttttgtcttttgatttcaagagttaggagctcgagaaccgtttggcaatatgtacgacgcggatgaggatatgcaatatgatgaggatgatgatgaaatcaccccggatttgtggcaagaagcatgctggattgtaatcagttcctattttgacgagaaaggcttggttagacaacagctggattcttttgatgagtttattcagatgtctgttcaaagaattgtggaagacgctcctcctatagacctacaggctgaagctcagcatgctagtggagaagttgaagaaccgccacgatatttgctgaagtttgaacaaatttatctttccaagcctacccattgggaaagagatggtgctccttcaccaatgatgcccaatgaagctagattaaggaatctcacgtattctgctccgctttatgttgatataacaaaaacagtcattaaagaaggtgaagaacaacttcagactcagcatcagaaaacttttataggaaaaattccaattatgttgcggtcaacttactgccttttgaatggcttgacagatcgtgatctttgtgagttaaatgaatgccctttggatcctggtggctatttcattattaatggatcagaaaaggttctgattgcccaagagaaaatggcaacaaacacagtttatgtgtttgccaaaaaggattctaaatatgcctacacaggagagtgtagatcatgtcttgagaattcttcccgacccaccagtactatatgggttagcatgctggcaagaggaggacagggtgccaagaagagtgctattggtcagcgcattgtggcaactctaccatatatcaagcaagaagttcccatcattattgtgttcagagcattaggttttgtgtccgacagagatattttagaacatattatttatgattttgaagatccagagatgatggaaatggttaaaccttctctcgatgaagcttttgtcatccaagaacagaatgttgcactaaatttcattggttcaagaggagcaaagcctggtgttactaaagagaaaagaattaaatatgcaaaggaagttttacaaaaagaaatgctccctcatgttggtgtcagtgatttttgtgagaccaaaaaagcctatttcttgggatacatggttcataggttacttctggcagctttgggtagaagagaactagatgacagagatcactatggaaacaagagattggatcttgctgggccgctgcttgcattcttatttagaggtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtgttaaaccgcctgacttttgcgtctactctttctcacctgcgtcgtttaaattctcctattggtagagacggcaagctagcaaaaccaagacagttgcataatacgttgtggggaatggtgtgtcctgccgagaccccagagggccatgctgtaggacttgtgaagaatttagccttgatggcgtatatttcagttggatctcaaccatctccaattctggaatttttagaagaatggagtatggaaaatttagaagaaatttctcctgcagctattgctgatgcaaccaagatttttgttaatggctgctgggttggaatacataaagatcccgaacaacttatgaacaccctaaggaaattgagacgtcagatggacatcattgtgtctgaagtttctatgatcagagatattcgagagagggagattcggatctatacggatgcaggccgtatttgtagaccacttctgattgtggaaaaacaaaagctacttttgaagaagaggcatattgaccaattgaaagagagagaatataacaactatagttggcaggatcttgtggccagtggggtagtggagtatattgataccctggaagaagaaacagtgatgcttgcaatgactccagatgatttacaggagaaagaagtagcttattgttccacatatacacactgtgagattcatccctcaatgatccttggtgtctgtgcatctattattccctttcctgatcataaccagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggcatcaactcaattgtggccattgcatcatacactggatataatcaggaagactctgttatcatgaatcgttcagctgtagaccgcggcttcttcaggtctgttttctatcgctcatacaaagaacaggagtctaaaaaaggatttgatcaagaagaagtttttgagaagcctacacgtgaaacatgccagggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagcgagacgggcattgtggatcaggttatggtaactctcaatcaggaaggatataaattttgtaaaataagggtacgctctgttaggattccacagattggagacaaatttgctagtcgacatggtcaaaagggtacttgtggtattcagtatagacaagaggatatgcctttcacctgtgaaggtatcacccctgatatcatcatcaatccccatgccatcccctctcgtatgactattggtcacttaattgaatgccttcaagggaaggtatcggctaacaagggtgaaattggtgatgccactccatttaatgatgctgttaacgtgcagaagatttctaatcttttatctgattatggctatcatctcagaggaaatgaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcgtgatggtggcctgcgttttggagaaatggaacgagattgtcagattgcccatggagcagcccagtttttaagggaaagattgtttgaggcatcagatccatatcaggttcatgtttgcaatctttgtggaataatggcgattgccaacaccaggacccatacatatgaatgcaggggctgccgcaataaaacccagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtc

SEQ ID NO: 1681 - DNA, 2271 bp, Homo sapiens
ttgctccgcgcttctgcttccggcggcgctggtggtggcgcgcggcgcggcgcggcgatggcggcgggtggcagcgatccgcgggctggcgacgtagaggaggacgcctcacagctcatctttcctaaagagtttgaaacagctgagacacttctaaattcagaagttcatatgcttctggaacatcgaaagcagcagaatgagagtgcagaggacgaacaggagctctcagaagtcttcatgaaaacattaaactacacagcccgtttcagtcgtttcaaaaacagagagaccattgccagtgttcgtagcttgctactccagaaaaagcttcataagtttgagttggcctgtttggccaacctttgcccagagactgctgaggagtccaaggctctaatcccaagcttggagggacggtttgaagatgaggagctgcagcagattcttgatgatatccagacaaagcgcagctttcagtattaatctccaaacatcactgctgctcggagaaaccacatccccaggcataacaccaccttcccactgtctggggctgacttgcacagaaattctgttgaagacagttgagaattcctttggagaaaacagcccagcttggcgtggggttaggttgctgtttcaaataactcacaggcccaggtgacatggaatcttggagcagccttgtgcagtggcagccagtggcttcctgaacgtgcctctgcgaagtgtgagatgaggggtcacataaccacactgttgactacctcattcctggtttttggcctccacatcatcttttttcttaatatttcatgttttaatttcagggtgtttatactttttgaaactagaccagaagatagtagactttatagagaaagaccagttttacctagatactaaaggaagaattaaaccgctgttagtttgaaatgctttttttttttttttttaaatggagatagggtcttaactcttgtccaggctggaggagtgcagtcgtacagtcatggctcactgaagtcttgaccccgctgcctcagcctcccaaataactggggccacaggtgtgcaccacaactctcagctaatttttaaaattttttatagaggtggggttttactatgctgtccagactggtcttaaactcctgggctcaagtgatccccctgccttggcctcccaaactggtgagattacaggcatgagccaccacaactggcctgaaattcttaaaggatgggagtgtcgatgacagcaccttggcatcgttgtgcctaacctgggagacggaagaagcacgccatgggaagtgtttacacttggggacaagtgctaagtattgtggagcccatagccccttgagatagatggctactttgcctttcttcttgaactgtcttgcagaatgtggatttggggtaagtggtcttgaaggattcatttagtcaccctcaaattaagatttttacttcatctttcttgggcctgcacctccaagataacaaagaagaagcaatggtcgtgccaaagaggtccacaaccaggtgtgcactgttcactgcagcccatttgctgtatgaactgtggttgttgtgtgcccaatgacaaggctactaagaaattcatcatttgaaacgtagaggccgcagcagtcagcgatgtttctgaaatgagcatccttgacgcctgtgtacttcccaggctggatgtgaagctacattaccatgtgagttgtgccattcacagcacagtggtgaggaattgagctcatgaagcaggcaaggaccgaacacctccaccccaacgtagacctgcaggtgctgccccatgacctccaccaaagcccatataaggagcggagttgttaaggactgaagaaaaacttctctggagaaaaataaaattgcaattctacttaaaaaaatttttttttttttttacttcataggccaggcttgaagttctgaacactttgaagtctccaattatgagagatccagtctaagcctctggcctgctaattagcaataagtgctttatttggaaggagggagtcatccactcttgagccactgcagtgaagtcacttgatctcagtctgggggaaaacacttcaatagctaaacattctagctttgatttttctgaagggaatacacttgttttcaattttggggtttttctttggggcacttgcttgactctgtatgaacttgtgatccaaggaaaaaggagaaagaacagtgttggcttttaaaatc

SEQ ID NO: 1682 - DNA, 1598 bp, Homo sapiens
cgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaacaaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccgtctcttgaccttgtgatccgcccgactcggcctcccaaaatgctgggattacaggcgtgagccatcaagtctggtgagagagattgtttctagatgagggtgggggcgggtgtccttagcccaaagcttgtgccagtctctatcagaaataaatgcccccaaaacctc

SEQ ID NO: 1683 - DNA, 1030 bp, Homo sapiens
acttggggtctggacgcaacggcggcgggagcatgaacgcccctccagccttcgagtcgttcttgctcttcgagggcgagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaacaaagtggtccagcgacactcgcc

SEQ ID NO: 1684 - DNA, 4199 bp, Homo sapiens
aacgctcctgcggacgcccccttctcccagtccgtgtttgtttccggaatttcaataaagctcgattcggctcgaagaagaccccgttcttccgggaaaatggcgactcccgctcgtgccccggagtcaccgccgtccgcggatccggcgctagtagcggggcctgccgaggaagccgagtgcccgccgccgcgccagcctcagcccgcgcagaatgtgctcgctgccccgcggcttcgagccccaagctcccgaggacttggcgcagcggagtttggtggagctgcgggaaatgttgaagcgccaggagagacttttgcgcaacgaaaaattcatttgcaaattgcccgacaaaggtaaaaagatctttgactcttttgccaaactgaaagctgccattgcagaatgtgaagaagttagaagaaaaagtgaactgtttaaccctgttagtttagactgtaagctaaggcaaaaagcaattgcagaagttgatgtgggtacagataaggcccagaattctgacccgatacttgatacttcatcactagttcctggatgttcctctgtagataacatcaagtcatctcaaacctcacaaaaccagggacttggacgtcctactcttgaaggtgatgaagagacttcagaggttgagtacacagtgaataagggcccagcttccagcaatagagacagggtaccaccttcatctgaagctagtgagcatcacccgcggcatcgtgtttcaagtcaagcggaagatacttccagcagctttgacaacctgtttattgacaggttacagaggatcaccattgcggaccaaggtgaacaacagtcagaagaaaacgcaagtactaagaacttgacaggcctttccagtgggactgagaagaaacctcattacatggaagtgctagaaatgcgagccaaaaacccagtgccccagctgcgtaaatttaaaaccaatgtgttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatcaagatcagtgtcagatattgttgagggaagtaattttataaagttacacaaaggtagttataaaaaaagcccagtttgtctttcagaaggtgactttcatgtgcttgaaaagtttaatatttgaatattgtgtttaaccacatggtattaaaattttgcaatatattgtgtattggtctgatattttagtatatagtagaacatactttttttttctttaagccaaatgaaaagaggtaactttgcttttttcctttttcttacctatcaaatagcatttattacatgtctttcagtgaaatacttagttgttccaggcacctaaaatcaattaggaagacatagttcccttcttttttgggtaatgaagggagcagtctaaagaattgtatgcatgtttgcatggggttattgagacattggatgtgaaatacctaggaagacatgtatggagaatgcttaacaaatgctcttctcctttttctgtcttcccttaggaagaacgttatctctcttctgattaggaaggacttcccttttgagtagatgctggaaagtggaggttttttttgttggtttgtttgtttggttttgtgtttttttttgagatggggtcttgctctgtcgcccaggctggagtgcagtggcaggatctcggctcactgcaatctaggtggaggtctttttaaataacctcatgttacttcaggcaaatctggtacaggagaagcccaagctaactgagctgggtgaaggcttgtgcatcacctggcttgagttccttgctgtcacagatgataggttcatgtacacaacattaatgtttgataaggaaagcattttttttttgttaaaattgaattgtcagtactttacttttttccccccaaataggtatatatagactgcagaagcttcagtcccatatataaacgttcatgtcattttagaggattatatggttgtctccagagaaattaacttacattatcaaaaaattctttgtctaatatattggagtctttaaaagtgttgaagaataaaatattaattagaacaacttcaaatgctaaggtgatgttttaccgggacttaattaaatacaactttttcctttcgaaaaagactgttcacatttgcttccaggtgtaattattgctttcattccttacccccctcaagcaaatgtgaaaagtatactgacctaagattctcattagttttagttcttaaaacgaatagtaaatgatttcacagcgtaaaatttgatgttatttctggaagctggatgatatggaagagttcatgtgcctggacacacagttccctgtaatcctgccatctagggagataaactctgttaacattttgatgttgtgtttttgcttatttttctatgcatagttatgcatttatattctcaaaaatgaaatcataatgtacattgctttgtagtctgctctatatattgtcaatatgttcccatattaaatattttgctttttagacagctgtaggatattttatttcatgggtataccataactttaagatttatttcctattcagcaatttgattatgtattataatgtaatctgtaaatagtgatatgattaacatcttaatcacatccatagaaaatgacttatttccagaagataccgctctaaaaatgaaattgttaggtgaaagtgtttttgagaatttttatatatattactcactgcagagatcatgttcatttacattcccattagcaatatatccaatgctcagaattgaaaattactacttaaaatctttgcaaattgaataattacagaaaagggctacatttaaaatttgtatttgtttttcttacttagtgaaggttgtgttttttttcatattcattggccatgctatattcattcttttgagaattgctcattcatattttttctgttgcttgcttggagaatttgctctttttttggcatataagttcttaagaatgtccgtcctttgtcatatattgtaactttttttagccttatttgtcatttaacatagtttgtggtatttcagtatagaagttgttttctttaggagtctacctttgtgtatgtgcttgaaagtatttttgtaatccaagaatggataaatgtccttattttcttctagtattttcttatttcacttttacacctatctttaaaaggaatttaaattttgtttatatacattaactaaatcagtacaagtttggggtgaaaaggaaatttttaatccatctcaaatgtatttggttatattatataaggtagggatttgattttatttcgaagaatttaccaattggttcagtatgtgaaaccaccatttcccctctgattagtaatgctatttttatagaatattaaattcttatgtgtcttttgtgtcttaggccaatttctgggccttctgggttttttctacactgtcaataattatcgctttaattggtgttaatatttggtagtacacaggttctcccttgttcttttaaattttgtgaaatataacttacaaataagtacttaaaacagagcttaatgggtaaagcaacagctgtgtaatcacaaactagatgcagaggaggtcttgccagcactccaaaatctctgtgtgtcccctcttgacactcactgtttcccccagagctaactatcctgacgtatggtaattctccctctgtccttttaagaattattttaccagttatgtgtataacaatatggtttacattttgctcacttttgacttatataaaaatagaataatactata

SEQ ID NO: 1685 - DNA, 3629 bp, Homo sapiens
aaaatggcgactcccgctcgtgccccggagtcaccgccgtccgcggatccggcgctagtagcggggcctgccgaggaagccgagtgcccgccgccgcgccagcctcagcccgcgcagaatgtgctcgctgccccgcggcttcgagccccaagctcccgaggacttggcgcagcggagtttggtggagctgcgggaaatgttgaagcgccaggagagacttttgcgcaacgagttacagaggatcaccattgcggaccaaggtgaacaacagtcagaagaaaacgcaagtactaagaacttgacaggcctttccagtgggactgagaagaaacctcattacatggaagtgctagaaatgcgagccaaaaacccagtgccccagctgcgtaaatttaaaaccaatgtgttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatcaagatcagtgtcagatattgttgagggaagtaattttataaagttacacaaaggtagttataaaaaaagcccagtttgtctttcagaaggtgactttcatgtgcttgaaaagtttaatatttgaatattgtgtttaaccacatggtattaaaattttgcaatatattgtgtattggtctgatattttagtatatagtagaacatactttttttttctttaagccaaatgaaaagaggtaactttgcttttttcctttttcttacctatcaaatagcatttattacatgtctttcagtgaaatacttagttgttccaggcacctaaaatcaattaggaagacatagttcccttcttttttgggtaatgaagggagcagtctaaagaattgtatgcatgtttgcatggggttattgagacattggatgtgaaatacctaggaagacatgtatggagaatgcttaacaaatgctcttctcctttttctgtcttcccttaggaagaacgttatctctcttctgattaggaaggacttcccttttgagtagatgctggaaagtggaggttttttttgttggtttgtttgtttggttttgtgtttttttttgagatggggtcttgctctgtcgcccaggctggagtgcagtggcaggatctcggctcactgcaatctaggtggaggtctttttaaataacctcatgttacttcaggcaaatctggtacaggagaagcccaagctaactgagctgggtgaaggcttgtgcatcacctggcttgagttccttgctgtcacagatgataggttcatgtacacaacattaatgtttgataaggaaagcattttttttttgttaaaattgaattgtcagtactttacttttttccccccaaataggtatatatagactgcagaagcttcagtcccatatataaacgttcatgtcattttagaggattatatggttgtctccagagaaattaacttacattatcaaaaaattctttgtctaatatattggagtctttaaaagtgttgaagaataaaatattaattagaacaacttcaaatgctaaggtgatgttttaccgggacttaattaaatacaactttttcctttcgaaaaagactgttcacatttgcttccaggtgtaattattgctttcattccttacccccctcaagcaaatgtgaaaagtatactgacctaagattctcattagttttagttcttaaaacgaatagtaaatgatttcacagcgtaaaatttgatgttatttctggaagctggatgatatggaagagttcatgtgcctggacacacagttccctgtaatcctgccatctagggagataaactctgttaacattttgatgttgtgtttttgcttatttttctatgcatagttatgcatttatattctcaaaaatgaaatcataatgtacattgctttgtagtctgctctatatattgtcaatatgttcccatattaaatattttgctttttagacagctgtaggatattttatttcatgggtataccataactttaagatttatttcctattcagcaatttgattatgtattataatgtaatctgtaaatagtgatatgattaacatcttaatcacatccatagaaaatgacttatttccagaagataccgctctaaaaatgaaattgttaggtgaaagtgtttttgagaatttttatatatattactcactgcagagatcatgttcatttacattcccattagcaatatatccaatgctcagaattgaaaattactacttaaaatctttgcaaattgaataattacagaaaagggctacatttaaaatttgtatttgtttttcttacttagtgaaggttgtgttttttttcatattcattggccatgctatattcattcttttgagaattgctcattcatattttttctgttgcttgcttggagaatttgctctttttttggcatataagttcttaagaatgtccgtcctttgtcatatattgtaactttttttagccttatttgtcatttaacatagtttgtggtatttcagtatagaagttgttttctttaggagtctacctttgtgtatgtgcttgaaagtatttttgtaatccaagaatggataaatgtccttattttcttctagtattttcttatttcacttttacacctatctttaaaaggaatttaaattttgtttatatacattaactaaatcagtacaagtttggggtgaaaaggaaatttttaatccatctcaaatgtatttggttatattatataaggtagggatttgattttatttcgaagaatttaccaattggttcagtatgtgaaaccaccatttcccctctgattagtaatgctatttttatagaatattaaattcttatgtgtcttttgtgtcttaggccaatttctgggccttctgggttttttctacactgtcaataattatcgctttaattggtgttaatatttggtagtacacaggttctcccttgttcttttaaattttgtgaaatataacttacaaataagtacttaaaacagagcttaatgggtaaagcaacagctgtgtaatcacaaactagatgcagaggaggtcttgccagcactccaaaatctctgtgtgtcccctcttgacactcactgtttcccccagagctaactatcctgacgtatggtaattctccctctgtccttttaagaattattttaccagttatgtgtataacaatatggtttacattttgctcacttttgacttatataaaaatagaataatact

SEQ ID NO: 1686 - DNA, 3487 bp, Homo sapiens
ggatgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtttcccatgctcagcaggagtatctggagaatcacatccaaacccagtcgtctgccctggatcgttttaatgccatgaactcagccttggcatcagattccattggcctgcaaaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagattgaatcattaaagaaaaagttgcaacagaaacagctcttaatactgcagcttttagaaaagatatctttcttagaaggagagaataatgaactacaaagcaggttggactatttaacagaaacccaggccaagactgaagtggaaaccagagagataggagtgggctgtgatcttctacccagccaaacaggcaggactcgtgaaattgtgatgccttctaggaactacaccccatacacaagagtcctggagttaaccatgaagaaaactctgacttaggcactcagaggcatacactttttacagatggacaaaagctctggaaccctgtggcttcaaatcctttgggaagggtgactgttgtttcccctacacacagtgtaagccggaatgggaatcgctgaggctctgatccacttctaagacaggaaggaaagtgaaggcagagtgagcaggcaaagtagaaaattcgaaaaggtcctcaacgagtttgtacagctgctcccactccctcatcacctcttgtgggcctttggaaatgtatgttggaggagacattttggattgttgcaatgacttgggagtgccatagcacctagcaggcagaagccagaaacaccaaatgtcttaacaatgcttgaggcggtgctacaaatgaagtccttctccaaatgcattgagccccaagaaaaatcgctgattctgaggaaccttccaactttaacaatttcaggacgtccctaagctgagctaggaggcaccacgcacaggccggaggcaccacgcacaggccagagtctcccaaatcctgtcccgcactctctcccaccttattaatggccagctcatctttcaagtttcgacttgaaccacttctcagagatatcttcccaggtgcccatcccaacgttactattatatcataatttgattctccctccccccatccccccgccaactctgtaaaccccaagtataacacaggacgttgctatttgttgactgacacatagtgcttggtgaggtcacgctggcgctgaatactttttgtataaaccgacgaacagctgatgaccgcatgaatgctcacacaaggggaaagggcgccaagccaaggagccggcgtcatccgacgtaacttccgccctttaacgctcctgcggacgcccccttctcccagtccgtgtttgtttccggaatttcaataaagctcgattcggctcgaagaagaccccgttcttccgggaaaatggcgactcccgctcgtgccccggagtcaccgccgtccgcggatccggcgctagtagcggggcctgccgaggaagccgagtgcccgccgccgcgccagcctcagcccgcgcagaatgtgctcgctgccccgcggcttcgagccccaagctcccgaggacttggcgcagcggagtttggtggagctgcgggaaatgttgaagcgccaggagagacttttgcgcaacgaaaaattcatttgcaaattgcccgacaaaggtaaaaagatctttgactcttttgccaaactgaaagctgccattgcagaatgtgaagaagttagaagaaaaagtgaactgtttaaccctgttagtttagactgtaagctaaggcaaaaagcaattgcagaagttgatgtgggtacagataaggcccagaattctgacccgatacttgatacttcatcactagttcctggatgttcctctgtagataacatcaagtcatctcaaacctcacaaaaccagggacttggacgtcctactcttgaaggtgatgaagagacttcagaggttgagtacacagtgaataagggcccagcttccagcaatagagacagggtaccaccttcatctgaagctagtgagcatcacccgcggcatcgtgtttcaagtcaagcggaagatacttccagcagctttgacaacctgtttattgacaggttacagaggatcaccattgcggaccaaggtgaacaacagtcagaagaaaacgcaagtactaagaacttgacaggcctttccagtgggactgagaagaaacctcattacatggaagtgctagaaatgcgagccaaaaacccagtgccccagctgcgtaaatttaaaaccaatgtgttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggaaagaccgttttacagccctcagtaccgcagttccatgaacttgctcagcttggcagccgcagctaaggacacccgtggtagtaaaagcgggaagatgggctccctggctcttcttaccaaactctga

SEQ ID NO: 1687 - DNA, 1851 bp, Homo sapiens
gtcttcttcggtggcgatccgcgtcctagaaagggcggtgggctccacctcggcctagaaggccagcgggagccgtaggaagccgtcgcgggaagctcagccgaattggagttggagcccccggattgcgctgaccctgagctctcagactccccagtacaatgactcaagcagaaattaagctctgttctttgttgctgcaagagcattttggagagattgtagaaaaaattggagtccatctgataagaaccggcagccagccactaagagtaattgcccatgacacaggaacatcactggatcaggtgaagaaagccctgtgtgtcctcgtccaacataacctggtgagttatcaagtgcacaaacgtggtgtggtggagtatgaagcccagtgcagccgggtattgcgaatgcttagatatccccggtacatctatactaccaaaactctgtacagtgacactggagagctgattgttgaggagcttctgttgaacggcaaactgacaatgtcagctgttgtgaagaaagtggcagaccggctcacagagaccatggaggatggcaagaccatggactatgctgaagtatcaaacacatttgtgcgactggcagacacacactttgtacaacgctgcccttcggtacctaccactgagaattcagaccctgggccaccaccacctgcccccacacttgtcattaatgaaaaggacatgtacctggttcctaaactcagcttgatagggaaaggtaaaaggaggagatcatctgatgaagatgctgctggggagcccaaggccaagagaccaaaatatactacagataacaaggagcccattccagatgatgggatttattggcaggccaaccttgacagattccaccaacacttccgtgaccaagccattgtgagcgcagttgctaacaggatggaccagacaagcagcgagattgtgcgaaccatgctccgaatgagtgagattaccacttcctctagtgctcccttcacccagccattgtcttccaatgagatcttcagatccctacctgttggctataacatctctaagcaagttcttgatcagtatctcactctgctggcagatgatccactagagtttgttggaaagtctggcgacagtggtggaggaatgtatgtcatcaacctccataaggcattagcatccctagccacagccactctggagtccgtcgtacaggagagatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggaaattcccaaaacaccagaccatgccccatccaggaccttctatttatatactgtgaacatcctgtcagctgcccgaatgttgttgcacaggtgctacaagagcatagccaacttgatagaaaggaggcaatttgaaaccaaagagaataagcgtctactagaaaaatctcagagggtagaagccatcattgcatctatgcaggctactggtgcagaggaagcacagttacaagaaatagaggagatgatcacagctcctgaacgtcagcagctagagaccctgaaacgtaatgtcaacaagttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcattatttgcagtggga

SEQ ID NO: 1688 - DNA, 1590 bp, Homo sapiens
cggaagccgccgaaactctggggtagagtggcacgcgctttttgcttttccgcgtcttcttcggtggcgatccgcgtcctagaaagggcggtgggctccacctcggcctagaaggccagcgggagccgtaggaagccgtcgcgggaagctcagccgaattggagttggagcccccggattgcgctgaccctgagctctcagactccccagtacaatgactcaagcagaaattaagctctgttctttgttgctgcaagagcattttggagagattgtagaaaaaattggagtccatctgataagaaccggcagccagccactaagagtaattgcccatgacacaggaacatcactggatcaggtgaagaaagccctgtgtgtcctcgtccaacataacctggtgagttatcaagtgcacaaacgtggtgtggtggagtatgaagcccagtgcagccgggtattgcgaatgcttagatatccccggtacatctatactaccaaaactctgtacagtgacactggagagctgattgttgaggagcttctgttgaacggcaaactgacaatgtcagctgttgtgaagaaagtggcagaccggctcacagagaccatggaggatggcaagaccatggactatgctgaagtatcaaacacatttgtgcgactggcagacacacactttgtacaacgctgcccttcggtacctaccactgagaattcagaccctgggccaccaccacctgcccccacacttgtcattaatgaaaaggacatgtacctggttcctaaactcagcttgatagggaaaggtaaaaggaggagatcatctgatgaagatgctgctggggagcccaaggccaagagaccaaaatatactacagataacaaggagcccattccagatgatgggatttattggcaggccaaccttgacagattccaccaacacttccgtgaccaagccattgtgagcgcagttgctaacaggatggaccagacaagcagcgagattgtgcgaaccatgctccgaatgagtgagattaccacttcctctagtgctcccttcacccagccattgtcttccaatgagatcttcagatccctacctgttggctataacatctctaagcaagttcttgatcagtatctcactctgctggcagatgatccactagagtttgttggaaagtctggcgacagtggtggaggaatgtatgtcatcaacctccataaggcattagcatccctagccacagccactctggagtccgtcgtacaggagagatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcatta

SEQ ID NO: 1689 - DNA, 1931 bp, Homo sapiens
aagatggcggcgcccaggccctgccacgcagacttccgcccggcgcggagaccgaaggctggcggctggtcgcgttgcaggcaacatgtcggaaggaaacgccgccggcgagcccagcacgccgggagggccccgacctctcctgactggggcccgggggctcatcgggcggcggccggcgcctcccctcacccccggccgccttccctccatccgttccagggacctcaccctcgggggagtcaagaagaaaaccttcaccccaaatatcatcagtcggaagatcaaggaagagcccaaggaagaagtaactgtcaagaaggagaagcgtgaaagggacagagaccgacaacgagaggggcatggacgagggcgaggccgtccagaagtgatccagtctcactccatctttgagcagggcccagctgaaatgatgaagaaaaaagggaactgggataagacagtggatgtgtcagacatgggaccttctcatatcatcaacatcaaaaaagagaagagagagacagacgaagaaactaaacagatcttgcgtatgctggagaaggacgatttcctcgatgaccccggcctgaggaacgacactcgaaatatgcctgtgcagctgccgctggctcactcaggatggctttttaaggaagaaaatgacgaaccagatgttaaaccttggctggctggccccaaggaagaggacatggaggtggacatacctgctgtgaaagtgaaagaggagccacgagatgaggaggaagaggccaagatgaaggctcctcccaaagcagccaggaagactccaggcctcccgaaggatgtatctgtggcagagctgctgagggagctgagcctcaccaaggaagaggaactgctgtttctgcagctgccagacaccctccctggccagccacccacccaggacatcaagcctatcaagacagaggtgcagggcgaggacggacaggtggtgctcatcaagcaggagaaagaccgagaagccaaattggcagagaatgcttgtaccctggctgacctgacagagggtcaggttggcaagctactcatccgcaagtctggaagggtgcaactcctcttgggcaaggtgactctggacgtgaccatgggaactgcctgctccttcctgcaggagctggtgtccgtgggccttggagacagtaggacaggggagatgacagtcctgggacacgtgaagcacaaacttgtatgttcccctgattttgaatccctcttggatcacaaacaccggtaaaatgagcaggtggaggaggacggcgcctgtgcccacggctgctgcctgctccagacattttgttcttgaatctgtgagacccagaaggggcccactgagcccactcactccagcctttggcaaccattgttccaggtcccccagggcttcctcccacagcagctgtgaatggcacagtgaccttcctgcagcgtggagatggcacatccttgctgctggggacttggccctgctatttatttttgtatttatgtcttaatctcttccactgatgcatcctccaagggtagatggggagggtctgtgtgaaggggccggcttctcttggtgcctgctgggttgcaggggcaggaagcgtgtggactgcagcttctgctggtgctccccccgtcctcctggaggcagtataggagagagagcaaggattgagtctgagacttaagcactcggtcccagcttgccagttcctggttctgtgtccttggacaaactacctaacctttctgagcctcctatacctcatccgacacaaatggggatgatacctacctccagggttggcgtgaggattcatgggctattatagatgaaaactgcacaaggccagaaccagcaggcactcaataaacgttcatgtcctttttctcta

SEQ ID NO: 1690 - DNA, 2866 bp, Homo sapiens
ggttcctgggcggggttcctggagagggcgtgtcgcgagccaaaggctctcacctgggtggtcccgggagtctcgccacgtgggaggggaggagctgagaggccactggagggacgcaccgactgggggaccggaaagcaagggggtggggttccgccagggtccgcgtgtcagtcccctctggtgatctcgtcgccccttctctcccaggcaacatgtcggaaggaaacgccgccggcgagcccagcacgccgggagggccccgacctctcctgactggggcccgggggctcatcgggcggcggccggcgcctcccctcacccccggccgccttccctccatccgttccagggacctcaccctcgggggagtcaagaagaaaaccttcaccccaaatatcatcagtcggaagatcaaggaagagcccaaggaagaagtaactgtcaagaaggagaagcgtgaaagggacagagaccgacaacgagaggggcatggacgagggcgaggccgtccagaagtgatccagtctcactccatctttgagcagggcccagctgaaatgatgaagaaaaaagggaactgggataagacagtggatgtgtcagacatgggaccttctcatatcatcaacatcaaaaaagagaagagagagacagacgaagaaactaaacagatcttgcgtatgctggagaaggacgatttcctcgatgaccccggcctgaggaacgacactcgaaatatgcctgtgcagctgccgctggctcactcaggatggctttttaaggaagaaaatgacgaaccagatgttaaaccttggctggctggccccaaggaagaggacatggaggtggacatacctgctgtgaaagtgaaagaggagccacgagatgaggaggaagaggccaagatgaaggctcctcccaaagcagccaggaagactccaggcctcccgaaggatgtatctgtggcagagctgctgagggagctgagcctcaccaaggaagaggaactgctgtttctgcagctgccagacaccctccctggccagccacccacccaggacatcaagcctatcaagacagaggtgcagggcgaggacggacaggtggtgctcatcaagcaggagaaagaccgagaagccaaattggcagagaatgcttgtaccctggctgacctgacagagggtcaggttggcaagctactcatccgcaagtctggaagggtgcaactcctcttgggcaaggtgactctggacgtgaccatgggaactgcctgctccttcctgcaggagctggtgtccgtgggccttggagacagtaggacaggggagatgacagtcctgggacacgtgaagcacaaacttgtatgttcccctgattttgaatccctcttggatcacaaacaccggtaaaatgagcaggtggaggaggacggcgcctgtgcccacggctgctgcctgctccagacattttgttcttgaatctgtgagacccagaaggggcccactgagcccactcactccagcctttggcaaccattgttccaggtcccccagggcttcctcccacagcagctgtgaatggcacagtgaccttcctgcagcgtggagatggcacatccttgctgctggggacttggccctgctatttatttttgtatttatgtcttaatctcttccactgatgcatcctccaagggtagatggggagggtctgtgtgaaggggccggcttctcttggtgcctgctgggttgcaggggcaggaagcgtgtggactgcagcttctgctggtgctccccccgtcctcctggaggcagtataggagagagagcaaggattgagtctgagacttaagcactcggtcccagcttgccagttcctggttctgtgtccttggacaaactacctaacctttctgagcctcctatacctcatccgacacaaatggggatgatacctacctccagggttggcgtgaggattcatgggctattatagatgaaaactgcacaaggccagaaccagcaggcactcaataaacgttcatgtcctttttctctacctgagtctattttcaaacaaaatagagattctaaatctcccagaagcagcgactagagctgctcccgtccccactcttgccccttcctgctttatatcccgtcctcaccctgggcctgatgccctaaatttatggtgtcagattgttctatgcctttttctcctggctcctgttagccaggtgcctcctgtgtgagttactgtaatagctgcaggtaatagaaaggaagaagtcagagacccctcccagcaccctacaaaagcctttgggggacatgttgggcccaggacatgttccctgcactctttcctttgcagttagtactcatgtatgagccgaagtcatatattgctaacaaaaaaactaaatccttcataagagaagttagggatgtattgaataatggcctctttgacacttggccgatgatgcccacttcaaaaactttgggtttcagaggcctgcccgtctcctgtcctagcactgccagagccacctactcagtgttacttttttgggtctgtgatcctgttccctttaccaggtcattgtactgtgttgtccctggaggaacagcttctcctcttgtcttgacagtagggctggggttttccctggttcagctggggagacgtttgcaggttagaaaaaggtctcatgcggcagcgtgtgtggctgttagacgctgatggcacaacttccctttgctggcgtcgtggcacctggcctctgggacagtatgaaccataggggctcaggaagaaccgcttcccctccacccccatccctgattcctagtggccc

SEQ ID NO: 1691 - DNA, 3697 bp, Homo sapiens
acgtgtccgccggagtttctccaccagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcagcatcgacaggttttgcttgaaattttttccaaaaattaccgggtacgccgaaacatgatccagtctcggttgactcaagagtgtggagaagatctcagtaaacaggaggtggataaagtactaaaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcgcagggtcagcttaagttagttagatcactcccagaagagaccagctgggaccttctttgcagtacaatttgaaattcctgatgtattttgcttattatttggtttcattctcataataaagagagtgtatactgacatgggcaggatgataaaaatcatggtttaatattttcttttgtaaacttaatgccaacaaggtctaagttatgtttacaacatgaagaaaacctcaaagttcttaatttttaaaatgcctagaagacaatatttagtcttggattatctatctgctaagacctccaccaatttcattaaaccaaattgaattattctattcttgggattctgtggccacttcacctttgacaacaacctactttatgtagcagtctcaactgtttacatgaaccatagcaaaaaaatcagaatcaaatccatctccttttaatgtttgcagaaagatgcaaacaaaaccaggtaagtatggaacaatgtgtaagtgaggttatcacactttgatgtaaaaatttctattttgtgtatttttaaaataaatgcaaacactaaactagcatcatggtgctatcttcaaatggttacaggaaggcgatcttgttgggctcagcgttacgtgtatctagagggaacggagctaatggaggaagacagagcagcactgtccactagaaagaggcgagtcacgtacataattttgaaagtttctagcaaccacattagtttaaaaaggtcatgttagcatattatttagctcaaaatatctaaaacatcaacataaggtaaaagtcttcaaaatctggcattttacactttcctcaacactcagtttggactagccacatcataagtgctccgatgccacatggggctatttgcgacagtattggatagcacagccctagaaactgatggaaaaaataagagtaagctaggttggatgacatgtgaattttggtatctagataaggctttcgccatcttttttgtacaacacagtcactaattgtctgaaggtttaaatgacggtctatgctatttccccactccccccaaaataaaacatctaatattttagctatagaatcactaaggcattgatcaaggatgtactttgccaaataagtatttggtaacatcacttaacaagttgatcgtgtattgattctgttaacatatgtgaacctgaaaagtaaagttaccaaaagcgatttggaa

SEQ ID NO: 1692 - DNA, 2475 bp, Homo sapiens
ggagtttctccaccagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcgcagggtcagcttaagttagttagatcactcccagaagagaccagctgggaccttctttgcagtacaatttgaaattcctgatgtattttgcttattatttggtttcattctcataataaagagagtgtatactgacatgggcaggatg

SEQ ID NO: 1693 - DNA, 2529 bp, Homo sapiens
ctccaccagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcagcatcgacaggttttgcttgaaattttttccaaaaattaccgggtacgccgaaacatgatccagtctcggttgactcaagagtgtggagaagatctcagtaaacaggaggtggataaagtactaaaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcgcagggtcagcttaagttagttagatcactcccagaagagaccagctgggaccttctttgcagtacaatttgaaattcctgatgtattttgcttattatttggtttcattctcataataaagagagtgtatactgacatgggcaggatgataaaaatcatggtttaatattttcttttgtaaacttaatgcc

SEQ ID NO: 1694 - DNA, 2464 bp, Homo sapiens
gtgtccgccggagtttctccaccagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcgatgtgtacttggccaagagtctggcggaaaagctgtatctatttcagtaccctgtgcgtccagcctcgatgacctacgatgacattccgcacctctcagccaagatcaagcccaagcagcagaaggtagagcttgagatggccatcgacaccctgaaccccaactattgccgcagcaaaggggagcagattgcgctgaacgtggacggggcctgcgccgacgagaccagcacgtattcctcgaagctgatggacaagcagaccttctgctcttcccagaccaccagtaacacatcccgttatgccgctgcactctacaggcaaggtgagctccacctgacacctttacatggcatcctgcagctgcggcccagcttctcctacctggataaggctgacgccaagcaccgggagagggaggcggccaacgaggcaggggactcttcacaggatgaggcggaagacgatgttaagcagatcacggtgcggttctcccggccggagtcagagcaggcccgccagcgccgtgtgcagtcctatgagttcctgcagaagaagcacgcagaggagccctgggtccacctgcattactatggcctgagggacagtcgctctgagcatgagcgtcagtacctgctgtgccccggctcaagcggggtggagaacacggagctcgtcaagtcacccagtgagtacctgatgatgctgatgccacccagccaggaggaggagaaagacaagcctgtggcccccagcaacgtcctgtcgatggcccagctgcgcacgctgcccctggccgatcagatcaagatcctgatgaagaatgtgaaggtcatgccttttgccaacttgatgagcctcctgggcccctccatcgattccgtggctgttctgcggggcatccagaaggtggcgatgttggtccaagggaactgggtggtgaagagtgacatcctataccccaaggactcgtccagccctcacagcggcgtgcctgctgaggtgctctgcaggggccgagacttcgttatgtggaagttcacgcagagccgctgggtggttaggaaagaggtggcaaccgtgaccaaactctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaaactggaaaaagtctataatcttgtaaaggaaaccatgccaaagaagccggatgcacaatcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgccttttcccccccagactgctgcttccccggatgagcagaaggtgtttgccctctgggagtctggagacatgagtgatcagtctcggttgactcaagagtgtggagaagatctcagtaaacaggaggtggataaagtactaaaggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcgcagggtcagcttaagttagttagatcactcccagaagagaccagctgggaccttctttgcagtac

SEQ ID NO: 1695 - DNA, 2416 bp, Homo sapiens
ccgcagggagcctggtacccgcctggagttcctttcccagtgctttcccataggcatctaagaatattccttcacagagttgccaagtgctaaaagttggtttcccaactcagaatgaaggaaccaggcttgtgcgtccgatgggcattgacattctggaaaacaagaataagaagctgtagcggcgcctgtaagtgggccggagcaggcgcagcttggccacctcccgccgaaaggcaaggaaggaccggctgcgacacgaggaagaaggcccctcggcctcagcagagcgctatcctccactggttccccgggttccccggcttgctaccgggctgctccgtgcatctttccccccaggcgtcaggaactgcgccctcatggcggaggtgaaggtgaaggtgcagccgcctgacgcggatccggtcgaaatagaaaacaggattatagaattatgtcaccagttccctcatggaatcacagaccaagtaattcagaatgaaatgcctcatatagaagcccagcagcgggcagtagccatcaataggttgttgtctatgggtcagttggatctcttaaggagcaatacgggccttttatatagaataaaggactctcagaatgctggtaaaatgaagggatccgataaccaagaaaaactagtatatcaaatcatagaggatgcaggaaataaaggaatatggagcagagatatccgctataaaagtaatttgccattaacagaaatcaacaaaattctgaagaatctggaaagtaaaaagcttatcaaagctgttaagtctgtagcagcctcaaaaaagaaggtgtatatgctctataacctgcagccagaccggtctgtgactggtggagcctggtacagtgaccaggattttgaatctgaatttgtagaggtgcttaaccaacagtgttttaaattcctacagtccaaggcagaaacagcacgagaaagcaaacagaacccaatgatacaaagaaatagttcatttgcctcatcacatgaagtgtggaaatatatctgcgaattgggaatcagtaaggtagagttatccatggaagacattgaaaccatcctgaatacactcatttatgatggaaaagtggagatgacgattattgctgcaaaagaaggcacagttggcagtgtagatggacacatgaaactgtacagggcagtcaatccaatcatccctcccacaggtttggtccgggcaccctgtggactctgcccggtttttgatgactgccacgaaggtggtgagatttcaccatctaactgtatttacatgacagagtggctcgaattttaatagagagctatgaactttattgacattttgcaaatgaagttacttagggagcagataatttaattcatgatggaacacgaaatctccttgaaagcaaacttcacaataatggacgtagacttgctgctatgaaaacatattttttttatttatgaagactaaatttatattggtaaaatagccagtagaatatgaaagaaataaggttagtagtgaaattcattcttcaataaataaaacactttgaaactccggaggaccacatctttcaagacttctgatgggtcaaggaaaaagatgccaacatacccgtatttaccaagtactatgataatggctagagtataaaaatgttctttttaaagttatttattaagttcttcattggaagtttttttttatatctggttcactaccaccattttctgtttcctactttctcagtggtttcattgaaaagaaattagaaggggttaaaggcaggaatagcaaagagtgcaaacttggggtatgactgggggagagtggaacatgccttttccgcacaatattaattcctttttgtatcagaaatgttcttttaggagattatgctaccatacttacttcaaacccaatgactactgtcaaggacatattttcagtacataaatactatcattttcattctaaagaatattttcactgttccttctttcttaaagtcttatgtttcactctttaactcaaatgtattctttgttagaatttaccctagattcttatttaatgtctgcagtagactgaatgtttgtgtgcccccagaattctaatgttgaaatctcatttccaatgtgatggtatttggaggtggggcttttggtaagtgataggtcaggagagtaacagcgctcatgaatgggattagtgcccttatataaagagacccagagagctccatcaccccttctgccatgtgaaagggagaagacaaacatccacgaaccaggaagtgggtcctcaccagaaaacaaatctgtaagcaccttgatcttggacttctcagcctccagaattgtgagaaataaatttctgttgttgataaa

SEQ ID NO: 1696 - DNA, 3285 bp, Homo sapiens
actccgcggtcctggtgccgcgtgcaggtcggtgcgcgcttctcccgaggtggaacgggcggcagtcaagcgccggcgttctctgccgtcaccctttccttgccggccggcacttcggctgcagagttttgcccacgcttcgagacttagggagcagtgcctttcagaatttgcccactcatctggtataactggttctgatggctgggaataaaggaagaggacgtgctgcttatacctttaatattgaggctgttggatttagcaaaggtgaaaagttacctgatgtagtgttgaaaccacccccactatttcctgatacagattataaaccagtgccactgaaaacaggagaaggtgaagaatatatgctggctttgaaacaggagttgagagaaacaatgaaaagaatgccttattttattgaaacacctgaagaaagacaagatattgaaaggtatagtaaaagatacatgaaggtatacaaggaagaatggataccagattggagaagacttccaagagagatgatgccaagaaataaatgtaaaaaagcaggcccaaaacccaaaaaggcaaaagacgcaggcaaaggcacaccactcactaatactgaagatgtgttgaaaaaaatggaggaattggaaaaaagaggtgatggtgaaaaatcagatgaggaaaatgaagagaaagaaggaagcaaagagaaaagtaaagaaggtgatgatgacgatgacgatgatgccgcagaacaggaggaatatgatgaagaagagcaagaagaggaaaatgactacattaattcatactttgaagatggagatgattttggcgcagacagtgatgacaacatggatgaggcaacctattaggcatgaaatttttcaaaaaatatttttatgatgcagcttctgaacatttggacagacttgatttgtattttatttctgataaggaataagtacttgtttctgttgttttggacaaatagttgttaccaaaatattcaaaaccactttgagtttacatactagttaccttaaaaattattccctgacactctgacattccttctaaacacctctgccatctctcttatgtactctcatgggtttttttgtatgatttgaatatgaatgtgcctaaagaatttttgctctcttaatctatgtatacatacttgaacaaatcattcttgcttaactgctgatcttttgtaaaactattgctagtcataatggatttctataacctgaaagttgatataatacagcacgtggagcactttaaaaacaaagaaacttgaaaataattttattttttacctttacatggtgtgttctagactactgcattatgactacataaacctacctgagctcttacaagtacagaattgtgagacagaggttttgtgatggaaaacatacacatagggaaaaataccaaactgagcaatataaatttcacagctcacatcttagccagtacaaagaaactttcacatggggtgaatattataatacttgaatttgagacttaatactgtatatgaattaatcatcccactgtaataactgacatcttcaaatagttgggcttatgaaaaatttgactaagacattttattttatactttatgtaaatgtgaaataagttctggtcatataaatatgtagaatgcatgtgtgtgaactctatgaagtgaagtgtggtggccttttatgtttcagagtactcaagtgtacaattgatttatataaaaatgcaaaatgaactcaggtcattttgaaattaatattaatatttttgttgtttaactttaaagctagctcccctaactttatatattttttgggaaaaaatacctaaaaacctcagcctacaaagactctcagaaatgccaaagattttcaaggaaattcatattatatatttcaaaaatgatttatcaatgttatctaccaaaagaaataattttatttttcccctttggggagatattatcctctaatatgagaatcagatccctagattctatttctacctatactattaaactcaaccttgaacctgagcttggttgtttctgtgccttagtttctccactcgtaaacaatttcctataaaaattgtttaaacaccaaccaaaatttaccatatgtattcattctcttgccttaaagatcacttcttaacttacatttggctctcaccctctaaaaatttgtagtttggagagtaactgaaagcacaattttaagaaacatgttttcctcacaaaatatattgtaatctgattttcctatcttgtattcatgcagaaaattggagaaaatgtgtattgtcttgtgccattctgcaatatgaatttctcaggaaaaagatgtttcaatggcaatactttcttaaataattcaagatgggtgtgaggacctatcttattagtttagtgctgtgttaaccatttgtgaattacttcttgtttaaaggaagttgtcaaaaaattttaagattctaaatggaatacacgaataaagtaagccttagaatagaaacctcacaaaaagttgtcatttgcggttgataattaacataggtgttttattctctcaactccttagtaccagagccaaatacaatttagttttcagaaatcttatcaatattgttctatttacctacttataaatctgcagataaccacttgaaccaggcaaatacactgaagataaaggttatttctttttttagctttgaatttgtcatgaccattttagtcttgcagatagcagggcagccccttggggcaaggatttactctgggaggtaccgttaagagccttctttccccctttgaaagatccttttacaatgttaaagtatactagttgcaagaacaagcaggatttgcaggttgctttaccagcatgagtctcatttttctggcttaaaatctgggactgtgaaattattccataggaaagtgaatgttattttgcagaattagcctcttacataaaagtatttgttgaagtgtctttaaaattgctatcatgagcaaaactggttgctgtaatgcttgtttttctgtatttatttacacattaaattcttacaaaacaaaatgtgttcgtttgttttatagtaagatgttttattttgaacttatttaaatgtttatttgttagagaaaactaatttgttaatatagatcttaactagtaactattaagcagggatgtttgttccaaatattcttgaataaacaatcaccacaaacaa

SEQ ID NO: 1697 - DNA, 3251 bp, Homo sapiens
aggtcggtgcgcgcttctcccgaggtggaacgggcggcagtcaagcgccggcgttctctgccgtcaccctttccttgccggccggcacttcggctgcagagttttgcccacgcttcgagacttagggagcagaatttgcccactcatctggtataactggttctgatggctgggaataaaggaagaggacgtgctgcttatacctttaatattgaggctgttggatttagcaaaggtgaaaagttacctgatgtagtgttgaaaccacccccactatttcctgatacagattataaaccagtgccactgaaaacaggagaaggtgaagaatatatgctggctttgaaacaggagttgagagaaacaatgaaaagaatgccttattttattgaaacacctgaagaaagacaagatattgaaaggtatagtaaaagatacatgaaggtatacaaggaagaatggataccagattggagaagacttccaagagagatgatgccaagaaataaatgtaaaaaagcaggcccaaaacccaaaaaggcaaaagacgcaggcaaaggcacaccactcactaatactgaagatgtgttgaaaaaaatggaggaattggaaaaaagaggtgatggtgaaaaatcagatgaggaaaatgaagagaaagaaggaagcaaagagaaaagtaaagaaggtgatgatgacgatgacgatgatgccgcagaacaggaggaatatgatgaagaagagcaagaagaggaaaatgactacattaattcatactttgaagatggagatgattttggcgcagacagtgatgacaacatggatgaggcaacctattaggcatgaaatttttcaaaaaatatttttatgatgcagcttctgaacatttggacagacttgatttgtattttatttctgataaggaataagtacttgtttctgttgttttggacaaatagttgttaccaaaatattcaaaaccactttgagtttacatactagttaccttaaaaattattccctgacactctgacattccttctaaacacctctgccatctctcttatgtactctcatgggtttttttgtatgatttgaatatgaatgtgcctaaagaatttttgctctcttaatctatgtatacatacttgaacaaatcattcttgcttaactgctgatcttttgtaaaactattgctagtcataatggatttctataacctgaaagttgatataatacagcacgtggagcactttaaaaacaaagaaacttgaaaataattttattttttacctttacatggtgtgttctagactactgcattatgactacataaacctacctgagctcttacaagtacagaattgtgagacagaggttttgtgatggaaaacatacacatagggaaaaataccaaactgagcaatataaatttcacagctcacatcttagccagtacaaagaaactttcacatggggtgaatattataatacttgaatttgagacttaatactgtatatgaattaatcatcccactgtaataactgacatcttcaaatagttgggcttatgaaaaatttgactaagacattttattttatactttatgtaaatgtgaaataagttctggtcatataaatatgtagaatgcatgtgtgtgaactctatgaagtgaagtgtggtggccttttatgtttcagagtactcaagtgtacaattgatttatataaaaatgcaaaatgaactcaggtcattttgaaattaatattaatatttttgttgtttaactttaaagctagctcccctaactttatatattttttgggaaaaaatacctaaaaacctcagcctacaaagactctcagaaatgccaaagattttcaaggaaattcatattatatatttcaaaaatgatttatcaatgttatctaccaaaagaaataattttatttttcccctttggggagatattatcctctaatatgagaatcagatccctagattctatttctacctatactattaaactcaaccttgaacctgagcttggttgtttctgtgccttagtttctccactcgtaaacaatttcctataaaaattgtttaaacaccaaccaaaatttaccatatgtattcattctcttgccttaaagatcacttcttaacttacatttggctctcaccctctaaaaatttgtagtttggagagtaactgaaagcacaattttaagaaacatgttttcctcacaaaatatattgtaatctgattttcctatcttgtattcatgcagaaaattggagaaaatgtgtattgtcttgtgccattctgcaatatgaatttctcaggaaaaagatgtttcaatggcaatactttcttaaataattcaagatgggtgtgaggacctatcttattagtttagtgctgtgttaaccatttgtgaattacttcttgtttaaaggaagttgtcaaaaaattttaagattctaaatggaatacacgaataaagtaagccttagaatagaaacctcacaaaaagttgtcatttgcggttgataattaacataggtgttttattctctcaactccttagtaccagagccaaatacaatttagttttcagaaatcttatcaatattgttctatttacctacttataaatctgcagataaccacttgaaccaggcaaatacactgaagataaaggttatttctttttttagctttgaatttgtcatgaccattttagtcttgcagatagcagggcagccccttggggcaaggatttactctgggaggtaccgttaagagccttctttccccctttgaaagatccttttacaatgttaaagtatactagttgcaagaacaagcaggatttgcaggttgctttaccagcatgagtctcatttttctggcttaaaatctgggactgtgaaattattccataggaaagtgaatgttattttgcagaattagcctcttacataaaagtatttgttgaagtgtctttaaaattgctatcatgagcaaaactggttgctgtaatgcttgtttttctgtatttatttacacattaaattcttacaaaacaaaatgtgttcgtttgttttatagtaagatgttttattttgaacttatttaaatgtttatttgttagagaaaactaatttgttaatatagatcttaactagtaactattaagcagggatgtttgttccaaatattcttgaataaacaatcaccacaaacaac

SEQ ID NO: 1698 - DNA, 1330 bp, Homo sapiens
aagcgcgagcggctgtgcgcggtgcgtggtgcgtggtgcgtgatacgagcggcggcacgtggcgcgggtgcggggcgtggagtggcgtggcgtggagtggcgtggcgtggcggggtctcgcggcgcgggcgcgcacccggagctgtggacggagagtgcctccctctggcctcagtttcctcatgttgtagtagcggagcatggcccggaccgggcccccgagaccgccccgtgcaacctcaccgccagcctgggggcctcagcgactgggacgggaccaaggggctcggggattctccctgcccccggccctggtgcgtgactgaccctcctgttcccagagcccccagcgcaggccgggatgttcgtcctggtggaaatggtggacaccgtccggatccccccttggcagtttgagaggaagctcaacgactccattgccgaggagctgaacaagaagttggccaacaaggtcgtgtacaacgtgggactctgcatttgtctgtttgatatcaccaaactggaggatgcctatgtattccctggggatggcgcatcacacaccaaagtctctctaggcttcttcgatgacattctcatccccccagagtcactgcagcagccagccaagttcgacgaagcggagcaggtgtgggtgtgggagtacgagacggaggaaggagcacacgacctctacatggacaccggcgaggagatccgcttccgggtggtggacgagagctttgttgacacgtcccccacagggcccagctcagcagatgccaccacttccagtgaggagctgccaaagaaggaggctccgtacacgcttgtgggatccatcagtgagccaggcctgggccttctctcctggtggaccagcaactagccctggggctggacagtggaccctaccagcctgcgggaaggtggtatggccggctgtgaagacaacagcagctgaggccgatgctaaggagatagtgtctcgagctggacagtgaggcaaggccaggagtgcccaccagcttgccccgctcctccaccatctaggccctgctcctccttcactgcagtgatggatccatctgtggctgtggctgttgggcctccactgaccttgactgaaaagacccttcctggaccctggacttgacaacaaacggcacagacaccaatcactcacagaacagtcactggttttggattcttgttttccttgcaagaacaaaaggttctctagaatccttcagccaccaatgaaatgatcaggcaggagaaaaactttagatgggagtcttgtcatcaaaaataaatacagttgcatgga

SEQ ID NO: 1699 - DNA, 4416 bp, Homo sapiens
cgcggtgcgtggtgcgtggtgcgtgatacgagcggcggcacgtggcgcgggtgcggggcgtggagtggcgtggcgtggagtggcgtggcgtggcggggtctcgcggcgcgggcgcgcacccggagctgtggacggagagtgcctccctctggcctcagtttcctcatgttgtagtagcggagcatggcccggaccgggcccccgagaccgccccgtgcaacctcaccgccagcctgggggcctcagcgactgggacgggaccaaggggctcggggattctccctgcccccggccctggtgcgtgactgaccctcctgttcccagagcccccagcgcaggccgggatgttcgtcctggtggaaatggtggacaccgtccggatccccccttggcagtttgagaggaagctcaacgactccattgccgaggagctgaacaagaagttggccaacaaggtcgtgtacaacgtgggactctgcatttgtctgtttgatatcaccaaactggaggatgcctatgtattccctggggatggcgcatcacacaccaaagtccattttcgctgcgtggtgtttcatccattcctagatgagattctcattgggaagatcaaaggctgcagcccagaaggagtgcacgtctctctaggcttcttcgatgacattctcatccccccagagtcactgcagcagccagccaagttcgacgaagcggagcaggtgtgggtgtgggagtacgagacggaggaaggagcacacgacctctacatggacaccggcgaggagatccgcttccgggtggtggacgagagctttgttgacacgtcccccacagggcccagctcagcagatgccaccacttccagtgaggagctgccaaagaaggaggctccgtacacgcttgtgggatccatcagtgagccaggcctgggccttctctcctggtggaccagcaactagccctggggctggacagtggaccctaccagcctgcgggaaggtggtatggccggctgtgaagacaacagcagctgaggccgatgctaaggagatagtgtctcgagctggacagtgaggcaaggccaggagtgcccaccagcttgccccgctcctccaccatctaggccctgctcctccttcactgcagtgatggatccatctgtggctgtggctgttgggcctccactgaccttgactgaaaagacccttcctggaccctggacttgacaacaaacggcacagacaccaatcactcacagaacagtcactggttttggattcttgttttccttgcaagaacaaaaggttctctagaatccttcagccaccaatgaaatgatcaggcaggagaaaaactttagatgggagtcttgtcatcaaaaataaatacagttgcatggagctgcttaagatctgaaccaaactcaaaataggaagacgggggctaaaaagttattttaagaacccccccaccacaaccacagtcactccgtgggctaagcggggagcaggaagcatgtctggtcacaccatcttggaataggaagccatggctggacggatcggatccactgatggcacacgtggagctgaacttgacgccagcggcggggcggggaggcactgccctcactgttgcagttccttcattctgttgagggcactgccagcgcggaaccactcaatctgcgtctcgttgaaggtgtggttcaggaggatggtctcctgggtcccgttggggtgcttgatgatgcacttcaggggctgcaaggagaaggtgggtgtgggtggaagtggtgggtactgtgtgcccttggccccgcaggggggtcagggagacagggcactgcctggggacctaagaggtcagcaggcaaaccaaatcctaggccagtctgtgcctgatggcccaggtcagacccaggtggcacctacaggggattcctggggcccagagggtcctgcagtgggtgggctgtcccctgagtgccaggtcctggtgagtaaagggaggttggggaggtgtgagggccccgggttgactccaacccccaactctgagaagccactttgctttctctgtggggccacctggagaactgggggcctttccagctggaatgaagcctcctgggagaagctaccctggggccagtgcaggaggggaaacaaggtggctgcccctcaccccaccacctcagggggacccgggcccctaaccttgccaggggtgaagtccttcaggccctgaatggtcagcttgtccacagggtgaatcttgttgtagtcagccgggtcagcgaaggtcagaggcagcaggccctgtttcttcaggttggtctctggaaagcaggcggcattcggtcatcgggggcctgactagcctggagagcttcattttctgaacccatctggggctctgggagatgcccctaatcctgctgcctgggacaatgcccgggcagtgactatggggccctggtctgctccctttcactaggggtgcccctagcaagtgtgcgctggtgctgaggtctgcgaggccttcctgctgcacattcatgatcagaaagaaccccctggcacatgtcctagatctcagcggctcagatctacaagcctggaagcagggcctgcgggaagccgggaagctgagcgtcggatgtgcactgtgtgagcctaagaaggggcaagaggctgacgggcctgtgggctgcagtggacacagcctagaaccaggcccaactcagccacgggcagggagagtgaccttgatcactagggatgggatgaggatggcctgggtacagactccagctcaccgtggatcctggcaaagctcttggtgatgatggcccggcccccaaggtggcgaggctccagagctgcatgctcccggctcgagccctcgccgtagttctcgtctccgatcaccacccacctgatgccatgtttctgtcaggcaagcgggggtaaggttataaggcagaggagggcaccgtcctcacctgtctggccctacctgcctggcctcacccacctggcgcctgggcatcctgaggctcccggtaaaggggctggaggggcccttcctcgcctgctgcctaagggcaagtgaagcctgcgtgaatgagacccaaacgaggccccgaggggacagaggcacgtggttgtttgcagtggcaaagaagacagaagccacccattggtgcttggcagaggcaggtgtgtgtggagggaggttgggtgagacagggacggcctccgggccccacacaagatgcatctgtgaagctcaaggcgcccccttcctgggagcaccctctgccccacccagccaccagggggtgccagagtcctttcacccggctgggccaggacttgggttcagccctggttctgtttgtttctcaaagcagaaaaagtccaatcacctcagaccctctctgcctgctcactgtgaggccccgtgtagccccctctctgagcttttggcctctgacttcctgagtcggcccccttccttgtctttgtctagggccagatatcctaagatatctctcactaactcctcctggtgcagggacccggctgtaccaccggacctgggcctcatgccttctcagccacagggaggggctgcaggcctctcctcccttccacagcagtcccctttgggcttggtcggcctccttcccagtttccactcccctaatgtcctccctgcacctgccttgcaggccccttcaggagtgaccactggcattgcccctatcaactctgacccaccttgtagtagcgggcagtgtcagggacggggccaaactcctgagtgacggcattgcgcacggagttggccttgccgttttcaatgttgatggcaccaatgagcaggttgttggagatgttatccaagtgcccacggaacttgagccaggggccagcagctgagatgtggtcagtggtacacttccctttgaccttgggtggtaagtagagaggacagaggtcagggcatggccctggaggggtggatgacaagccctccagaggcaggcagcaggccccggggcccaggaggggtgacagaggggtgagaggcaggcaagtcttcagacacgtgttctgtggtcctggtgcttccaccctaaggccacatgggctcaggccaggccttcatcccctcaaaggcctctggctgctcagtctcccttatggggcagaggccgcccaaagttgggacaggtcaatgttcgctcacccttcaggcctcagctgcaagatcagccacagacctcatgctggacacaggagcccaggacatgcctgggtcctggctgatgactgattagtctcttctgtcacaggggtgcctggagaccccttaataagcagcataaataaatatctgacacag

SEQ ID NO: 1700 - DNA, 4159 bp, Homo sapiens
gcagtcgcgcaagcgcgagcggctgtgcgcggtgcgtggtgcgtgagcccccagcgcaggccgggatgttcgtcctggtggaaatggtggacaccgtccggatccccccttggcagtttgagaggaagctcaacgactccattgccgaggagctgaacaagaagttggccaacaaggtcgtgtacaacgtgggactctgcatttgtctgtttgatatcaccaaactggaggatgcctatgtattccctggggatggcgcatcacacaccaaagtccattttcgctgcgtggtgtttcatccattcctagatgagattctcattgggaagatcaaaggctgcagcccagaaggagtgcacgtctctctaggcttcttcgatgacattctcatccccccagagtcactgcagcagccagccaagttcgacgaagcggagcaggtgtgggtgtgggagtacgagacggaggaaggagcacacgacctctacatggacaccggcgaggagatccgcttccgggtggtggacgagagctttgttgacacgtcccccacagggcccagctcagcagatgccaccacttccagtgaggagctgccaaagaaggaggctccgtacacgcttgtgggatccatcagtgagccaggcctgggccttctctcctggtggaccagcaactagccctggggctggacagtggaccctaccagcctgcgggaaggtggtatggccggctgtgaagacaacagcagctgaggccgatgctaaggagatagtgtctcgagctggacagtgaggcaaggccaggagtgcccaccagcttgccccgctcctccaccatctaggccctgctcctccttcactgcagtgatggatccatctgtggctgtggctgttgggcctccactgaccttgactgaaaagacccttcctggaccctggacttgacaacaaacggcacagacaccaatcactcacagaacagtcactggttttggattcttgttttccttgcaagaacaaaaggttctctagaatccttcagccaccaatgaaatgatcaggcaggagaaaaactttagatgggagtcttgtcatcaaaaataaatacagttgcatggagctgcttaagatctgaaccaaactcaaaataggaagacgggggctaaaaagttattttaagaacccccccaccacaaccacagtcactccgtgggctaagcggggagcaggaagcatgtctggtcacaccatcttggaataggaagccatggctggacggatcggatccactgatggcacacgtggagctgaacttgacgccagcggcggggcggggaggcactgccctcactgttgcagttccttcattctgttgagggcactgccagcgcggaaccactcaatctgcgtctcgttgaaggtgtggttcaggaggatggtctcctgggtcccgttggggtgcttgatgatgcacttcaggggctgcaaggagaaggtgggtgtgggtggaagtggtgggtactgtgtgcccttggccccgcaggggggtcagggagacagggcactgcctggggacctaagaggtcagcaggcaaaccaaatcctaggccagtctgtgcctgatggcccaggtcagacccaggtggcacctacaggggattcctggggcccagagggtcctgcagtgggtgggctgtcccctgagtgccaggtcctggtgagtaaagggaggttggggaggtgtgagggccccgggttgactccaacccccaactctgagaagccactttgctttctctgtggggccacctggagaactgggggcctttccagctggaatgaagcctcctgggagaagctaccctggggccagtgcaggaggggaaacaaggtggctgcccctcaccccaccacctcagggggacccgggcccctaaccttgccaggggtgaagtccttcaggccctgaatggtcagcttgtccacagggtgaatcttgttgtagtcagccgggtcagcgaaggtcagaggcagcaggccctgtttcttcaggttggtctctggaaagcaggcggcattcggtcatcgggggcctgactagcctggagagcttcattttctgaacccatctggggctctgggagatgcccctaatcctgctgcctgggacaatgcccgggcagtgactatggggccctggtctgctccctttcactaggggtgcccctagcaagtgtgcgctggtgctgaggtctgcgaggccttcctgctgcacattcatgatcagaaagaaccccctggcacatgtcctagatctcagcggctcagatctacaagcctggaagcagggcctgcgggaagccgggaagctgagcgtcggatgtgcactgtgtgagcctaagaaggggcaagaggctgacgggcctgtgggctgcagtggacacagcctagaaccaggcccaactcagccacgggcagggagagtgaccttgatcactagggatgggatgaggatggcctgggtacagactccagctcaccgtggatcctggcaaagctcttggtgatgatggcccggcccccaaggtggcgaggctccagagctgcatgctcccggctcgagccctcgccgtagttctcgtctccgatcaccacccacctgatgccatgtttctgtcaggcaagcgggggtaaggttataaggcagaggagggcaccgtcctcacctgtctggccctacctgcctggcctcacccacctggcgcctgggcatcctgaggctcccggtaaaggggctggaggggcccttcctcgcctgctgcctaagggcaagtgaagcctgcgtgaatgagacccaaacgaggccccgaggggacagaggcacgtggttgtttgcagtggcaaagaagacagaagccacccattggtgcttggcagaggcaggtgtgtgtggagggaggttgggtgagacagggacggcctccgggccccacacaagatgcatctgtgaagctcaaggcgcccccttcctgggagcaccctctgccccacccagccaccagggggtgccagagtcctttcacccggctgggccaggacttgggttcagccctggttctgtttgtttctcaaagcagaaaaagtccaatcacctcagaccctctctgcctgctcactgtgaggccccgtgtagccccctctctgagcttttggcctctgacttcctgagtcggcccccttccttgtctttgtctagggccagatatcctaagatatctctcactaactcctcctggtgcagggacccggctgtaccaccggacctgggcctcatgccttctcagccacagggaggggctgcaggcctctcctcccttccacagcagtcccctttgggcttggtcggcctccttcccagtttccactcccctaatgtcctccctgcacctgccttgcaggccccttcaggagtgaccactggcattgcccctatcaactctgacccaccttgtagtagcgggcagtgtcagggacggggccaaactcctgagtgacggcattgcgcacggagttggccttgccgttttcaatgttgatggcaccaatgagcaggttgttggagatgttatccaagtgcccacggaacttgagccaggggccagcagctgagatgtggtcagtggtacacttccctttgaccttgggtggtaagtagagaggacagaggtcagggcatggccctggaggggtggatgacaagccctccagaggcaggcagcaggccccggggcccaggaggggtgacagaggggtgagaggcaggcaagtcttcagacacgtgttctgtggtcctggtgcttccaccctaaggccacatgggctcaggccaggccttcatcccctcaaaggcctctggctgctcagtctcccttatggggcagaggccgcccaaagttgggacaggtcaatgttcgctcacccttcaggcctcagctgcaagatcagccacagacctcatgctggacacaggagcccaggacatgcctgggtcctggctgatgactgattagtctcttctgtcacaggggtgcctggagaccccttaataagcagcataaataaatatctgacacagattggaggcctctggccacacc

SEQ ID NO: 1701 - DNA, 802 bp, Homo sapiens
ctctcctcgccctctctctgccccacgctgtgcgcgagcacacaggcagccccgccccgcctcggcggggtgggggtggacagaggtttcttattgagcccccagcgcaggccgggatgttcgtcctggtggaaatggtggacaccgtccggatccccccttggcagtttgagaggaagctcaacgactccattgccgaggagctgaacaagaagttggccaacaaggtcgtgtacaacgtgggactctgcatttgtctgtttgatatcaccaaactggaggatgcctatgtattccctggggatggcgcatcacacaccaaagtccattttcgctgcgtggtgtttcatccattcctagatgagattctcattgggaagatcaaaggctgcagcccagaaggagtgcacgtctctctaggcttcttcgatgacattctcatccccccagagtcactgcagcagccagccaagttcgacgaagcggagcaggtgtgggtgtgggagtacgagacggaggaaggagcacacgacctctacatggacaccggcgaggagatccgcttccgggtggtggacgagagctttgttgacacgtcccccacagggcccagctcagcagatgccaccacttccagtgaggagctgccaaagaaggaggctccgtacacgcttgtgggatccatcagtgagccaggcctgggccttctctcctggtggaccagcaactagccctggggctggacagtggaccctaccagcctgcgggaaggtggtatggccggctgtgaagacaacagcag
